United States Patent 8,781,750 (CELL-TYPE-SPECIFIC PATTERNS OF GENE EXPRESSION) - sequence listing, part 9

SEQ ID NO: 36098 - DNA, 316426 bp, Homo sapiens
agtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaatgtgagtggcgccgcgtcccgaggccgggcgagcgggcgtcctcctcccagagtcggcggcgcgaaggggacgggcgtcgcccgcagctcccgggcgcgactcggccgcttcggatccgtcgcctccctcggccttcggaggccggcacgggacgcgggaggagggagcgggtgcggacgagcagcgccggcggtgcagggcgcggggcttcccggagggacgagcggagcgcggcgtcccggggaccgggcggggtccgcgagtccgggtgaggaccagcgggccgagcgcggcgtcccgggtccccgcggggtgagtgggggacgggcggggtccaccgaccggcgcgaggacccgcgagcagggtgagcggggcgcggcgtcccggggtccgggcggggtccatgagtccaagtgggaccggcgagccgggcgcggagtcccggggtccggtggggcgggcggggaccgggcggggtctgggggtccgggtgaggactgagcggagcgcggcgtgacggggaccgggcggggaccggcgagcgggcacggggtccgggcggggtgcgcgcgtgcgagtgtgcacgcttgtgtcatttgaaatgcggggctgacggagctctggtggccggggggaaagagctcttcttaccaaattacccgctcatctgatttaatatttgcaaagatcctttcctaaggtgggagaggggaagcggagacaaggaagggcggggggataattataaagcgtgaaactagccaggtgtactttattgcagaaattagaggtaatttttacgtaatcatggtttgtctgatatgcagtctgtaatttaataattaatgtgattctggttgttttacatgtcgtcaaactaaggtagagcgtttattggaaagaagtagagagctgggattcctgaagaaaggaaagtatgtctaatttttagctggcttgataggaaagtttttattagctcggaggggtcagtaggatctatttgtatttcaggcatgttaggaaaaggaaacctaaaaagagagaaaagattgccagagtgggaacaaaaggtctgtgtcctttttcgacattttaagttttctctgatcaggcgagaaattggatagcggatctaagctgtaattaatctaatccagtgagaaaaaaatggattggtatggtaagagtgcgtgtaaaatgtttcctgttctacccactgtaggacttaacatccctattctgtctggcaccttatggtactctgcagtattgaggttattccaggctttatgatccatttccctggcaactaactttcccctgccatgctagattctttttctagcatgttaagtgttatgagttaagagattcttgagaaactctgcagtggccaattatttgagctgcaaggacctccccaccaaaaaaaaggaggggggtggaggagggggatgatagaatctgttatgcaaattgtcttttgagtcaatattaagaatgttaatttgcttgtacacgatcaggttcatcttttccgtattctgttttggtagttttctccgagatgtgaatcatgattagtaacatttccacgatatttgttttaagagacctctgtcctgtcccccatcttaaaatatatacctgtatagacacgtaatacatgtttgcacatgagctagtatgaaagttttatgcgttttctcctctagaggctagagggtccaggctaaactgaagaattcgcctaatcatgattttgaatttatggtcacctgctacttaagtgaccataatatagctaagctgatgaatgctctatgaatttaaagtgttaatggcctcagaaagatgcagtttcttgtcaattaaattatgaattacaaaaatttaatttatccttttcatttggtggatgaatgtggcctgttcaagcgatttgctctgaactgagcccttgtgccttagccatggagtctcctatgaaaatcctaacgtgacttccacctcacttctcttccaaatgttagttatttccaaatgatagcctttggaatcaaacccaaattgttctcagcgtttgtcagctgttgcttaattgaactaagggaagaaaagaggatttgtaaatgatagttttattatttgtttcctaaatagctattgtgtgtctccatagccctgagaacactagagcatgcttttatatatcgttcataattaactcacattaaatactgtatctggggatagaggtgtgtgggggggaatatgacaagttgaaaatgcctgaaatccgcctaagttgtaagttttattgccatattcacccagttgagaagatagccatgcggatttattgttttagggactggttgtcatgtgtggtatattgccatttggactaaattgcagtcggctagatattggcctgttcctaaaaggaacttaaataaagcataggggcttttctgctgttgatttttctaaagcagtagaatattttcaatggcgttttcccacgagaatatattagataagtttgcaagatgtaatatgtttgagtcctcaaggcagatgaacaaatagcttttgagatgaattattacgcttgatagccccacgagctatccagtgtttaaagagcccagatcatttaaggctctgtagtggtgtagaattgctgtaacatatgcttcaaagttttggggttttaaacattcggtatcaaaactataaatggaaatggacattttaaataatcttggctattaaagtttcattgtctttgtgttactatacaatatcatctacaatattagccacacagcataatgaaaacaggcactgatttttttttaaatttgattttaaactgacagttgattttcaattaagatggtggagagtgtttcctcctttgattcacctttttaatgaccatatacatgcatttagggtttgtaaatggttttggatttttaaacaaagctaataaataaagtctcagaaatgagaaattacagttagactgataaacacagcttaaaaagcattaggtgttagaataagacactgagaagagtctaccaataaattaaaaataaattttttttacatttggtaggtaaccttattgaaaatgagaaaagttatgttgactgtaaattcatcagcttaatgaactagctttttgttaagtcctttcaagttaggataactggcaaaatatctatcagtgtataattaaactgaagggtggttctaaggacatcattgttaaagctgaaaagggctttagagaccatctcatcagacctcattttatagattaagaaactgttagaggggcagtgtgacgagtccaagaagtaattactgcctccccccaaaataaggaaacgtgagttgttagttgagtgcctgccatgcgccaggatagtttattcacaccgtctctaatctgcagggtggatattgcccacattttacagatgatgcttaaagaggtgacctgcttgcccctgccacataggcagtaaatggcaaaactgtggttttcaagtaagtgaacacatgtggggtggcatgtaatgttcatgggttgatgcagagaagaacactgaattaaaggatatgacatacccttttatcaaaatcaaaactgtgccatgtgagaatgagcataagaaataagtatgtcacctgatcaggattgatgtatgtgaaacatcattttatactttctaatttgattccaattcggttattccatatatttattaactaagcagaatacgttttaattaaaaatctttttggtttacaaggttccagcaagataaagatcaaaagcagtggggttctgtttttctcctccatgggcatttaaagtctatttagaaaatgcagttataaataatacggagataactggcatttatcacctgatactctgatggtcatgaaaggaaattaaaatgagaaaagtctaaagaaaagactttgcgtatggttctttaaggaaaatttttgaagtgtttttttcagttgagattgctccgttaacagcacatgttatcagctgctttccgagaggaagaattcatcccacattggctttttagaacactgatgttatctttgatctgggcagaggtattattttaattgtttaatcttgctgtttaattgcaatttgctgggttgagataactttggcatctgttgatgagatgcagtgagctggggaaacaagacccttgaaagacaagataaaaaggtgatgggatttttggatatgaacctagtaattaagatttcatgggatcatttggagtgttttccacttctcagtgtttggttgttttttttttctcccctgacagctacaataacactgtatttggcctctggtaaaagactgcaatatccttagcttttttacataaatccccaaacttcatttctctttaccccttccttacttttattaaaggttaaacactcgtttacttagcataaaaagacaggttacgtttggcatgcaaaatgatctgatacagctgagtgtaatacagccagcgcccaatatgacccagctcttgggcaaaaaatcagggtagcgatcattgttgagacttatatgtagattataatgggaatatgatgtcattgttgaattttttgtaaaaaccgacaaaaatgaaaacaaactctcataaatgttaagcagtactataagcattccgtatctaatttgcatttaaatggaaaatgttatattttcaacatgagtcaaggagcaaaattaataagtcatcaatgttgcttatgttcaatgctgcactttacccaaacttaataggtcattatttccactttagagtattaccgtttgggagattttgtttcttcacgggagggtcacattttcgctttttgttttcggattaggccatcacaaagagttagatgtttgtcagtgtaatgtttgttttacagaaccacagaagggagggtttggaaactactaatgatttccagttcattagcacctacaagttctcatgcatcctgtttgtttcctccaccaaggaggtgccgagtaatataatgaagccagtatcagtggtgtgctacttgtgtagcagtgcagaaaatgtatttttatttttccttaagaaacagctcttgctaaacttaagagaaatggagctgcacattcctgggaaaaacctatgtgggaaacaaaaactaattagagcagcaaatgtgatgctttcaggtaattgtaaaataattattcccctttagtatcatcaccgtgtaattgttccatccaatatcctcatgctctgaatccagatgtgaagggatggaaaccatctcctcctcctgggaatgtatttttcatttagtgagagctttagactcctcctaaaggacttttaaaagaaaggggaagacattgagggagattttgaacagcttcactctccccatttgttctaaatcatgacagaaagtgattactccaactgtttttatagaaatacaattccagttatgtggctgaaatgccttgtgagcgtatttgagatttacgcattggccgtgccaacctggagttttatgaacagtctcttttatgaactgcagattgtatgttctgtttagatactaaaagtgatgttttaaaatcagctgataatttaaaatgtaatgctaataagtgtgtagtcctgtggttttcaaaatgacgtatgagtacaaattcaggttttggttaaattttatttactccatttgagtgaatgcctcagagccaacataaccagcaaattattagacccattttttttcctcctaaagatttatgtaaattaagtttaggctgtatttaaactatcaggtcggctttattagtctgtgtttttctatcaggttatgtggccttttacttaaggttgggttttaaatgaagaaatctattctgaagagatcttcatttaaacaatctgtgcgtcctccagatcagcagcccaggagtcacctaggtagttgaccagtttgccaggattcctctagtgctttaaaggtaggagttagatacaatattttgattttaaatctcagtaattaaagaagtcagtcgggtacggttgctcacgcctgtaatcccagcactttgggaggccgaggcaggcgaatcaccttcaggagttggagaccagcctggccaacatggcaaaaccctgtgtctactaaaaatacaaaaattagttcgccgtggtttcgcatgcctctagtcccacttacttgggaggctgaggggggaggatcgcctgaacctgggaggtggaggttgcagtgagctgagatggcagcattacactccagcctgggcgacagagcaagactccgtcttcttcttctaagaataataatagtaataataataataataatgaagaagtcccggaagtttgtctcctcagtgagactgtatgcagtgctctctgtcataaccatggaaatccagtctccccagtgccacagctgatttgtctgacatttacaagctccaataggactgaagatttcctactttcacagatgaaggtggtgactcactactcagggacaatgaaattaaggtcagctgatttatttcacatcttgacatagcttttggacagcttaaattgtttctggtaccataacagtgtactcccaagtactttgatttacatactaagtctaaaattctgtgcttttatgctgaaagtcttgattttatgctttttctaaagaaagttcacagcttgagtaaaactcattaaattttaaggtggtattttatatcctttctcccaaattatgtcttcctttctcctagtagcaggaaagttgaccctcatttatttgacacaaagacaatcagttggtcttttaggctaaaagagtaaagtattttgtcatttacttgaatgtggtcagtaggcctgaaatatgtgtgggggtatatacatatatgtgtgtgtgtgtgtgtgtgtgtgtgtgtgtgtatatgtatgtgactgtatatctggaaagtcatcttattggacatatggttaggctttgtgtccccacccagatctcatcttgaattgtagtcaccatagtccccacgtgtcaagggagagagcaggtggaggtaattgaattatagggacagtttctcgtgtgctgtcctcgtggtagcgagttctcacgagatccgatggttttataaggggcccttcccccttcgttcaacgctttcccttcttgccaccttgtgagggaggtgcctggcttccccttccctttctgccgtgattgtaagtttcctgaggtctccccagtcatgcttaactgtgagttgagtaaaactctcttctttataaattacccagtctcaggcagttctttatagcagtttgaaaatggactaatacagcataggtcttcgctttcttaaaatatttaccacgaaatggtctttggttacaaaagtgatcatacttgtgtttttggattattaccattgtaactgaaagactttatgttcagaaaagtttcacattgtgaccaaagatgtactgcaaattagtgatactgctagaaaaaagtctcaggactgtatttcaactcttctgcccagaactttggattaactctgatgaagggtgaagacaacctcactctggcagttctgccatgttactgggtgaaaagctcagactctttcccttttgagggcctcttttctcctcactgctgagtccttggatctgggggcttcttctgtttctcagtggcaattaagatgttgctactcctgaggtcttttcagagttagagtaggaagaaaaacagacttcacagagaaatctggacagttgggcctccacggatgttttcttgttatgcagacacatacggtcctccgcggaccacaccccctaccttgtgcctcttggctgctgcttccattttatatgatccatgtcatgatcccactgccacctgttgctgttgaaaggggtccttgaaatttttattgtctaatgggagtccagcatataaactgaacacttaaaaaaggtgaacgttacagcagattcacaagcccggaagtgggtaaattggtttaaaccaacttaaatacctacccgcctcccccgccacacacacccaggtgttttctctttggaactcggggggaagacattgggtatcaagtaaaacagggttgaaatcatttggtccttgaaaactcttaggggaataatagaaagatgatacccaaaagtgtgaagacagaaagcatttgttagaggactaatgtggatttacttcgttgttttgctcttcactcctgaatctctgtaccctggcctagattcagtgtggtcataaccagtacagagtacagctttctctgaagttgtcttgttgcccttcttatgttttcctgatttatatatatgttttaaaaaatctcctttaatgcccgttttatccttttcctgagcggcttcctaagtttcaacagaaggggccacagccgtctgggacttagttctcagggttggagcctcgggaggagagcagtatccaaatacctagctcatcacttgtaaattccactggagcagctgcttgtttctgcgcattgaactgtattttgacttcctacattataggaggagtgttgagttttcgagttgagcataagggtggcgtgtttcggaatgattaactttatggatgtctttgtctgggccagctatatttggctatgctgcagctgtgtttgccttctcaaaattgtcaccaggaggcctccaactgcaattagtcacttcagtccacgctggtaacatctttgctcgtgactcccattgtccagccagccatcttttcttggtgtcaggactgagagataacacaggaatcctttgagaagcctgaatgctgctggcagctctgtctcaaagcagtttcttaatattaagccatccttacattgcctcctcgtgcatttgggattcttctttcttttcaccacaagctcatgttttcctgtctgctcgttcccccttttcttttacgctctgatgtccgaaagttgccgccagcatcaaatggacggtgtttcttcctcttctgggtacctagagcgcttgggaatgcatttttacttctggtgtcttagagtccccttacataagggcccctttcctgtgttggagaggagactgagaggcaagtcgttttttttatcttcacctcggttgagtacttgctacagaatttacctttctttcgggaggaattgaggaaatactttttcttactacaaagaccattttcattccattggctatgcgtggtttttaatttttcatggaagtaacttcctcttggattgttcgacttgccctgtatgtcgtagaatggaaccactagggacatggcttcagggcctctcccagcaccagagtggaagggcatccttcaaggctaggcgtcctttgccactgtcttatgagaatgcctggcctgccttctaatctgttccatgcctacttcaagtctcagttgacttgtcaagattcctcgtctagaaaataaggacaataaaatacgctgcttacctgtcccacagtattaccgtcagactaatgttgggaaagaaatgacaacctaaatattttatagcttcctggcacttaaaactggccgcaagttcccccgcatttcccgggagaatcaaatttaatggaacttcattgcagctgaagagtgaatgttttcttcttcggaactttcatgcttttaagtctcaggcaaagacccataaagcattgttgctcccaagtgaactttcagaaaacgcgcagtccctaggacaacatcatgaagactgattcttttttcttcccctcacctttctgcatgatgattgagaagttcaatgaagttcatgttccttctgtgaactagtggtcagacctttccattctgggatgggggggaagcaaaggcagtatctccacgtggtccttctgaaaagcccttctctacaccagattttgattttcttatgggaagagaatcagccacacgatatgaaggctggttctgacataatgggaatcacaacccttgcagaaacccagccgttaaggaaacgattttttcttttcttttctttttctttttttttttttttgagatggagtctcacactgtcacccaggctgaagtgcagtggcgcgatcccggctcactgcaacctctgcctcctgggttcaagtgattctcttgcctcagcctcccgagtagctgggattacaggcgcccgccaccatgccctgctaattttttgtatttttagtaaagatggggtttcaccatgttggccaggctggtctcaaactcctgacctcatgatccacctgccttggcttcccaaagtgctaggattacaggtgtgagccaccgcacccagcctttttttttttttttttgggagatggaatcttgctctgttgcccaggctagagtgcagtggtgcgatcttggctcactgcaacctccacctcctgggttcaagtgattctcctgcctcagtcttctgagtagctgagattacaggcccccacctggctaattgttttgaacttttaatagagatggggtttcaccatattggccaggctagtctcgaactcctgacctcaagtggtgagtccaccttggccttccaaagttctgggattacaggcgtgagtcactgcacctggccaaggacacgattttgatggtatgaatatggagcagagaggtctgtagacctggcagccttgggtggcctcataaggtgctcaggccgcagaatgcctggaggatgtagatggagagagtccttggggaaatgacctagacaaggaattggtgatttttgccttatgtggtggtgtagggttaagacaaggggtttggggtatgggttatctgtagcatctatgtggtgtccagctgcagggtgtgtcctggttattttggtggttaataaaaaaggcacttctttattctgatgtagctgatagggtctttggagtgctaagagatcagagtctccacagaatgtgacagtttgctcccagtgctgcaagtgacttgatgccctagatcagacagcacagattctgtttggaagcctaaagcctcggtgtgtgaatccattgttgaggaatatcctccacgacgggccaggggaatatttggcacctactgtagctgagagtgtgatattgactgtggagaagctctctgggctgtgaatgtgacctccaaaatgcagactcttgcctctcatcacacagcactttgcattagggtgaaccagggaactttgctggaggcaggggggcctttggcaatatcaaagatgactgttgttgctgagattcttgggaagggaaaactaggtctgtggctgaaagctggcaaaatctttggagaagagggccagccacacagatactacaaatgtttctgtacaaattaattggtactttgtaattagcactttttctcttatcaatgtccaagaagtctgattaactttataggcagactttcagttgggccaacagttttaaatctgcctgttgtaaaaagtgaccaaaattggacttttgtcacctcagaagccacgtgattggccacacttttatcttgcctctctctcagtctcgtttttcaggtctcctaaggatgtgctacttttgttccagatttgtttccagatgcctgctcaagtaataatcgtgcagaccccagaagccagaaaacattttccagtgtcaaccaaactaattccttgccaatcatacgctgctttttggtgtgtgtttcttttaattctgattactaacactttaagggatgctgccttcctgtggttacattttctgaactattttatgagattagttattcttgatttaggatataccatgggccagccatcaggctaaggagtttatattttatcaataattctcagaaaaaatttcctcaataatttgtgtcatttccatctcacaaatgaggatattgaggttctaaaaggtggtggtactgaaaactcgaaaatgtacctctgtttctcatttccaaaatctgaggttgcacctgtgtttctcatttccaaagcctgaggatgcacctctgttcctcgtctccaaagcccgaggtcccacttctgttcctcatctccaaagcctgaggttgcacctctgtttctcgtctccaaagcccgaggtcgcacttctgtttcttgtctccaaagcccgaggttgcagctctgtttctcacctccaaagcctgaggttgcacctctgttcctcgtttccaaagcctgaggttgcctgcaagtctcttgaggattttttggtgtaaacaggttgagtttctggataggtgggcatattggcagctgaatatgtgggttttgagtgtgaaatacaggttcttagctatgacccagcaatcttctacttgttctgtgctcttccacataaattgctttttcttgattgtatttcatagagcaatttctgaggctggaaggcaggagcattgtaagagacatgtcagtggatggggacacccaagcagtgtcaagatctcttaatgcctgaggcagattctcacttactgccaagataaagaagcaattaacattgactgctaaggtggacacttattcttcatttatgataacggtatattttatgaagaggtttctttggaggatttcattagacacctggcattttcccccattaacttccaacttaaaaatttttgcatatgacttagacgaatgcttggccttctcaggtggcgctacgccttcttgtgaattagaaaatggttctcaggtggcattttgtccccacagcccacctcagttgatgaccttatgcagtatcctttctacagtaacatccgtttttactccctcctccttaagtaggcctcgtaagtaggcaatagaataaatgagcctctatgcaggatatcagtggagtttcaatgatggacagctgtggccagctgacatgtggtacctggtccatttcaaggatcattacactttcagccactccacagctttgtgctcaagtgcataaacatttgatgggattctgtgttttcagcaaatcataaatttctgtctacttctagatacccaatgtaaaggaagggataatagaaaagttagagtagaattcatgcatgggttggcctaacccacaaaccatttcatactgaacattagcttgtcgaaatgcctttactcttggcaggacacaagcgccataacctaagaggatgtgatttgagtggagttttcatgccctgtgtgcttattgtattcttgctactgatgcaaacattatctataattacattttcaagtgactgaaaattgcaggctttgtggaacaaaaatacagccaaagaatggaatgtatattcactccaccctcattataaggctttcagaaatcagactgtaaggcccaataccatggctctcaactacgtgatactaactccattctctgatgtttgaacactttgtcaaaatgctgggtttccaatgatgatcgtataatttgaggaaaatgctattacccttttagcgcttcatttgctccattgttgactcaatcacagtggcacctcctcacacaagtcctctatttccaccctgtgaaacaaacacaatttgatttagatcgaagcatgataggcaaagttgagaaagttggttgaggtgcatgccttcttggggcaggtgcgattgcatccctgggacattatatgtctttacatctcccagctccacatagggcttagccaaaaaaaaaaaaaaaaaaaaaaaaattgcttccaggggccacccactacatcatgggctctttctttgtccttagaacctggctttggtaccagaaaaccatcctggtcaattttactcttgtagacacaagatgagacccagtttctaatttcagcttaaaccccttgaaattgttaaagagaatctagctggatggggtgactcagtgcctttcatcctagctactcaggaagctgaggtgggggaatcgcttgaggccaggagtttgaggccagcctgtccctaaaaaaataaaaataagagaatctgacatgttatatcttagtattttgttcattgttgagtagcattttaaaatctaaggaactgtttaatgaaatagatgttccttggttttggatggaaaactaatgagaggaagaatttatgatggcatcgttgttttgtttttaaggcatgaaatttacaatctacgtggtatctcacgatgttgtaactcactttccaggccccagtagagtccaaactcttggaaaatttaaagaaaaattattgtgatggctttatccaaaatagaagcagaataaataattgacgaaggttgctcaggaaacctatagaccattcctgattctctggtgtctgtgtctgacaggatgatatgtcaccaaataaatgtttattgggtcataattaaattgtgaacagttaatgtatatatagtgaattagatgttccccaatatgtatgttgtgttaccttttctaacataaatgataaactcaaatgtatgttgggttttggacagactattttgtactgtaatacaaagattaccaattaggtattaacattcatggagttaaaataactttggggtccaggtgaaaagctttctgagtaatacagtgcatcgacaagggtgttttcattgtttgtgtaaatgattgttacagcttttgaagcaaagcctctacagtgaaaattctgaggcatagacattcctcatcaaatatcactgtccagtggtgaggtgtgagggcaactcaatttgtacatctcatgaattctttctgtgaatcacaaatactgtctcaatgttcagggcattttttttttttttttttttagacagttttgctcttgttgcccaggctggagtgcaatggcaccatctcggcgcaccgcaacttccaccccccaggttcaagcgattctcgtgcctcagcttcccgagtacctgggattacaggcatgcgccaccacacccggctaattttgtatttttagtagagtcagggtttctctatgttggtcaggctggtctcagcctcccgacctcaggtgatccgcccacctcagccttccaaagtgctgggattacaggcgtaagccaccatgcctggcctcagggcacatttttgacaggttatttgttgaggcatctgactaactgcctgggcttttgatagcatggattcttagccaatcagcaaaatttattttaagaaaggtaattagactagaaccaaagtaaatttagcttttaaagttatctaattctcagggtttcttgtgagcccctacagtggcaaattgattcccctgtagtgttgtaaatacagtgtgagtcagaaaatacattacagttgtacagtctgtacagcagatcgaatagttaagttggacaactgaggagtttaggacttacgagttacaagcgacccattattgttggactgaactgattagttgttttgttgtcacttggaaacaacctaaacatttctgtactacctgttcccttttttaagtctgaaatgtctgccagtgaataagagttgcagtttagcattgttaacacaaatatttagtctctaagtctcatataatgtgctaggtggctgccggctgttctaggtgttacaaaaattgtatgaagtataacaatagttgttagattacaagcttaaatatttgatgactctgggcttttgtcctgttgactttgcctgtattttcttgaaggaaacacaagtttaaaatgaagaaagagctgtacttctgtgttgttttggggctatgttggattaataaggaatttcttgttgagatacaagaaattaaccgatgtaacttttaagaccttcattccttattctgtagatcaggtgaggtaaatattataatggggcctcatctttaatttttatttttttttgctgcgtctagatccctcctagatgtgttaaaaatatttcatgtgttccttattactaagaacactggaagaaactgttaatttttattttttttgctgtgtctagatccctcctagatgtgttaaaaatatttcatgtgttccttattactaagaacactggaagaaactgttgattggtggaaatgtgcacagaagcccctcttctgtgatcttggccatttggactgtagcatccagttagcttgtgatgggggaaaatcagcattcatcaaaactggcgatgtggcagttctttcccattcaaaagagctgcagtggtggtggtgcactgctccattaggtcaggttgaatctggtatgatccatggaattaattgtgtaagcagtggcatctggatttttatcgagcctgtccttttgctccctaaacttctgtagcagagctctgtaatttacccgggattgggaatcttgagaacaagtagatgaggatcagtgaaattaagaggatggaattgcagccacttgattgacattcgagatccaacctgaggctctgttttgtgcccttggtactcaagtgggtgctgacctggtttgctgggatactcccagcttccatctattgtcctagcatcgtcattaatagtatcctcctttgaattaaaagtgtccaagtttggataataaattatacagtcccctttctcttgtctgatccttatcaccgcctttcttaaatacgaatgtgtgaccatgtttaaaagtctctgcgtgggattaacccaaacttttccaccaaaatggttaagactttcaaaccttaaggaaaaaaaaaaattctaacctttctccaagccgtcttcttacctaaatccttatacatagaaaagctatttaaaatttaatacaagtttatttgttgtttctaatatggtagcagcctgctgggagatgtctctctacacccttccctggtgcctggatttaatgtggaggaccctgagatgaggcttttggggaaaccttcccattcagtgctgttaataacttttccccgttctggaaagctgggataggcagctcagatgcttcagatgactcagccaaagcgtgaccacagccaggaaatgatctgatgatactgcctttgttctaacactgccctttgtgaaagagtcacaggagagctcagccagatttaatggccctggggtgcctaggtatatttttgaattttaatctgagatactttttcactctgtaaggctaattgctctttctcctaccgtgctggaatttcagaggatttttgaaatatgtgtgtttgaaattggtttcctgatttttacatttatacccagctgtttgttattccgttcagccatcagcatctgagtctcaatggaccatgtaatgtgcagctgtagccagatataatgcttcctctccctaaatgtttcttttagaagcttagagaggcaggctaaagactgctgataacagtattgcctgcattaatatacctgctggagctacacaaattctgcttggcaattttatttcatgaccaacaagcaaagcaatgtttgtgatctccatccctggtagtaatgttgacactgtatatatcaagtatatctgcactgatgtgagaggtagttgtacagctaattcaaactgcaggaagctgtctgatctgcatgcgtaaatactctgaaagccaggctgtacttaagcatcagccaggattcaggtcagacctttgccaagattaaaacaggtccataaactgactcttgaatagagaatttcttaggaaggataattttaggatcatttctcttcagcttatagacaaaccttgttcctaatttgcatttattattcaaatctgtgtttccttttgtatttgtacgatgtaactttgtttagaggctatagcttctactgaatttaattactttgcttccaggctttaaattgagggcagcttctattaatcgttaattactttcttcagccatttacgcagtaaaggtacagttactaattgagggtatgttctatacaatggcaacaggctccttcagtctcaatatttacctttctgtggggactgattatttccctaatcttatcttttgctaaacataaaagtagacatttcattgacatattggacattcctatgatccagtgttagagatcctagataaataaatgggaatcatacttggctctgggttgccacctggtggtgtattgatcccttttagcctcctcagaccaatctcctatgggaagatgatatccctggatctactattccattgctagttttacgctgagagcccgctgggggtttacagataggcttgtgcctcatgggcggctgagggaggaagcatcagtatggcctgggtgttggttgtttttttatgtcatgaaagtatgtgttccatgtgcctttggtgtatttggcaatttgtctccttaaaattcctctgttggcctatgtgacatgtgatgctttttctgattatccttcattacccctccatgccccctttcttccagcctcctgactgtgggcgtcttgcgcttctcactctttggctctcaccttgtccttctcatacttccctttttagagagcttctatcttcacccactgtattagtccgttctcacactgctaataaagaaagatgtacctgagactgagtaatttataaaggaaagaggtttaatggactcacagttccacatggctggggagacctcacagtcatggaagaagacgaaggaagagcaaagggacatcttatatggcgcaagcaagagcacatgtgcaggggagctcccctttataaaaccatcagctctcctgagacttactgtcgtgagaacagcgtgggagaaacccacccccttgattcagttacctcctaacaggtccctcccatgacatgtgggggtcattacaattcaaggtgagatttgtgtgaggacacagccaaaccatatcgaccactgtatctcagctgattggggtggaggtagggggaagctgtttctcaacttgtgatctttgctttttatctggatgtttcctggtgagctgttcctcagtctcagtagcctgggctttgagtcagccatggtagatagtggagtctatctgcttggtgatgggcacgtgctgaatgctcaagctggccacagccccatgtcaacagtttattaagagtgtaacaaaccccactaaggtttctgtaatttactaaaagaacggtgagagttgtttattcatccatttattagactcagtattgtacgaggtgaaggttcctcgtggcctagcttgggctgttgagtttcttactgacactttagtctccactttgaaatggatttaccatgatacttctgtgtcatgatatgcttctagttcatggtcctatgattttaaatttaatttttaaaacatgtataaaggtagagagcaagatagaattgggttataggttgaattaatgagcagtggcaaagtgaaaagcttgagatttctttgttttggggaagccgaagtttatggaaaaaaaaaacagtgattttagtatgtagtttctgtaagactttgtaaaaatgctctttactccctggaactctagtaggtagccatgttaagttataaaccaattgttgctgctggtgataacaggcagaggagctgaagctcgcatgagaaatgctttgtgtcccactgttccctggagatggctgcctcggagaggacccagccacaccagcaaagaggagctgaggtcagcgttcagggggtgaacatagtagcttcatttgaaaaatgacttcctttttttccatctgtagcctggcttccctttgtggagtcctcttgcctagcctctgccctatattcctaagagaaaaaatgcttctaagaatgcatctaaagtggtttgcgctgcattatatcaccaagttgtactggtagaggtatgtggtgtgtgaaattgaatggtatttcaaacggtagtgcttattaagttattgatacaggttggttgtcgacttaggcaaggtgtgaagttaatcctattagacagtgattactcttctaccaaagtacatcaaaagagtagtagttatggtactgggacagtaggaattatgacaggatttctattaataatcaactactatgcagtacaccactataaaaatgaattctagaaggaaaatttgaatatccatttcagcactgatttcatacacattacacatatatatttataaatcatatattacaaaagatggtaggataaaagtcaaggattattattttaaatggtgctctaacattagtataaatatctcacataaaaccatttaaatttctggaaccccataggtgggcttaaaactgtgataattattttaagttatactgattggattcatgtttattaaaacccttctggcatcagtgaaacttactaaacttgcttttggagttaaaaatggaaatttttacagattctttgagatcgaggtggagcagggcctcctgtagaaagccagcagtcttcttgtttcatcccctcaaccatccaccaccctaagccaagtgcgcctgagcttccacagtatcctggacaagtgtgcacacgcgcttgcatccacaccactctcatggcatcgaccatgtaacggcgataacagccgagtcctgtgtcagctctcctattagcgtggaggacactgagagcagaaaccgtgatgcagtgagccttctgcccacaacacttcgtgccctgtatggcacagagtgggtcaaacacatcagatgagataggaagaaaagtggagaatgcactttgctggtgctgagatgaactgggccaattctcatggggcacctcccatgccaggatttgggatgtaagctcatctcaaatgtagcccatcaaagctattaaataacatagtactttttggactattcctccaacctacttcttatgctggttgtgtgaattataccattagggtggtgagctatgtagtcacggtcacagtgtgtactcaaagtaccttaaaacgagttcagagttaattatttacttcacaagacactgcttgtcccatgtttgcccacgtacacatcttattttgtaagctttacacgcttctaatgcatgttactgaaaacaagttcttgagtcacagtttaaggttccatttaaagccactcaatggaagataggttaagtgtacttcataattttgatcattgaaccaggaacattatgtaccagtttttaaggctagtttcatttaggaaaaaagataattatatatctattacgtcttacatttttgtaaattccattgccactggaggaaaccatggaccagagtaacctaaagatgcatgttggtatatattttaattccaggtaacattggaatgtggtatgtgttgggggtgggatcttcctgtttgtttttgtcaagctaatattatttacaaaaaccatcccaaggactgagagcaaaatgtattgattatctttatgtggaccatgacaaattgattttttaattgagacttcctattttcagggagttcagtgtctcgtaggaaaatagtaaattttgaaaaactttaaaatgttcatgccactgatcatgggaccacatgattgttgataagggaaggtaggacaggaggaagttcaagaattctcagggcagtccaaagcagaaggaaagggtggcatttcatttatgtatctgactgccatcttaactgtgttctctgtgaatggcctccaacaatatggagataattcaaaacaagcattaacaagatatagacagtgttttggagaagaagcaaaatagggtctctgtttcgaaaacacactgtcttatgtttagtgtttaataagttcctaatctgctataataacatcttcacagctgataaactgcatcatataataaaagtaacaatagtttatggaacttttaaaggtataatttgtacagaattttaattatggagcctagaactctgagccaccaggagaaacctatttaatgtatcttctatgtagcgacgcacttccaagcagttccttgttgttctggtctggttggtcgctctgtttttcctgtgtaatggtttttgttgttgttccttggttcaacaaatgcttttaaatgcctgcttatgtgcccgttaccatcctaggtgctgggaaaactctgcatcctcaaagttatatccccactcatggaaatgattttttatttccctttgattttgtgagttcttctcttccaactgatttcaccttctacctttcaggtgtttttccattcaatattttgaatattttttcaaattatcaaaaatattcaatattttcaatatttttccattattcagggctgcattaagcctctgtttagctccatctctgtgataggttgttctctggccagctgctgttctatggcctcctgccatgaatatcttactttggttgggctgctataactaaatgccatagactggacgacttaaacaactaatgtttatttctcaaggttttggagactacggagtccaacatcaaggtgctgacacatttggttcttggtgagggctctcttcctggcttgcagagggctgccttctagctgtaccctcacatggttcaaaaaagttgtagtgtccttttttcttcttaaaagagcactaattccatcacgggagctccgcccttgtgactacaactcaatctacttcccaaaggccccacttcctaacaccatcatgttgggggttaggactttaacatacgcattttagggggacacagtcagtccatgataaacagtggtggtatcaagatgtagagtaagatcccgagagagagagggagacactacctaaggcaagacttagggaaatggtagtacagtatcgaaacccactggctatgaataatggtgttggtgtctaaacacacatgcctcaggatttctcttttaaactctgagcaggttcactcagaaagtcataccagggaaagttctcacgccatcttttgtaatgaggatgaaaaaataaagtgcagctatagatggtatcagggtggtaagacttcgtattaacaatatgatttataattcttagttctcaactcattcgtagtttctgatgagtcaagttacatgaacttttctcattgtgttttcagaccattttcctgtgacagttatataaagagatgggtccattttcatgctgtgaatccagtgggatctctgatccttccatcaggacataacattaatccctgtggaattaaatctatcatggagagtttacaatctgtaagctgatatagttggatatccacagacccattactatatatacgaaagaattgtcaagattattgggattttcatatatttggtgcatacttctttctagattactgtgattagttccattgtcatgtatgtgaattgtactaaaattatatattatgatctacccattgggggcataattatgggtacatagttagccatgggtagacttagatggatagactagaacatttctgttgaacgatttttgcatgatcaaaatttcagtaataacatgaaaaggaaagctgggggcttagcactgtgttgatttgtcagaagattaccaagaggttggttttctcttatggtagaaagaaacttacatttatctccttccctttcaaatttgttattattcgacagtagacagtatatttgatcccgagctttttaaagcctggcagcactgttttgtgttgaataactttaaactgggcagtcaaaggttagagttctttggaagcagaggtcagagcaaaggtggaaatgagagtacaattggtggacatcttggttattgctgcatacagatgattgaacggtctctcttgactttgaagactcacattgatgtttcttctaacagcatagactcacattgatgtttattctgacagcgtaagactttaacctggtgtgtcttttctttttatctgagaagctgtgcctgactgtggctgtctttcacataccacgaaagccagtcacccttctaaaatgttcaattcagtggtttttatcatatgcacaaagttgtgcaaccatcatcactatcttttccaggacaatttcatcacccaaaaaagaaaccccgtaccctttaagggtcacctcccccaccccaatttcccttagccccaggcaaccattgatctctgttctgtgttaactggatttgcctgttacatgtacatttcacagaaatgtaattgtataatatgtggcctcttgtgtctggcttttgtttaacttatgatgtttttggagatttatccatgttacagtgtatctcaggacctcatttttatggcccaatatttcattatgtataggtgccacaatttgttcctcagttgatggacatttaagatggtttggcttttaggaataatgctgctatgaacattcaagtacaagtttttgtgtgaaaacttatttttaatcctcctgtgtatatgcctaggagtgaagttgcttggtcatgcaatagtttttgaggaaatgtcaacctgtttgtctaaagtggctgcaccattttaccttcccaccagcagcgtatgaggttccaacttgctgcatccttggcaacagttgttgctgcccatcccaggatcacgatcagttaagtttgcttttgtaatgagaagggtgggacacagaaagtaataactaagcccggagggtattaggcagggccagggctggtagaactcatgtctcctgactcaccgtcaccattcactgcaacattgcatttcaggaaagctgggtgaagaaaaaacacatgagaaaataataattggtctggaattacttatattcattttcccattataaggaatggaacagttggtttctgtgatctctgatgcagtccagttgtgtgtttctagcctcaaccttgccctgaacaccagcattgaatatcccgctcctggctggactctttctacttggatgcctacatggttgcatcgcagacttccgtgtcctgaatcaagctcctcatcccccgtccttcctttctccatctcactaaatggttagccagctgctccgggcagacctccagaggctttgcttctcccacattctccacatccaggccatcaacaaccttgtgggttccgcgttccacctgcagtcgctcctgctgtggccactgctttcttacgccccagaccgagtacacatgtttcccatctggactggtcacccgaccatcatctctcacctggacttgagattgtgctcggatcccccagtggcttcctcgcatacctagaaagcaagccagcgtccttaaaatatcccacagccacagaccgcctgccgcttgcagttccagcatcttacatttgctctgctccacccacatgggcttcttcgctgtcctgtgacgctgccagcacaccctcttcaggttgtctgtgctcgctcttctctctgccctgaaccctcttccctcagttgtgggcacggcctttgcgtcttcacttcttctaagaatctacttagtcgcctcatccaaaggcggtccctgactatcatctcaaaaaaacagtgtcccatcactttctatcctcttaccttactttatccccttcatcgcattttttaccgtttaacaaaatgctccatatttatttgcttttgtgttgcttttccgtattgtctactgggatgggagccccgaaacagcaggggcttggtctcttgagcttactgatatatctgcatagcctggatcggttcttagcacaaaacaggaagtcagtaaattactgttaaatgaacaggttattttattctcccttttggcatcactcagtctttgctgccaacctattttgggtgagctttaaattttttttttacatcttgcaaaagacttctatatgtacgtatcaatttgtgtgaatctctgtagcacagtttcttcgtatataaatttgcaataattctgggcaggtgctttgagacctcatttgagaaatgtttccccccaccaagtaccagagattatgatggtaatattgtcatttttattactcaatctggttttaatacattataacagtatggaccctattagccaagtacacgataatagccttttattacaataccctaggatatactattgtaatattataatatcttattgtggttctaataaggatctcacttatatatacatagagctcttgtagttttataatatccaaggatgagactctgctgttgagaatcttatctaaaacatgataccacaataccaaaagggatattgacaaaatatgtccacgtatttgaattgcacattcatagtttaatttattcttactgtgcagcacattgttacctggaattccagattgttcaagtgccttccaggcctctactcgcctgtttattccatttaatagaatagccaaaaataagtaaggctgatattaactttggtgaagataatgttccagtgccttccagtaccctaaataattcaagaggatatgatgctgtgactgagaacttgtgttccgcagtcaggattacctaaggctgagtcttaactttatttttattttggaggtaggatctcactctgttgcccaggctggagtgcagtggcatgataatggctcactgcagcctcaagctcctgagctcaggctaagagctgggttagttttttatgtttttctatacagacaggggtctcattaagttgctcatgctggtctagaactcccggcctcaagcagtcctcccacttcaaactcctaaagcactaggattacaggagtgagccactgcccccagccattaactttataccttaacatgtcactatgagactttatcttccaatattcagtgtccttacctgtaaaatgggtgaataactgtagctaccctctaagtttgtgtgagaattcaatgagatgattcctataaagtacctggcacctaatgaaatgctcaataaatgttaactgcaattattactattaaaacatttgaacaccatgtgtgatgaaatattctttggcaaagggaggctggaatgactctcaggtaaagagtagtaaaagggctataagtagagcaataaaatgcaaatgtatgacctccgcttctttccccagagctgtacatcattccatttgttgaaaaagggaacggggcctactgctgaacgcaatataacaaatataacacagagacccccttaaggtgccatatctgtttatagcctatttaaagaacaaaaaatagatctttctgtggcacttaatctggccaggacactcacaatacccgttagaatgtgtgcttatttcatcgttacaataatgggagttcacaaatgttctctgctcttttcactgaagcctctaggggtagaggtgaaagaaaggaaacaaaatttaaaatgctcagggtttgtttttaaaggcaacgactcgctcatgaagagtttgaacatacagggagaccagctgacttgagctgtctacaccttccagctctgttctatttgctgctgtttaatgttttcctgcctccccaaccgggctgcacgccagcggttctcaaaatcacggcaccgcttgtctaacaacaccgaacgctgggcccatccccagacgttccgattcagcgggtccaaggtggggctgggaatttgcatctctaacgagttcccaggtgattgtgatgcccgtgtcaatgtgccggtcagaaaatcacagattgccaactgctgctggatgcaatttggatctccctagacgacttggcccagagttgggcacagagtatgccctcaataagtacttgttggttcactgcctctgatgacaccgaaatgaaatataaagggaagataaagtatattaaggttctcattaggcgcactgcctgattctcattaagactgtcctgatttcttttatgtcttgggcatgtgggctcagtgctaattttcatggcttctgtggtccctgaagtacgagctttttcatagactccaaggttctcctcatttaccctttcttttcctaactcatttcagacggacgctaataacagcccgcagaaccctcaggacccatacaggaatgaggattctcatacctcccaaagagtttttgtaaatcccatgtctttaatctcatttcgctatttctcaacaccctattaacataaagcttaagcccttggcttgttgctttattttctaaaattttaaatttcatcgaaactgcctccactaagctaacatgtgcttgagtcactggggagaagaaaatttccagagatgtgatagaaaacaaattgggcttgtagaggaaggattgttcggaattattatattgtcagacccattgtttatttcgctcacattttcctaggtctgagcgctggagtatttcttcaccagaaaagaattttggaggggcgggggaggttgttttgcacatcctttaaactcttcctatttaagcattttagaggaaaatgatgttttccttcatgaaaacagataaaaacaatctctaagtttccatttccactgagtccttgctacttagaagggaatacagtcctatacaaagatattaaagacctgtaaatatcttttccactaaatttctgagtataattttagtgctttactcacagccaacccatgagttcagttttgagatgagtgttttccaaagtagagtccctggaggacactaggagggtgttctgtggatgaaagggtctctatggcaaaaagaacgcaagcttagtgaactcgggtttaagcaaaataaacaggtatctttaattcagggctgtcaggatctttaatatggctgttgtgcattgtgggtatggaagagagcgatttctagagtctctgaccatggcatcttctgatgctgctgttctgcagaacagattttgggaagtactgtgtgaaaatccctacgttatagcatcgtctttgattcctaaagaagcctcagaggtattaaagctgctcttttctgtgtagattcaataggcaaaatttcaactcctttttgaagcaaaaaatttatttttagaagatttaaagtagtgatgagatcttgtttattcagtagttctctcactactgaagacctcagtgcctttcctgaatactgatttcaggctaaatttttctgggatatagacattttcattcttatgttgcctatatttagacaaagttttatttgtctaatttacccatcatgttactgttgccacatgcacttctagagtgaaatactttgggacaaacctgaagaatttttttctcttctagatgtcaactttcaaaattatggaaaaatgaactaaatatcataataaagattcactcattcataatttaaacaagcccctgaagccctctctccaaatgtaagaattgttccctgccagtttgttctcttctcaggttcattgtttggcccacacctcctcccctcaacactccccaaggctgtattccagttagtgatactctgcctgcaatgtagcttttctcagtcactagaaaatgtcaagaaagtatagtttgaactgtggaggttattaatctctacgacactgtcaaaggaaagagggagagttttatagctgcaggttattaacactcttgacaatagaaaagttgacctttttttccccctttgcatttaggctcttgcctctgctttaaaaactggcagtgaacagaatatgcatttttagctttctcagtattacgtatataaaagtagtgagagatgaacctgacatatacttgataatcagatggttgcgttactgtacctagggtattgtagtttaacttttaattccaggatggttatttgtgacagtaaatgttcccgtgccaccaatcctggttttctgttttatcccacctctacttcccgtgtaaggaatatattgacatctgggaagagttagatccacccttgtttgacaacaccattacgctgggtaagatccactaagctgtgaaaacgcattcataaaacacctaaggtagaatctaagaacacagtcttcctcttttcttgaggggcaatccaaacttataaactggatacattacagagcactgtcattttccatctcagccaatctggttcttattcactgactgtaattacaaatgtaggtgtatgaattagttggttaaaaactccaaagtgtgtgtgcacataagtgcattacatgtaaatactctgagtgcagaatacctaatttaaatgagtgacagggagcacaacatcattggaattgtcagggaaacagaaattaggtgttttacagccccgtctttgtctctggatactgcattcatgtattagaagccagaggagcttcaaaatatgtacagaattgagtgggatcttgggtgtaacctattaccatgagaaattggcaagaaggaaatcacttgttttctgcatgttcttatgtaaccttgaacaaactgttctgttaaaaaaaaaaaaagtctttttccttgcttaaaaaaaaaatcagcttagccttccagatattttcaatagctgcacttgttagtatgccatcttttttttttttaaaactgcctgtctttttttctccttacaacttcctaagttaagcctcaagtgagaatctcagcaaattgacttttagtaatattttaattattgagattattacggtgtggtccagtgtggtgaatcctatagtcgttttactcgtgtattctaatgtcaacaggattgtgctagtttagatgccctgtttgcgtctaatcattttatgtcgaaaatagatgggggagaggtcaaggacgtagtctgtgaaaacaatgtgaaccgggacctctgatcttcattcctgttccctttttctcccaacttatttgttcctatccctttctttagtaaaaaaaaaaaaaaaaaaaaaaaatactaattttttttctcaaaatgttattttgtttctgcatctccccttttctgtactacctcacgcttccggcacatacttagagaatttggactagaaagggccatagagatatggttactcataatgacttgcctgcctccttgtagtggttatttttttgtttttctttaaatgggttgtatgtgcactctgggtgttgtggggcggggagtgctaagtgtgacagtgcttacaaaacacaccttcacagctgggaggaggagaacacagtgtcattcatgcatcctcagaacattaccactgcggaggactggcagtgtccttcggggaccccgttgcccgtgtgcatgctcaggggcaccataaacacttgctgctggttccccatgccacctgctggttccacatgccacctgtggcctgtcaggtgctcagagggccttctggggcaggcagtatttatgataaatagtttcatcaggatgtgtggctcagctgggcagctccagctttcttgctccctctgggtttcctgacaaactggcctcctgctaagggcagggaactgaatggcactgagaagagttaatgagccacagaaaatgtggcgttctaagaagagaacagtatttgtgtcccgaactctttgtccgtgaagtgttcagagagaagtccagtgtaatgggcttaaaaacatcctgcttgcactgatctcttttaaatggtgaaagaaaatgcaacatttaaaaatcattaaactacattgtctggacattatttgggcttgggtttcagatacttctgggacatgcgtgagatgagtgacactgctgcagaagtcatggcgagcagaagacatttgtattattggaacctggcctggcttgaacatggagtgtcggttctaatttggttctgctggactgtagcagctcctgctgctggtggggagccagtcatcttggattcatagctacgtgcagacactttctgtgcattcttactctttaatattgggttgagcacttagctctgtagggcctgtttccgtgatctcccatcagtccctgcctttccattccaacatcaccactctgtctccagatgatcgtgcagcctcctgtcttctctctgtcaccaatcccttccaccctgcattgccagacagatcttaaggcctgtctgatggggttgtgcctcttctcacaatacccaggggctgcccttccctgccttgcatgcagagctctgcagattatgcttgagcacaggccctctcctcccctaccattcactcactcgcccactgggcctcttgtttgcctgcctccctgctttcctcctgaatcctcctccataaagcttccactgtgaggaaaggagtgataataataaaactccgaaccctgagaaaacctcgcctattttccaagaccagttctatttttagcagctagatcaagatgcatgaaagctgacagatctaatgttgccttcttgaaagcatggggacacttcttcgctgtgggaagggccaggtctgggaggggtaaggattgtgagctcaatctctatagtctttggtttctaggttttcttagaaagataacctttcttgaaaaggttagctttttagttctttcttggaagaaaagttgtattggagccagacagtgatacagatgctatcttgaaaacatcttttactgcatttcacttgaaatgcttccttacatgttaaatattgaaaacaactaaaacatagagttctcttttgattatccacctatgtattatttatggaaaatattttaaatctggcagtatccttagcctatattcctttgagtttgcctctcttgctcgtctggcttacataaactgtaccaacaacctaaacagcccatgtttataaaactcagcctgatgcctgcccgatcaagtattgcattggatttattcatttacagtatgttgaacacctaagtgccaggcaccacaatgtgctaaggtttcataacagatacggtgactgcctccatggaactccaatttgagagggagacagatgttaatcagattatcacacaaagatacaattacaagctagtttaaaatgtatgcacaggggacccgatttgactggtggtaaagctggtcaaggaaggcttcactgaagatgaaacgtttgagcttcatataaaataccttcacattgcccactatgtaggattaaccatacaatctaatgatcttaactgcttcctagactttggcaggtttttgtttttttgtgtgtgtatgtattgttaatacttttttttttttttttttggagacagggtctctgtggcccaggctggagtgcggtggagcaatgttggctcactgcaacctccaacctccacctaccaggctgaagcaatcctcccacctcagcctcccaagtggctggggctacaggtgtgcaatgccacgctggctaattaggtattttacagtcttgtcatgagccccaaaatgcctaattagctgggcatggtgttagccatgttgtctaggctggtcttgaattcctgggctcaagcaatctgctcatctcggcctcccaaagtgtggggattacagccatgagccaccattctaggctgttgttcttaatactttcttttgctaaattgtgtctgtagaacatttagggaagtctgagaagacaaccagtagagatcattaccttttttcaaagacattgccaaagttagttcagataattcatttttttagttactatgattaaaccttgcttgatgcagacacctgagattgaagcttctttatgctgttactgacctgtaggttgtttgggctcagatgctgatgcttgtttccttagatgatcattgttgcacggtccttgggtgatgtcctgtgggttatcagatgaacttttgtcctgttcagaaccaagcagttccgtattgaaaaatgaaaagctaactgcaattaggtaaactatacctttctttacatccttcaatagttttgtgtttagttggcacttctgccgatccttaacacatttctctgacggtaaccttgtatgatggtatcctttacaacgaaaggtcttttttgttcattatcttgtttgatccaagcagtaactctgcaagtagatggccccattattatggtggaatgtacaggatgataccatatcctgggaagaggaaggaagtggattcaggcactggaaccagtaaatcatgtagtagagggcttctcaggtcaaaatgttattttcctacaatatcacacaactggtccatactaacttttcagagcttcttgtccttagagtgaaatgtcatgttattctatttaacttccattttgattacagcctgagttttttttttaaatgttttcttctttaatcttgtagtattggttcattactttaaaatttattttctggaaaaccaaggttatagcaaagtaagttgtactcacagggtaaaggagacctgcagaagaatccaattcatctatgcctttgaattatcaaccataaacactgtaattatgtgacacattctctggacatttgttttattattattacagtcagtttcccaacaaaatgtcacataacagcattcttttgttccttggatcaactgttaattagttttccctcaatagaccatatcttcagtgaagtagacagaatactctgatctctctcagtattttctagtgcatgaatcctctgcttcctcttgccattggtcctttcacctgagaggcatagctaaggaatcaaaatgcattcaaacacagtcataatcagtttcaagtatgtgttgtggatggattagggggaaatactttttctctttaactcttccatttttaggctaaaagaattttttgcatcaacaaatttgttattcttgttccaagaaacacacattttttaaaaaaaaagactatttgggcattcgtaggcatactctgatatttcttttttttttttttttttttgagacagagtcttgctctgttgcccaggctggagtgcagtggcgtgatctccactcactgcaagctccgccttccgggttcacaccattctcctgcctcagcctcccgagtagctgggactacaggcgcccaccaccatgcccggctaattttttgtatttttagtagagatggggtttcaccatgttagccaggacggtctcaatctcctgacctcgtgatccacccgcctcggcctcccaaagtgctgggattacaggtgtgagccaccgcacccggcctgatatttcttgaatgtacttttgtcagttctgtttatcgtttttattaatgatattattaccaataataaaactatatttgctaattttggaaaataccccattttgatactatctaaacatagccaaaatgaattttgatgtataatttccagtatctttagtaagcaacacataattcaacttacagcctcaagctgtgacaagtgagatgttgttcataaaagagtaaaaagcctggcatataggaagtgcagaataaatgctctacgattattactacaaagctgatgcctgtttgtatagtggtaattacaggatacacagccgtgtcttttattccattatctttccttcaccaaagctttgatctttcatcttgcccttattgtatcatcccatagttactgtggtctcacgaggaagaggcggttgatatttatggcaatggttcctagacttggaggaacatatgtaaggtgctaagattttattttggcaaggatatttttaaaaaatctatcatcagttttcatcataattttttaaagaagaaaacaactgtgtatgtgtgtttgtgtgtgtgtgtgtgtgtgtgtgtgtgtgtgttaataggaccgtcttttaacttaatgtcaatttatgaagaattgaccttgtctttatctcatttcatagtggcctacaggacactctggtggacgtgtagtctgtggattggcactgactgatgtgaaacatgaaggtcaaatgaaagtcacgacaggagagttaagattgttaagggaagaaaaagactttcttttctagtggtttttttctttggagtcttgctctgtcaccaaggctcaagtgcagtggtacaatcttggctcactgcgacatccgcctcctgggttcaagtgatgctcctgcctcagcctcctgagtagctgggattacaggcggccgccaccaatcccagctacttattgtatttttagtacagatggggtttcactatgttggccagactggtcttgaactcctgacctcagatgatccacctgcctcggccccctggagtgctgggattacaggcttgcgccaccgcacccggcttctagtgtattcttttagagaaagttttgagctgttgtagattttgaaaattgattgaattacagatgttactgtaatgctcataacctgtgtttcatgtgttaatgtattattcttgcaaatttcagttgtccagaataactggaaaacaagttgatgggacagatattaactgatacttcacatgtattttctcctggtgtacttcactaggtgaaagacaaatacacattaacacaaagcagataggtagactatacctttgtagaatgcctttacaagtccacattgatacccattattctgtatctagtactacagtttcctcataatctgcatttcatgaacaggatcagattcctgtgtttctgagtcagaaaaactgagagaaagaataataaagggaactatttggctgaccgagtatcattttcctgggaatagttttaatgtggagacacaggtgccataggcactctcaggtgcatttctcctttcagaatctttcctcatccctgtgccctcatgcttcatacacttatgagtgactgggatagatgttcttggcttagatggtttttaagattcgttctaaacctgatattctgtgcagtggtttctgaagtggaaagacattctttgctaaatgtggcctaattttgatcccgattgctctcccaaactcttgatagcgtctggaaggcacggcagactattctgtaggcccagtgcaagtgctgtggccgccatcttgaaagctcttacatgtgagtcttttcttcttttccctctccccatctggagtatcccccatctagccatttctaaaggttccttttcagtcccaactgctgtattatttaaatcccatctacagcactcactacaagcaatgcttaaatctgcttttgtatttgaaaacaaagctttaaaagcagataggggagccacagagaagagtagtgattttgtgacaatggcctaaatccaagaagtgcatttagaaagtgcatttgtttgttttaaacaattggtttcagcatgtttgtccattgaaaatgggaatgctgagcccatgtatagataaaccctctgatggaaactggagatttttgttataggtagaagtgtgtgtgcaatatgggaccctatattccacaattctataaagctctttaaaatgtattcataatcattctaataattcattctgcatatagaatatgccctctcacactcagtcatatttgtggggttattccttaaatgaggctttgttgtttctgcaggaaatgagtggttcgatgtttttataaatcacgtctgccttttctaagatgcatagctaggaataggtgcctaatagcttgctctgtagttgataatcaatcaggtaataatttattacacttgcatgagcttttcaacactgatagtttcactgtaagataaagagaattgtaagatgcaattataagcatactttccataaaatgcactaaggtagagagcaagaaagatggatgtggttggatcttagaggaattcttgtgcagaaagggaaggtatttgaatcgtataagaagggagtcaaggattataaattttaagagtagaatgaaatgtttacaaagcatattgatttatttcttggtagaaatgagccttgtgaaacatttaagatgaagcaggatcagaggatgcattttcatgaagatagtagaccacttatcttaggtgaagaagatactaagagccagtgttagaagcaaatctgattgatcaggcattctaatcaaagtctgaaaatgtgtccattagcaataactctgaaaacttatgccagaaaaagaagtcatagtactgggggaagtctgtgcagggaagggcaaggcccacaggaggaaaatcccacgccatgttcaaccttctaaccacatgcttctgggggaggggtgagtaagaaccgctgcgtgaagtgtccagtcacctgctctcaaatgaattccaggttggtaggttggaggggaggctgtgctggggcaattagtgagcagccgtgcctggaggccctggtaccatctgtgtaacagagaaacagtttgccctgatgaaaaatcaacctccagaggcagcagatacaacccctgaaagaacaaaaagtcccagacccgacttccatgagatgcaacagaagctaatgagccagtgtgggtcatacgaggtgcgcctgcctgtgagagcgatgcctgggcctctagaggggtaggggatgtgtggggtggggggtggtccagcccaactaacacatgcttttgctctactagcatgacccgtgccagaggaaacagtgattttaagaatgccttgaaatacagccaggtaaacacctggaggagattttcattttgctaaatattaatctatagagaaaacaggagaaaaaggaaaacaagttcatagcctgatataaacaactactcaccatggaactctcacaaaggagcctcagccacggccttgtgggggaggatagcatttgaataagtgttgatccaaagagaatgtttggcctttatggatacaaacactgattatacgctcaaagccattgacgtagtatgttttctctttttttccccccgatgaagtacttgaagctggctttttaagcataaggatgtaacgtggggatggtgattgtcagattatgacttcgggaatacaggagtcacaaaatgtttttggttaacagcctgtttctccataccccagcatcatccctttaacccatattgccagaaaaagatgcattttaagatactgcatccaacaagattctgacatttgctagcggtctaccacaaagaacaattatatttagcaagagaagttctactttctactgttagcaagacatgttaaatggaagctttttcttcttcctcttaatttttttttagtctagcttttagattgcctgaaaagaaaaaagaggctaagcaaaatggaaatactttacgcccaaccaaatgggaatagattatctgaagaggaaaaaaaaaaaaaaacggaatctaatgttaaaacctgcccttctggatccagtggaggatctggcatgttccagtcgagttgtagtatttattgcaaacaagtaggcataaaatactaaaccagtttagcttgagctcagccatgcggtaacattgttaagtactgtctgtgaattattctcctgtagtctgactgtatatagctgtcactgccctggtgtgtgcttctaatggaaaaggctgattttaaggagttacactatatttgcatcccacttcacttctggctttaagagttttatcttaacttactgtgttaaagtataaagtattatttttcaacaacctataaaagcaaattaggtgaggtactgttggttttttttgttggtttttttttttttttttttttttgtgatggagtcttgttctgtcacccaggctggagtgcggtggtgcgatctcgactcgctgcaacctccacctcccaggttcaagcgattctcctgtctcagcctcccgagtagctgggattacaggcatgcaccaccacacctggctaatttttgtatttttagtaaaagaaggggtttcaccgtgttggccagactggtctcaaactgctgacctcaggcgatccacccccctcagcctcccaaagtgctgggattacagacatgacccaccgcgcccgggcttttttgttttgttttgttttgttttgtttagagttagtatgtcactttgttgcccatgctggagtgcagtggcacaatcatagctgactgccacctggagttcctggcctcaagtgatccttctgcctcagtctcctgagtagatgggataacaagcatttatcaccatgtccggctaatttttaatttttttgttgagacggggggtttcgccatcttgcgtaggctggtctcaaactcctgggctcaagcaatgcttcttccttggccgcacaaagtgccagggttgcagccgtgagccattgcgtctgtccttctattttatgtatgagtcaaggaacagacatggttaacaaactgctacttcagcgccctccactagtaaacagaaccatcactagaacgcaggctctctgactcatttcaccatggctcatcacatgatgccattttaatcagtcagctgaaatacacattctattccttaatccctggctttttgacttgatttgactagacttgcatgtctgttttagggtggaaaacctgtgcttgagtatatttgtctttatactgtacctgatcatttggcctggtaatttgggagggtttgagccattttactaaggtggggagcaaatttaagaccgtttaccaaacagtttctcagggaaaatgggcccttttctcaccatgaggaaagtgttttgtttacctagcacggtctttttaaggctaaggctgattgaaggagaattctggtgagatggtgaaaacatatcccatgtgactgctcttgtttctgtgcctcaaagatataaaccttgaaggagaaggcttggagtccaaggaaagagttgtgctattgcaataagcccatagccttgcagactccgagatagcagccatcaggacagagtatggaaaatgcagtgatttgtatcagccagagggaagcgcagcctcaggcactggaagagtgaagggtagtgctttcacttaaggaaacttagctggtgaaggactcccccaaactaattttgttgaatatctgaaatccctggaatagtgcacctgaaggagggaatagagcctttgcatttaaattgctggagtttatctgattaggataggtttcaactttcacacgcttaagcttagcacagaatagatgctcaaaagccgttgaattggtcatagttctttttcttggattctttttatttaaaagtgtatcagaaacacatctttgaaatcagaggcttgtgctcaaaatgcaagaggaagagaagtctagtaagagagttggtgctgttgacttccttgtgaatggagattacagtatttgaagagttgaagtctagtttgtcccaccaagtcactgaacagccccatgatctcagaggtaccagcagcagttttactgcattctcatacctgaaagaacatggaatacactttgccattcaatacagcccctaggaaatgggtgaaccccactcaaaacttcctggataggacagctctgcgtgcaccgttcccggcatagtcagtggtgccttcaggattcaggggcattttgtacttctgaagagtaaggtacaagtatgccagattctctcattagaatgaaatcattaattacaggaaaagtgtaattagggtatgtgaaatattttatatggtggagtttcttgatgttaaagatgttcctgcattgcctaccctcaatgctcctgtctttaaaactctccttggctgctcttagaagtacagtgtcatcagcctttgatgtgcttggagatagaatacaggtgcaccttgtttaattgcacttcactggaatgtgcttttcagatactgccttttttttcctttttaacaaattgaaggtttatggtgaccctgtgtctgtctgaaattgtcggtgccatttcccgatagcattttcccaataacatgtgctcagtttgcatctctgtttcacactttggtaattttcacaatgtttcaaactttattataactgttacagtgatctgtgatccatgatctttggtgttactattgtaattgtttcagggtgtcaggaacagttcccatagaagacagtgagcttaataaaagttgtgtgtgaagtgctgccattctctgtctttctccctccacttgggcttttctataccccaaatttcaatttcctaattgaaatcaggtcaattaataaccctgcaatggcctttaactgttcaaatgaaagactaaagaatcaaaagcttgaaattattaattaaagctcagtgagaaaggcacgtcaaaagctgagaaacgctgaaagctgggtctgttggaccaagcattctatccaagtggtaaatgcaaaggaaaagttcttgaaggagattgaaagtgctgttcccatgaacatacaagtgataaagtgaaatagacttattgcctatatggagaaaattgaagtggtctggatagaaaatcaaatgagccacaacagttccttaagccaaagcttaatccagagcaagtccataactcttcaattctttgaaggatgagagaggtgaggaagctgcagaagagcagtttgaagctagcagaggttgggtgatgagggtgaaggaaagaagccatctccatagcatagaagtacaaggtgaagcagcaagtgctaatgaagaagctgcagcaagttatccagaagacctagcaagatcattgatgaaggtggcaacactgaacaacaggtttttcaaggtaaatgaaacagcctgctattggaagatgccatctagaagtttcgtagccaaagaggagaagtcaatgtctggcttcagaggacagattgattatcttataaggggctaatacaactggtgactttcagttaagccattactcatttactactccaaaaatccttgggcccttaagaattttactaaacgtactcttccagtgctctgtaaatggaacaacaaagcctggatgacagcacatctgtttacagcatggtttactgaattttttatttgtttgttttaattgaggcagagtctcgctctgtcacctaggctggagtgcagtggcatgatctcagctcactgtaacctttgcggcctgggctcaaacaattctcctgcctcagcctcctgagtagctagaactataggcacctgccaccacgcccaggtaattttgtatttttagtagcgacggggtttcaccatgttggccaggctggtcttgaactcctgacctcaggtgatctgccctcctcggcctcccaaagtgctgggattacaggcgtgagcctggccagtttaccgaattttttatgcctacggttgagacctactgctcagggggggaaaaaaaaattcctttccagatattagtgctcattggcaatgtaccttgtcatccaagagctttcgtggagatgtacaaagagattaatgttgttttcatgcctgctaatgcagcattcattctgcagcccatggagaggaagtaagttccacattgaggtcttatttaagaaacatattttgtaaggctatggctgctatagattgtgattcctctaatggatctgtgcaaagtaaattgaaaaccttctggaaaggatttaccatattagaggtcattaagaacattcatgattcgtgggagaaggtcatagtatcaatattaacaggaatttggaagaagtggatttcagtcctcatggataactgagggtttcaagacttcattggaggaagtccctgtatggtggagatagcaaagaattcgaattagaggtggagcgtggagatgggactgaattgctgcagtgtcatgatcaaacttgaacagatgagcagttgcttcttacggatgagcaaagaaatcggtttctggagatggacacctggtgaagatgttgtgtacattgttgaaatgacaaaggattcataatattccataaactttgttaataaagtagtggcagggtttgtgaggattgactccaattttaaaagaagttctaacatgggcaacgtgctatcaaacagcatgggatgcttcagaaaaattttccctgagtcagtcaaagcagcaaacttcatggttgtcctgttttaagagattgccacatccttcagcagcaccccccccgccatcagtcagtagccatcagcatcgaggcaggaccctccaccagcaaaacgattgcaagcagcggaagactcaaacgatagttagcaatttttagcaatgctgtattttaacattaagatacgtactttttaaaagacataatgctatggcacacttaataggtttgctgcagtatagtgtaaacatgatttctgtatgcactgggaaaccaaaaaattcatgtgacttgcttcattgaaatactagctttattttgatggtctggaaccaaacctgctgtatcctcaaggtatgtcagtatttaggaacatggcacatacagaagggggctacctatgaaatatttattccccatttgatatctgaagtgatttgaaatcattgaaagatgttgacttaagatggtcaggcgactactaccaaacattcatgacttatctataaaatctccacatgggaacatatacatgtcaatattgaaactagagaattttaattaccaatttttatttgaaagcattgctgtgtgctaagcgctgtgcatagcatttcttatttcagagtaatttggggtcacattttaagttaaagcatcataaataaaaggtttattcatactcaataaaatgccttagaatatagttacagattttaaatgtgaaatctaaatatcatatccttttgaagtgttacacaaatgtggcagctgtctttaaataaaccctttttttgcttgtattcttaacgtagataagacatcgtgtaaaaatgtttgggtttaagaactcagtattgtattgatagattggtggttttcattttgatccacacattaaaatcacctaaataattctttagagacacttgtgcctaggcctgtctctgccctattaagttggactctctaaaaggtgacaatgagcatctttggcttttgcttccagaggggagtggattgatgccttttgcgttctgcatggataatctgatgttttgtagctcctggagtgtgctgtttatcggtggagttgcattcactcagttgaactacaggaaactaattcctgagtgccttcagcagatactttaagggtctgctgcgtgtcaggcatgattcccagcatctgcttgggagagacttgatcccctccttctggagtttatgcttgttgtttcgggcaaaagattgagtcttctcgaagtctaaatgcacaattaacagaatcatctcatttcactgacagatttaacctgattcttagatctgggctaggttttccaaatcatttcacagtgcttgatgctttttctgatttgtggatttggtttctctttaactacgttccacatttagattaattgactgttttcagcaggccagtcccaccagcactcccttcagagtggtctgtggttattacaaccaaggaattatttttgtttgtttgcctattatgatgaaagaaacaatacattgcttttcttttttctggaacagtaaccttcaagtttaaaatcaaacagcatttcttgttaagggagaaaaagtgtttaacactgtggaagaagtaatagctaagcaagtggtatcagttaaaccatagtgaacccatcatttaagagtgaaagatttaaaattattcaggtattttgacctgttctgcttcaaatagagtatataaatgtctcaatccccttttgcttcctcataccaatctcttccccaccccccaaatatgatttaaaatcttgatatatagagcaggagcaccaggaataaaaggcacattcaattaggggagactctttactgacctaaataacagttcattcatgagataatgtgacctgcagtcagagagaaaaatctgttgcttgagctgggataaacctggcatagtacaaaccctccggtagtcagggaatcatctaacattagaccaggtagaaaaatactgcaaaagctttgcaggcccagtctccatttcaggaatgtttctttctcaagatgtatgtgtcatttgtcacctagactatccctggtaatcctgtaatgcacatctctatcagtgtgaagtgcttgctatcgaagtgaagttccctgctatcaaagcaatcaagcagttcaagcagttaagcaatttatgtatcttaagggtgagtttcctttcataacttaaggagctcaccttctgttaaacaaggtctcctctttggagaggtggtcagtgtatcttgggattttctggtggccacgagtttgatgattgccgtgatcaaaacatcaatatctgtcctagaaattattgtatggtgttgtgtatgcaagtatttgtcttacagtgatgcattttcaaaaatgtgagattatcatcttgtttcctcaggtttctttcagtagatctgacggtaaattcttgaactgctaaagggaaattccttactaccgaaatgagctcagattcttttgggaaagagaagcgtagaaataaatgcggtacactaagtagtttgctatccagtgaaccatctagtgtgatggttagaggtttcttggatcattggaatcataaggagctccagtcgttgtttgtgatttatccatgtcaaaatgagggggggatcccacaaggatgtggttttcctctttgaaccaatagggaaaaacttaaatctaaaatatgaagttcagattttattccttcaaaacatgtttatggagcatcagtgaacaagacagacaaaccccaccccccgccattgctgagtgtgcactctagtgaggaatgcagatgctataaataaaacaacttacttagaaggtactatggtcagggtgaggggtaggaatagagcagggcaaggagaactaggagctccagatttggagggcccggggagggttgcagttttaaatagggtatcagggtaggctttctccggaaggagcaattgaaagaaaaccaggaagccactgagggattaggccacgtgcttatgcagggtagagtagtccaggcagaaagcagttatactggaagtgccccatacagcaggaatgcacctggcatgttggaggaacccaaaggccattgtggctgctgagagggcgtagggaggaggaaaaaaggagatcaggccaccggaagtggggtcccagccacacagggccttgtcagcagttaggttttccatggcaccgggagtaaagctttaaagggatttgagcagaagaatgagctggcttcattgtgtgccttgacattcatcagttgtttgataactactatttttttttcttaaatttcatctcttttctggaaccacaccttttttttccttctctgaaaattgtaacagcaatagctcatacttgctatggtgggtgtgctgccaatcactgtacgttgattaaccctgtgacccttcacaacaacttcaaacagtacatgtcatcaccttcattttataggggaggacccggagactgggagagcataaatgattcacctgaggacctcaggtcactcaagggcagagtcagtattccagctgaggcagtgggctcttaactcttaaccacagtagtgaaacactcatgccctcccaccctaagatttccccagacccccatgagcatcccacttgtcagcctcaggctctttaaccgttcacatatgtagttgcccaaaggatgatactatgtcagctggggtgtgcatgtgggttggttgcactgtgtggatcaaggtgtgtctgtcggggataaggaggaggagtggttgctgcttgttggggactcatctgtgggacttaccaattaccatttcccaattacagcatggtttcctaggtgccagggtgtggggggagctaagagacttgcatgtgtatattgaagcaagaaccccagctcctgctgcatctcctcccttccccctgagaccgctggtgtaggtgctgtcggttgtaaacagcacagtcagggtgagactgtgcttggctctgtagttactgtcatgtggcatgatagaactcttgcctacaggtagaaattataatgagggacctgaattcgcaactttgacttcactctcaattccctccatcatccagttattagtcctttaatgtcactctagcttttttatgtcttttagcgacatcatctcatgattttgctgttggatttggaaaggaggaacctcagcttgtaatagaaatgtatgaagtgaaatgagttctaaggaggaagccattataacctcttgtaagagtacgtaaatgtgtacatatttggcagattaaaaacactgggcttacgttaagtcatgatattttatggcaacaagcattctgatagccagtggaaatatatttttgaagtgccggtaaaaggcaggtcgtccattggggaactttatttctgaatttgctaagtaaaacttgcttgcaaatgtgtaatatctgtagcacactgctcttattaatccactggagctgacttcctgttgtccaaggaaaatgagaacgcttctaagtgcctgtgtggcgtatattctactttaaataaaattccacacacaaggcaaggacagtacaagccttttagaaaaaaacaaaacccatgcaagacaaaccaaatctaaatattgatttaaattggatcatagctctttagacaacacctcttagtgcccaccggttcccaagcaagaaactctgtgttctggatagttgtaaaagaaatagaacatgcttcccttgtgtgtttccagtggttgaagttgaaagaacacaggttagagtcagatcaggcatgaatttaaatctcttttcctatttattggttctgagaccctgggcaagttatttaaccttctaaatcccactttcccgtctgtaaagtgaaaatgggaatattcagttggcaagattttgagaattaaaacagaacattgaacatagaccacctgatcccagtaggtacttagtaaatacttccttcactgttgtcaaggatcacacagtaggggatggggggaggatgaaaatatgttaacaatctcttaggcaaaaattctgaagcaatagtgggcacttctcacccattatgacagttatttcacatagtgtggagatagaaccaaatttagactcattttcccaggtccctgttgagaacctactgtgtgtcatgtctgattccagatgctgaggaaacacagtctctacgcttatttaaagtttattgagagagcagacattgaccaaatactcatactaatcagaccaataaatgtcaaaccgcaactgtgttagtgctatgagagagaagaaaatgatattacaaaacagcataatagacaagtttgacctaatcagggagatccagaaaatcttccctgaaaaggatggcaatgatgccaatatcttaaaggtgaagagctgcctgcaaccctcagtataccatcagggtcccttggaccccattttaattttggagtttcttttatgagatgccttaagtgctttaaaggattgctgttgcataaatttaatctttcatagaggtctttgaaggaacaaacagaacattatgagaacattatttctgtttttttttttgagacggagtcttgctctgtcgcccaggctggagtgcagtggcccgatcttggctcactgcaagttctgcttcctgggttcacgccattctcctgcctcagcctcccgagtagctggggctacaggtgcctgtcaccatgcccagctaattttttgtatttttagtagagatggggtttcaccgtgttagccaagatggtctcgatctcctgacctcgtgatccacccgcctcagcttcccaaagtgctgggattacaggcgtgagccaccgcacccggcctcattatttcttttaaggcaaaaaaacaactcattctgtcttagcattaccacatagctctgttggaccttttgtacacctaagacacgttgtgacgtcttagtggtcttttctgtatcttgaaacattttcctatttcatcatctgaggaatttgttcatccatgcttatcaattattcccaaccatactaaaataaatgttagaaaagcagtgagtgatggaatcaaatataaggctgatgcaatagtgaagtgttattatattatccttgagttttcttactgcatgacccacagttttttgtatctttcaagcaggtataaaagaagtcaagaaatgtttttatgtaaattaaaaaaaatctctggttgaacagagtttagaattgatcattttctcccatgatagcaaagaaaaggatcatgattactacatgattcagaagataaatgccaaaagacagaagctctctagactctaatgatgatggtgaaattgatagtgtaagtgaaatctcagattcttcagacgaagatatcccagatgaattttcctcaactcaggaatcatgtgagtcagtaatgcatttcaatggatgaaaaggaaatacggtattcatatccagttagtcattcagtagggagtacttcatcatgcaacattttgcagcaaaaacctggagcattctgtttttgctagaaggacatgtgacaaattatttcatcttttaagatgtttgtttatggaaaatgtacttcatatggtttttataagtggacaaatgcaggtgtgtatacagaggtggttagaaggaatatatgatgtagaaatgaaaagaatcattggcttgtcactctaattgattgcaccaaatccagaaatgaaagtgtttcgtaattattaagccaggaatatggctgtcctttcatcagcaaaactatgagccgtcacatgttaagatactgcgttttgatcatgcagctacgaaaagaaccagaagtaatgatgagctagaacctattagagctacgttcaaacctagagttagcatttgtaaggtggatatattccagcttcattcaggacagtcgaagagcagttagttgcattcaaggaagttacctgttttgagtatctgaagcttcaaagctaggaaaattggagtaaaaatttgggtttgctatttaagttatcactaatgtttccaataatgtttgtactcttgttttattctctaaatcattctttaaattcattcaaaaagtaaaaaaataaaagaggtccattggtgatgacccttttttcttcgtatacagtgggtttagcaggcaaaggaggagggaagagaatttcaggtagagagaacaacacatgcaaaggactcagggtaggagacagacggtttgcttgaactaagtgaaggctcaggtggtgggaatgcagagagcaccagcggtggggcgaggctggagaggatgcgggcacccatgatccagggacctgtagacatgaggaggatttcttccccgattctaagaacaagggaagccatctaagggaattaagcagaggacgggcattgtcacacttggattttaaaaagtgatgatggcatttgaggtgattttgaaccaggcacttgtgcatacaggactgggcctggtgagaaatttccggctggaggtgtggagttggaggttcatctgcatgtagttcaggtgaacatcttgagtcgtgaaaatcttgagcaaagatgaaatcatctggggggaggggtataaagtgagaacatctaagtcccagtgtctgggaccaacaatactttgtggcctgaagagacgatgagcttgtgaaggagacggaggaagaacagtggcatgggagaaaacatgatactgtgtgaaggaagacagaggaggtgaatgttcggggaagggtgcatagcatcagttgctactaaggagtctagtaagaggaaaacgaaagaacaaaagttttggaatttaccaacatagagatacttggtaaccttagtgggagatactccaataaagtgatgagattataggttggattggaactagccagctatgaaatggaaggtaagaaaagaaggggatagtatagatgactattttgagaaatttggctatttaaaggtggtagagagtaaagacacagtaatatcaaatggccagataaatacagcagtgatcctatttattttaatcttgtttatgttttatttatcgaggctaattctgctgtaatttaaatcagttttctaccttcatgaacgacttgagagctcctgatccctttgaattgtcgtgcttccctgagttccacttggcctgtgttttgcagcaagcctccagctaggacatgcgctggttcttgggagcaagctcaggggcatgaagttttattgcaccaggcatccaacatgtcttatcttggtttactcttcacaacaactatatgaggttggtttcattacctccgttttacagatgataaaagtaaggttcagaggaggctacttccctgccagagtcgaacatctaggaagagggagaactgggattcaaacccaggtgactgaggctacacatttcctgacttatcttcgacacaaagataacatcgcagttgaaataaactgcctttcacaagagatttttccactcaaaacccagattttggggcttatttttattgctttcattcatacaatctgtcagtacacagccaattcaagatcagctccctttcttccccgctgttgcctcatccaatgtgtctcttaactgtcttgctgctggaagtagttctgagaaatgaaaataataaaaccagtgttatttcccagaggctttggaaacaagtacaggattttgtttctgctgcttcaccaacccacttattataatctcagttcttcttacctgggaccccacgcaggaacaaaacagatctgaatcctttcatatctcacccctgacaagtcccgagtcaatggggtcatgttggtgacatgtttggacatgtatagaaggaaaactggatggaagtcataatcagcattgtgaccatgacaagttgatcccacattaaaatagaaatgttgaattggtgacgacaccgtgagtttggagattgccttttgggttatgtccttaggatcacacagcatggtcaagtggtccaagatgtggacagctgagttacacattccaggtgaaacagaggaaagttgatagaggtgaggtcgagcaacattcttttgtcgttttttctttaggatcaaagtccccatttaatagatgttttcagcccatggaagacactaatttgagagaattatgtgtttttctctcccagggttttgtaccttctcctcctctctctaatgttaacttatagaacctcttttaagtgcatgtgacaagttgtttctttgccttgagggaaagattttgatgtcactatgtgagactcaagtctttgatgtttaattgtattttacccagatgacaatgaatggttggactgtgtttcctgcatattgctaagaccatgaccatagtggaacctctacagtcagtgctcactttgtgaggctggagtgtgaccacttgcccctgggaggccacggtagccacaccccgttctttgacagcctctttgagcataagagactctgggtaacatagcagattctggactctgggacaaaccagcattattgcctgagctgatcttcactccttctgaattttaaagcaaaggatatagaggcagccccaaccataggagcacaagagtatctcccatccctgtggagtctgtagatggtgacccttaagtttactaacacctcgggttcacaggtatcacttgagttgtggaatatccatttgattgatattcatttaggtgaatcctgatttcccttttttttttacattataaaacggaggtatgctaactgaggatgggaagcagatatccctgaaacataataaaattggtttttaaaacatagaaaacatttttaataactatattaaaatgttaatactatactaataactatattaatatcctattacattatatattataagttattacacaaatcacactcttattgtacaacatactactaatacaagttacatattttagaaatacaattatgataaatataaataatgctaatataattataccaaaatattaacatgtcaaatcttagcaataatacttgaattatgaaacattcacaaatctggacagagcagagtgtaacactggctagtgactcagtgggcctcctgtactgccctcactgtagaagaaactatcccttaagctttgacaattcgctttcaaattatgtagcatttttctctaggaaggctttttattatattttggtggcacttaagccctccagctgcaacaccccttaccctaatggttttgtcttttcagttaacgatttctgggaatatagacacgtttatttaaagtagaggaatggcagtagcagcagggattgaaacacgccgggatgtttagcaatagtcacagcaacatacagtggtatgagggtctggaattttgttcatatccaggcttaatgaattactggcttgtgatagttataaaaatagccaaatttgctggcacctactatatgtcaggcactgtgcctaaagacttcatgtgtggactctggtttcaagtggaatggtttttatatttcactcaattgtggttcactggttaacggtgaccatggcatcagaatggccttgggcctcacagagtgctgatcttactaacgctgactgaggagaaggggccaggtctccctggggtgctggtaacataaggtgatggctgcagggtggtggctgggaaacccacaaatgtccttcgtgttttacctagtgctgtgaagcagagtgagggtttaattcacaatttctttatgttcatgattttggttatacatttttaaatagttttcatactgttatcaaatgtaaaataattgagaatattcttgtaatggccatagaacttggaagctttgaatttgaaaacctaccttagataagtgatttctagcctccgtgccacagccctcgagggtctgtagttgttatcagaagttctaaatccttggacacatcaagttctgtctgcaggctaaagtatatacgagtatgtgtgtgttacaacatctattcaacctattttgttgcttttttgatcagcaaaatgtctatttcaaaacacattaccaaattcaaactagctttgaatttatatccttttgtatttttctcaagtcatctgataccaaaagttcaactattatcccatgagggtgctgaaacatttttttaaaaatatattcgtaaagattgggaatgactgttctgctgcttaagggattttttaaaaacagccaaagattggaagttacttagtgactgtcgcttccagcctaggtctattcttagaaaatatgtcagcttatcctaaagaaaaatttcatcactgaattgaacccttccgttttccaaatatcttagtactgccttagaagtagcatggagttaaagggaaagatttctagcccatgcctgattgccgttttttggtttgcctaattaatattcactatgggataaattacctgctattctttgaaatttgctgaaagatgcccttcattcctgtctgcgacgggggactggtattattggcagcacttgtgtgagcagagacagtgtaggtatggtgcaaaaaatacaaccagtgcagctgagagcatggtaaccattctgagtgtcacaaaaggtgtaaatcatgtgttgcaactctgagcacatggacacagctctattccaacctctacctaggaaaatatccatttcctttgtgcgtactccctggtcttgcccagccataggaattatgtgttattcttatgttgaaatatctaaagcaaatgaatttggtctctaaataacaaattagtcaaaagttcactttcaaccacttactggaatttggggacatattttctcatagaactggtttgcatgtaggttcccagttgggctgcaagaacaacctctttgactcagaatggaattgaaagatgctttcgattctcttgtttcctcttgtcactatgggaaaatgctgctctgtcctaatccccttggccctgaaagtgaatggtcttgtcccttgtcaagtgtggcttgattgtcttcctcttccttggctggctgagtgataaaggcatggagttgccccactctgtggctccttcatttgtaagggatgttcaggagtcatcagaaggcatgttgatacttcttttactaaatagcaaaagcataatgccctttcagcattcctcttctctccccgcccccgtctcttctaaaacagaaaaaaagaaaaggttaatgtgagaactgcccagtaaaaagattatattctattttacaaccttacttattcagtaacgtatggagagcagtcctggtatacagatacatgtacgatgtgataaagtttgtgagatggtaattggattcccaaaaccggtatgttgaaggtgttttattctatctgcaaagagctctaagaaactcaaaagaaggctgctgtgtaaattaagtggattattgctgtgaacatacgtatggacttaaatgtccagggtctacagtgaatgttggtttagcgttcacttagagacttgtctttggcggataaagtgtttgcagccaagcaggtgacattgagaatgaaatgggggtgagcagccatcagcgttcttaggaaggaggagtgattcctgaaggatccaggcaagcaggtgctatggaatgatggttgaaaacgtcgtaggcaagaaaaaagcatcagtattagggcaaaatactagtaatctgattaatctcaattaattaaaatgtttaataaactgccaacatcagtatctcagaatgagtgaaacaaaaagctttcctttttcttcctgtttttgttagaagtttattgaaaaatgatatatcagcatacttttttagtgtgagaaaataccaattaagaacattagtttaactctctcttgaattattcagaaggaaaaacaagtcagatccattgtgggtatttttgttgtttgttttttagagtccaggtagacatgaacaagcagaagttaaaatagcagatgggatattgatggtcatacatgggggaagcttgttaacagcattggcctggtggacagacgccaagcttaaatcaggccaactttactcctcctcgagaaagattattggaggataaggaggatactatacagaactttgtcttagaattgtaaataatagtcaaagagcccaaattcagcagcaagcaaaaagggacagagtaaaaagaaaaggcagttgctatgggggtgcattagcattgcaaggacgtaggcttgatttgttatacagcaagagctaggtaaatgtggcctgagggctttaaatgcgcacagcttgctttaatatctgtggacagacccagatccagggctacttgtcaattctcgaatgttttttaggtgaaagcttctaagaatgctttacagctcagaattaagtactgattgcccactcacatttctcctgttaccagtgtaacatgtagcacctagcattgcctttttaaaagaatgctggctctaggtgaaattgtgtgtttagcctttcctttggtgcatactaaaatgatgtggattcattagggaaaagtttatagtcaaagaagcattgagttgatctatggacttaggtctgtttttaacttcctaagccttaggaaaatttaaatcacctggtttgagctctgcaaatcaaggctttggtagtcagtagtataatttcaggcttacaggggattgactgtaggggagcttgtcttgcagatctaacttggttattgataacatgtagcttttgaaaaaagcaggttatagtaaactagagaggttatgaaagaagtattggacttgtagataatacctggctttgaattcttgctctgtcattgactccttagtaaccttaggcaagtcactttatttttctgggcttcaatttcctcccctataaaacggtgatttcccaagtcctttgccgttttgcaaaccgttaactctgagacaagtgaatgtctccgtggtggtagtagttcacacagtgccgagggttatcattataaataccagattttcagtgtacagaggggttgtaagaaccaagtgtgcacatagggaggaatgtgtgccaacaccagaacaaaccccagcaaaaggctttgagtttgggtgcttttataatgaccaccattgccagttgtttctctcttaaagccaagtacagggaaagtaaggaaacacgactctggaaacatctgaaataatcccaagtgggtcagttctgatgagtccagtactgaaggcattgtaaggcttttataacgagagacctgatgccctaagcgtgatcaaaataccagaagtaatgaggtcaatttgttggcgttcgaaacttctgtcttccaaatactgagccttgaatgtgtatgcttttgtcttctggaaaatgatgcaaatcctctgagccttgtaaaaaaatacctattattacttttatcagcaaaatttgaagttgaaaccagaaagcaattaggttcaaagttagcgtttatcgtcgtgtgaaacatttcattgccctgtaagtgagatacattgaagtacaggggtgagcctcttgacagatgaattatgaacaattcaccataatcaaaaccatacagtgcacataaacataaaattaatatcacttttatggactctagtcccacagcttgagaagttatgtgagtagaagaaaaatatgtaggacaaagacagcagtctttcaaactgctacatcaggatttagacatacagtaacacctgtaaaagcatattaggagttttgcagctaaagcccaaagtaatccttgagaaaagcataccaaagggaatgcaaaatagaaatgagagctgggaagtgacctgcgtaggtaggctagagcagaccatttgcttctggtttgagataattccctccattcgtgtttcatccatttcgttttgaatgctttcccttggaggacaattccatagtctaatagatacagatacttgagagcttctttaagacattcagtctatttataaaaaaaaaaaatgctcctccagttgctgtataattgttcttccttgtattatcctaaaggaagtggtggggggcggaatgtatgcaatgggaaatcgagttcaacaacatttctctcttgggtgctacagatttcatctttcataaacttatgctttgctcacagaaaatgattaccaagggaagggaatgaattcactgcttttccagagctgaacgagttctacctataacaggtgctcacagagaataacacagtcccaagtcgaaatagtccctaaatgtatttttccttggcctcattttaatgcttgacccatttctagagtcactggtttcattcatccagaaccttgttcatttccaaatcccctatcttccaaaatctatctatactccctacaaactaaccactcagaaaagctaggtagagatgtaacactggacttatttaaaagcttaatgggtgaatgaataattatgtcagattagaaaagagtgggcggttctttctcttcatgcacggcttgcagaaaatataaaagaatcggaggctgccagtctgtattctcttacctattacatattcttgacctgtgcaagaaaagactctaaacctttggctgtccagtggttgctgtctgggagtgatggtgctattgggcacatccattgctttgctttagagaatcatgctgctcccttcttcagcataacgtgatgtgattaaagaattaagcaaatgctgttggacccaaagagatttgttttacaattgattaaatcacttgagcagctcacattttctattgcgatttggagtctgtgtgtacagttggggtgtgacggggtgcatctccttcatgtactcaaagtataaaactacttactcctctgttttactcttactccctaccctctctggagttttaaggggactccttacatttattgccctggaagtaaaactaaaaacgttctaaaacttactgagagtgacaagagaggagtatctcaaaaatgtataaatttcatacgttttttgtacttacctgaactaaagtcctctcacctaaatgaactcttattctaaaatagctttatgttcccatctgtagaccttggttttagcagatacccagcttttaggttgaagtacagctgtcacctcaacaaaaacgtgcggaaaatgcagatggcccatggtatggtttggctctgtgtccccacccaaatcttgccttgaattgtaataatacccatgagtcaagggtgggactaggtgaagacgattgaattatgggggttcagggattttccccatgctgttgttgtgatagtgagttctcaggagatgtgatggttttataaggggcttcccccttcacttggcattcattctcactcctgcctccctatgaagaggtgccttccgccatgattgtaagtttcctgaggcctctgcagtcatgcagaactgtaagtcaattaaacctctttataaattactcagtcttgggtatttcttcatagcagtgtgagaatggactaatacagccccccccccctttttaggccatggaatctagcaattcaagatgaaaagagaagttgtcactcacctttccctcttgggtcagcttctgccatcacctggcagtatcatcacatatgatcagagttaccacagtagagtgcaaacagcaatagcaagatgcactgtactgcaagatgactttgggatttgttagctgctgaccatttttactacttatagcgctaagaaaaaaatgaaatggaaccatccagattataaactgttgtgaattgctctccggtttataaatgttttagccatatttatgagagtcattaaggtagagaggaaagagctttgcacttgacagatgctagttcaaatgctgattttgctactgagggtcaccttgagcaaatcatttaacctctcacaacctcaatttcctcattttaaaaatggaaataacataggtttattgtgagaattaagtgaggtcatgtaaaagatccaagtagagaccccattaatgttagttccccttgctttttctttgtttaaatgagctgtatttttacaagtcttttacagtcatgaatggataatttcttataagcacctagttcctggaccatcctaggtgcttagtaaacattcatggaatgagcaagtgggcgagtacatatatttagtgggatgtggctattactagttcctctattaagaccaggaacatacagtttgcagtttacctgtgattactcagaaaatggattcactgatggctacctggacatctataaaaataagtagactttgtacttatttcaggcaaaggcagtgttagacgtgaaagtttctgtctgcattaaccattaccttcctctctatcagacactcattctgtgagaagataattggtgcatgacagtgatttggatattgaagggccttttcattgtgtattgtagagagaaccttatgtgggtggttaatttaagacttctgtgataagcccctattccggaggtggaggaggatgctggacaggctttgctgagacagtcttaaatttcagtcaaagtcctgatagtcacctaatgaaaagaaaattatatgaaccacaagttgatccacgtctgttgtcattagaattaagttgagccagctgccagtttctagaggcaggctagggctgtctgtctcagcctgcttctggttttactttctgagtgggcccagtgagatgaattagtctggtgttcctttgaaaaacaggtgctggttgaatttctcagatgttgctttagcatccatttcatagaaatcaaacttagaaaaaattattctttaaatggtgcttatttggggatagggggcaattccagtcttataataaattcattagtgaagtgaagacttactcatgtacattggttctagcagataagaacttttataaaatgggacatgttctcatgttaatagcatcagctaaaaatgtaagattttttttgaagaagcttttacaaagggattttctattacccaggttggcaaaaagaccagcagcctagggggaggaagaaagaagccttcaggagttggtgtctaaatctcagtctcataattgaaagggtgcttcttgaaaactcaagtttaactagcatccaagttctctaagtcatacctgggacaattcaagtttgaaaaactgactaaacaaaatgttagggaaagagcattcacgttcccaatagaacatttttcccaggaaagatggaaattctacttgaggagcctgctttgctgttttggcactgagggatcagataccagccagaacttggaagagttgagatagaaaaaaaataaaaaataggagatttcattaaattcacgtgttagaacctctggaagggttctcatgggagatggatttagaaatagatgaaaatttgtacgaggagattttgacagatttgttttttctctggcatacttgacacatttttttgcccactctggtaaataagtattggcaaagggtttctagtgtgtatcagctgggcttccttgatattctttaccttaagaaagaaaggctttcaggacacattcatcacttagggatgtattttccctggcctctgatgtccccattatattggtgctgtcttccatgcatttttaactcatggagaatcaaataaaacaagttttattctgggcctgataacacatcaccctggcctagttttcgttccctggagagacttgcagatttgcctgtcactttggccagtttatcacagagtggcatgtgttcctatggcctggggctggggctgcatcccttgcttctgtttggacccagagtcctgtggagggcaggaatgaggaaggtgacaccccctgtccacgctcacacaggcccatctctgctttacctccagggactctttcagaatccaaatctgttaaaactccaagaaaacataggaaaaaaaaatggtatcctgcttctagctccttccaacagaggatcctaaagagagtccactcagttgcagccaacggttgaactttgtttcgttgcagtgataaggatgagctgtatgacctgcccaggtgctgatatctatctccaaactctcttcccgctagttgttctatatttccagatcactcagctgttcaacagaaacgtactgatggctggcctgggtgaggcactgtgctaggtggccctgcagggcagtaactgagtccttaggagacataaaaatggctccagatcctactttgctctgaatagagagtaactatgtaaatcactcctcttctgtggctctcaagtctctgatctgtaaaatgaggagattacttagatgagctctgagatcccttccagttctaaaaatgctatgattttcagattacagatctctggagtcagtgtttcacatttccaaatttaagttgaaaaccacattctttgagctcttggcatgaagtccatgctgtctgtgagtaagccatgctttatggcctgcttgcttcatccatggtaggaaacaatctattgacttcaagatacctcttgtagatggagaaagaagctgccttcgagcaaaatggtcagaatttgttgtccttcagatagtgtgtgtgaaacagccccttggtgtgtaatgattagctgtaaatggaatgaggtgaagttactttttcctaatatctctaagctgaataaatagatgtcagataaaaaattccattcatataagaatagtgttcctcctctcccttcatgaaggagtcagccatgaggatggatcgtaaccctgggtcccatcccaggacacagtgcatccttcggttgtgattgttatcttatcctgattggcagtgaggtgggggttcagggtgacccttctgttcataccacggaatctgttgacagctgacacctcttttgggaaaataaaaatgaactggggaaaggagtgaaaggaccattatcactttgacagatgctcatgattggggactgtgccaactggtgaattcctaataataggaaacaaatgtgtatttcagcttcttgactgctctgtgaaaggggcttctaggaaggaacccttaaatgtaaatgtaattgagtttaaataacagggacgggaagaggccacaaccgactggcctaggagtagcgtgatgatggtggtatctatttctgtcacggaggggtgccaagaccccaaataaccagcctatcaaggatggaaaatagcttgggtcttctatgaaagtttttactaaggtaatgttaggctccctctctagaacctcagttcagccctctgctttgacctgttttctcctttgcattttccatatttccccttttcctgcaatgggtgatgcatgtagttactctctgccccatctcaccgagttgagtggttgagagcaaggacttgggagtctgacagcttgaattggactctgggttccaccactgacttgggcaagccagtgaacctctccataccccagtgtcttcatcattagaaaggggatgatgatgccattttcatttagtgataagggagaattagatcagaaagtgtacggagagggccttgaaaccaaggctgacatgtactgaccacgtcttcactctgtgcttcccgttgccagtctcagcaaccacagcatggactatatcagacatgatttactgctccctcaatccaggggcccagaccccactattgaagggtcacagccattaccagcccactgtgaagatccggtccctgctggttgccagtggtctgagcaagtaatgttttggcaaggaaaggaaactgtcgcttggaagattcattttcctccagaagaatttactatcttgttttctggttggatgtaaccccaagaagtaaaataattcaattccacagcttaggtggagtaatagctttgttgatggtgtctgccagatatggtggtggaaacaaacgcaagtgaatatgcggctcttgtgttcagggtcttgttgggcagccagaggaatgcatggacacaagattggctgtgtttttgaacaaatgtgggttagaggtagatgctatgcttaggtccttactgggttgaaagaaggcgtgtgccagagcacaattaagtgtgctgtacaaaatgctacattagagttaaacaggctttggggtgctgagtggtgaatgtcatttggaaaggctgaagatgatgtcttagaatttcacttgggcttcaagaaagatggacagtatattaatgggcagagtcaagggtggagttgagcgagaaaaatgataatcatgcacttaaattcacagttggtataattcccaaagactcatttctgtttttaaattgaaaatgaaaataccactttaaaaaaactagtcaatttactattgatatagaattctaagattttacctgataattagtaaaagtccctaggaaagagaataaaagaaaaaaaaacccacggtctcattttctaaggtctgcccagagaatgtgaaaattactgtctagagaatacagaccccgcaacaaagaggtcattatcgtcaaactgctaaggtcatcagtatatacgcttttaaataaacccaatgatcctcttaatatcattacggaaattctaggcactaacacattaaaagtatccttttgggatgttctgctattactgtatttttcaaaggctttggtttctgaaaatttctacaaatactctggctttattagttgataatacaatgatattctcagtatttgaatttactcgtttggcttttctttcatttacgtaaaatattgagaatatggcagtgattttatatttaatcatcatgctgttcttccccctaagttaacaaaaagaagaagtataaccttaaggtttagtagatactgtcgttgaagacattggaaatcattttccagttctttacagacaagaaaactagacccaaagtaaagtgctgtggtcagcagcacatcattgttcagtggctggcctgggtctagaagccagaccttttaactcctaatttgatgttcaccttttataccataatcctgttcattgaaaaacatggggtacctatagatttgagcccgtgtattagaacaccgtgaatgaagagtccaggagattgtcaaatacattttgattggcaaattgttatttggcaataacaataatagctaacatttacaaagttctcctaagcacttttatgtataataattcattaaatccatcacagtgaccttgttattggtactgctgctttccccagtttacagatgggccgttgaggcacagagagttgacagaaactgcctaaagttacatattgggaatgcaaaagcaggcggtctggttcagggcctgcatctgcttccccaagatgggatccagttattgggagttttttgtccccacctccccatctgccttgtgtcagaagcagtttttataatgtcatattaaccacacagttaataaaacagactgcaccaccatttgaatcctgggtcaccactccatttccagaaatacatcgaggatagcactgccctggatgaatccagaccttcacaataatccagaccttttctgtcaactctctgtgcctcaacggcccatctgtaaactgaggaaagcgacagtaccaataacaagttcattgtgatggatttaatgaattaatacacgtgaaagtgcttaggagaacttcataaatgttagctattgttattgccaaataacaatttgcaatcaaaatatatttgacaatctcctggactcttctttcatggtgttctaatacacgggatcaaatctataggtacccactgtttttcaatgaacaggattattcaggataatgcagtgccatctggaagacccttatagctatagggcagctccactgaggagagagcggaatctccccagttgagcaggtgatttaaactcccctggcattcgcagcaataacaaccgtatttttccctccgcctggcctgtgtcttgactttggacaggagtccaaagtgagctgcgtctttgtgtctgctccctgcactgcagagggtgtgagctgcacgctgcctacccgggtctgatagggagtggggattagacgccaacattccaacatcattatgtaaagtaaaatagcatcattgagagaggtgaggctgagcagtccaaaatatttgataacactgaaagagcgtttttcctcttccacagtgaatccatgtctccatttgcatttgttaaaaaaaaaaaaaaaaaaaaaaaaaaaaaaaactcccgacagcaccagcaacacaacaggagagatgcacagcctgagcaataaatctctcgaggcattcagcaagtgccacagggctcattaatcttgattatttcccgtaatagataacttcacaaatcagctattattcctaatcacgcacataaagataatggatgggtaatagcttcctgcatggttagaccaaaataaaatttcatgtaaaaatatatttctacacattccagggaaaggtgttttcttgctttcttaaagggacaggaggagatgggggagcaaccactgagggcaaaattgatccttgagaattgggtttgaaggaagtattaggtctctctgatttgcttggagacattcactggcttgtgtgccaccctgtcactgtgaggcgggtttgagagacttagggccacaggaggctacagaattgtctagttccagtctctagatggtgtttgggaagactgctccccaaaatataaagcactgtgacatcagtgctgtcttacatctctaaagatggcattggtgttgagaatgtttgctgagtttgaattctgttatcttcccagggtttatggacgaccccaggaatgctcttcatataccggctcccaaactgaatgaacaatgtaaaaagattgataggtgatgagagatgtgtttcgtatatattgggatggggtgtggatgataaagcattggtattttaagcagttgacactagacaagagtaaacctaaagagtcctaggactcccaggtctttttcaaggggcaaaaacctgtgtcttttgagtgcctgaaagagttctaactgaaattgcccaggtgaagggaagtagcaactggcttctccatttaaattatgcccttctgacggcccgtcgactgacgtagaacatggcactgttatcgcacagcagcgagctgcagctgtctatcattttcttctcaaaatgccagtgcattaaagcaaggcctggaatgagacacatcacatttatgacaggatttgactccatattattcagtcagtaggaataatcagcctatcacaacaacacatacccacagaaacatcgtcttataacacacgcctttgaaccccaccctgcgttgctggatagtgctagcaaatgtccttctacagcctcttctccaggcacctaaagtcaaaatttcacctcagacttctctttttacctgcggtgaagtagttaggctttatcagaacttccaaaggagaaggagggccggtctacttcccagggcctcgcatactatacatgtttcttaaatgttggagtagaagatgattaactgttttcctgccaatgaagtctgttcttctgatacattctccactgtgacagaatcactgaatgccctttaggtagaaggcagtgtgttaggcattgggaacacaggtgttaaggtgtgatttgagcctttaatgaacgttgtgcttcagtagaggaggtgagaggcaaaagccaatgcccacacatgagcaaaggtgaggcatgccagaaaggaggctagagtgaagtgctgaggacattcaggtgaggcaaggctgtgcattgaaggaggcacgaatttgtacccatggctatgaggggaaaagacatgagaggcagagtgaacagcatgagtgaggcatatgcgtagaaacacttcggacatctttagagggcagtgaccaatccaaccagatgggaacatcatcagtggaaaatgagagataaagcagagaatgtgatgttaggctgaattttagaggactttgcatgctgggctagggggttggacattgttccctagacattagagatctagtaaagggtttatagcagggcatggcatggttagacctgtggtttaagaagatgaattcagtaagctacagaatggactagaggaggaagagcctagcagagccggatttctcaaatgatgatgcttcttggctgtgtgaatggatgtgcagaaacacatgtcttaggcagagggagccaggaagcactggtggttttgttgggtgtggtgggtactgctgtgtaacacatcatcccatacttagttgcatagaacctcttccttatggactgcgtgggtcaggagtttggacagggcacagagatggtggatggcttgtctctgtctgacaatgtctgggagcctcagctggaagaattcaaatgacaggtgactcagctggctgaggactggagtcatctggaggtgtcctcgctagcacatctgacaggtgggaagtgttaccagaaaactgggctcatctggagctggtgactgaagcacatgcaagcctctcccgtgcgttgggctgccattggcacggctgctgggtttgagagaggcgagcttctgtaggggggagccttctagtagaaccaggagaaagctgtacagtcttttcagcctagcctcaaaagttgaacagtgccacttctgccacatccttttggtgacaagagtcctaagagccagcccagattcaagaggagaggattggactcccactgtcattggggatggcagggtcacgttgcaaaagagcatgtgggatgggaataatttccggagccatctttgaaacacacagtaggccacagtggaggttggcagccgatggcagcaaagatgactaattcagttaacacttgctgagtttgaggtgcgcataggattttgaaggtgaaaagggtgtagtaactgaagatagaggactttacacaccagcctagagacattgaagacttttaagaaaggagataaaagcagagatagtggccagagataagcgtaactgctgcaggcatctcgacatttagaagagcaggatgaggaacccaagaaggggagggacagactgaggagaatatgagccacagtggctagatgaatgaagagcgtgaagacaggagtgtcagtatatggtctttgaaagaggtttcagtggctggtggaagcagaagccagatggcaattgcttaaggattaacgaggtagagagaaggcagaaggcatgagaggtatatccaaaggagaagaaatcaccctaccaaaaatatacatgccctcatatgttcatcacagcactgttcacaatagcaaagacacggagtcaacccaggtgcccatcagtgccaggttggataaagaaaatgtgttgtaccatggaatacttcgttgccataaaaaaaagcatgaaatcatatcctttgtagcaacgtggatgagttggaggccattatcctaagtgaactcatggagaaacagaaaaccaaataccacatgttgtcacttgaaagtgggagctgaacactgggtactcatggacatgaagatggaaaccatagacaccaggaactccaaagagttgggaggaagggaaggggacagacatcaaaacctagttactgggtactatgctcagcaccagggtgatgggatcatttcacaccccaaacctcagcatcacgcaatatacccaggttacaaacctgcacatgtaatccctgaatctaaaatgaaatttggggaaaaaaaaaaaaaaagtaggcctagggagcaccttgaatgctatgaagggaaacaaggcggtagaagaagtaatcgtggaagacttaggaaaagagaggatttttgtatatgtttgtatttaaaagaataaatggtagttttttcctcccagattgaaggacttatttttgaccttcagaaaatatgaagtacatcatgtctgaatctggatatgctgcttttatgtacttctttccctcctcccaattaataaaaaatcaaatgaatttctattttctactgtttaatagttggaaaggattttataggttagaatactcagacattttaacagactcacttgagaggacattgaaagattgatttttaatttggaaatgtacatattgaaattatagcattatatataatcttgaaaaattagaggcagcctaaatatccagcaataagagaataggtaaagatattatgatatatctacataatagaatacttcatagccatttaagattgtagtgataaggaaaaaggctaataattactgattattttctattctctagcactggggtgggacggaagtgatctaatggaattccacaagagttttaagagggttaggtcatactgtcatcaatgtttaggtgaaaattgatacctaagttaaaaatcatatgtgcatatgtaaacaactttttaataaaaatacaggctagaaataaacaaccgatggttaaattagaagaaaatgtacagacttattcttccgttttttaaaaacatgtaatcattgtattgaatatcattcttttataatccatagttaatgtgttcaagatcatgtgtagacttaaatatcaattatgagttaccttctgaaattccttttgaataggatgatttcaagaaaaaaagacataaagcagtaagcctatggtatgaatgtttgattctccttttttgtctaatcagcttcctaacataacatgttagggcacagctgctcctcccagtccccgacaaacaccaaattcaggttccatcattttaataagtgggcgttgagtcaactgagtagaagacattaagtgaaatcgctggtcttccaggacaggggaggtaaggctgttctccctggggaaccgttcagcaaaggaatgaaattttttgtgagaaacatggcctcttttacagaagttaatcagcctgttctgggcttgagaaaatactgacctccatgcctaggacctgaaagagatgaggccttgagtacatggcacatcccttcaagaaagttcatgtgctttgccttttctttcaatgcctttcctcattttttaaagacagggtaaactagatttgtgaggaaatactacgttgcagccttctgcagtcaaacgagcatgttctctgctgattgacagcaatacaaggaaaggttacatcgaagatggaggcgaacccgaatttttttcccctaccagcctagtagtttctgaactcattttgtgaaatgaaactagtagaaaaatttaacccacagaaaaatggggaaaggcaagcaataaaattaccatgaatgactaaacatgaacttaccactgtcaaaatcttctccaagttaaaaacatgactctcaatcaaatacagaatgaacgattctcacagatataactcgttcatgaggaaaccagtaagacggtaacgttggcttaaagtgcatttgcagaaccaggtatttacaggcatttagaaaagcagaataaaatttctcagttatatataatactgatcaatatcctagaacgtaataaaaccataaccattgggatgatcatttcaactagacatacatctagaatttaatctgtaacttctaatccaaggccaaagagcaaaatcagagatagatccttcttctgagagaatgaaataatccccatacaggcctctgaagggccccagtatgacaatggaagggcacagtctaccactgccaccttaccttattcataggtgttacttattcttaacatcacacagtgtttgcttctccccctcaacttttaaacacgttttaagaaatgtaatacaactttcagcttcctttattagaataatgatggtgatcaaaacacaaacaagaggttgttggcggacaccactttatccttgatctcaggccttggtccccttattccaggcactgtaggggagaaaacattttcacccattgcaaggttcatagctgagaccctcataacaaaagattaagaaaagaaaagcagatagatttatttaacgttacgtgggcgccttcataaggaaatgaagagctgaagaaacagggagaactgtgtttttaacagtcatgcagaaatatgattggaggaaagaagggtatgatctcatggttttgaactaaggagacttaacaaggcttgtttgttcaaattcttctctgtagtccctgtttcttcagagataaggatgttcctcttctctgggtatagacaaggccagaaaattctttccaggttttgtgaattgcttcagggaagaaggtgagagtggccctcttgcctgtgctgttttcacaaatgccaagatgccacagtttgggatagcatggcctgaaccccatcagcattctagactgctaaacgaacactcagtccacagctgagtgaatccatccagacataggagacagatatcttactttatcacctctaaatttgcagctcaacttttctttgcacttgtctgttgggagatgcctttcctggcgtttcagatgctgtccagtgcaattccgtccattccactgtgtaataataggaggctgtacgtcttgattggcatcagtcttaatttcttactctgtcagggacttagcatgctgatagatgcaaagtgatgcagttacttgtaattgtctcctctagcttttttgcatctgctgttaagttgagttctacagaagaagaagttcatgctgctctcaatcatttgtgggacatttggtctgttccctcttgagatggtgtttattgggccacagtttggtgtttgggaattaatgtgaaaattccagtggactattcccaggattggggcttagtcttgaaagtcctaacacccaacattattttagctacacctcagggtatttctgtcttcacaaagggtattgtgaaatttaaactaataaaaattttaatttatttatgtaagtcaatctgtggcatgcaaactagggatgtggagaaggatggaaaagaggaggaagaagagtaagattacctaatcaaatcaatagccctatgcatatcccagctccgtaattgtagcaaatcactaccttcaagtcatcaaattgagtgtcatagtgaaactgttcctatatgtcaagcaaagctttaaacaaacttgatatactaataatctacaactataaaatagttcagcaattttgattcatcagggagcagtttttttttacatgccttgtccaggcccttttttcaactgaatcagccagtcaattccgttaacatggtccaaattgtctatgtaatctcagcttaccacttatttcttaatctctgttttacagttagaactccagaatgactgactaataaggtcaacctgtgatataattatgatggcttcagattgtatctctaccactcagaagaaattaactcttctaaggttgagtcagtgttttccatcattgtcatggacaattagtagccacttaacaattggttacagttcatttctgctaatggtattacagatgagatcagaccaaccacacaacagtcgatatgagttctcggagattcaatgtccacatggtactggaagccattccatttttcaggccagtttataaagccactttctgtgtattgcagtgctgtatttgccctggtgtttatgaaacatgtctttgtggcaaattaacttgctggcgacctagctgcgtaactgaattgaattgcagaacattaactttacgctaagtacacaacagtgacaagaactgtgtgttattttagagccataagaatctgctgtttttctaaaatgccatcatttgtaagcatggcgttggaagaaaagtttgtccaaattagccgtggttatagaggttctggttactaggatatgcagtccacttgtgggcaaagagctgcattgttttttttgaaactaccttgtctgtctcttcttcctcattcttattataatgaacttgggaatgtttagtaaatcaggtgacttgaaatggttgaatgttttccaaccttctcatactgaagtggtcgacaataaggcttccatagcaaccagctttttcctgacaacaatttctttggaaggggaaaaaaagcaaaagggaagtgagagctgtgtctatatgttaaatacatcggctgatttatttttaaaggtagaaaagagtgttttaagcactctgggaaaaagactgcccatcatgtgtccatccatgttagagtgtccgtcatttggtttctgaatcttcacgaggaagaatatgtccctgacatacaaaataccttagccatcgaatgaacacatatgagactgcttggtgtaatcccctcagtaggggacattgacaagaactctagtgcaaaaccttgaaggatacactgcacttgttttaattgaatatcattttctacattaattaatgtgtccattctaatttcccaaaatggcaaataatgatgtgtgaaaacagtataattacatttttatatttttggtagagtaataactggattcgatttgcttttgatcttgaaggttgtttatcattcctgtcaatcattcatcccttttaattatatttatgtcatttttggtttttatttttaatgaggcacccagatcagcactggccttgatgcgtggcccccgtgatactttgcgtagggggtttacaaagcgaagtttcttcctatgattgttaaccagatgctttgagattctctttttctgagagaagcatgcacatgtaacacacatcagcaggctactaagcagagtttgtgacttcattagaatgagcatccttgcatttgggtggaagtagtgtggtagctggcggttgtgtgcggcatcatcccacaatgtgtcatttgggtaaatgtgactgaggaccgtggcagagtcccatccgtgactgtatgtagccgtctcagtgccccggcattcggcatgttttctgcagtagctcgtgagtttacctggagctaagatgaagctaagagatgtttttaaatccacgacctgcagggggagggcagctgaggtttaacaggcatataagcttgcatatcttttgcccacatttttaactgtaacaatgagttgtcactgggaaacagcatctcagcttgggaaaaggcctgttgcctttcaacttgaaagaggttgtggtagaatttttgtttcgcaaccagaaaaagagagtgatggaggcaggcacgcagtgctccccactaggagaagctggcgttggcattcatcatcatgacaggagacgcttcgaaatgaaattctcacaaattatgaggccaacacttagaatcgggaagaaagtgatgaaaccatttgtgaaactcccttgtgaaaaaggatgcatttattttagctgattttttaaggaaaactatatttaaaaaaaaaatatccttagaatttacagtgtaacattttgccatatgtattgaacattatcatgaaagtatgtctggacacctacctcgcatccataggtattaacagctccttctacctcctcctgcctttgtactgatacccgattttgcaaaaacaaacaagtagcctcatgttgacctgcatttatttgaagcgcattatgcaccaatgcagaggaaatgcatttacttctacctctgaacaactaaagcttaaataatgcatttcagcaaggtaatctattagaagagctctcttgagaagtgctatgttatgaatggattctgcatttaaaatatccattttgttgcctccctcctgctaattacttctttctttgtcttacctctaatttgcattacttgagaagaacagagggaagggagtccgtcgttttccccttcacgaatccttacacttagtggcaactgtagtgttgacttaagctcatttctgtagaagggaaactgcattgccaaggaaaagataatcgctaatcactaaatctaattacaaagaagagtaaatcactaaaaacaaattaagtatcttaaataaaaatggaaaataaaagcagttaagaatcaaggaaactgctgcaatctctcaagtctgttgcacggagctaactgagagcagcctgtgttgggttgtatggccagactgggcatgggcaaagcttttctccatggaatccctcttcaaagagtttgaccgaaatgacaaaaccaaaccaaacaaaaaccttggctcagaagcaattctgagtatcttttggttgtaacttaggaagcaacaagtcactctctctgtgtagccctgcagacctgcttacttgtcctctatctaccaggatgatggaggttactttcaaatcactgtagcccgaatttaaatgaactggaaactaatgagaattctatacttgaccttaatctgacgaggtctgacagaagcttctttctaacccactcctcctcctcctttccttccttcctttctatattactagttccttatgtctttaaatgtatgccagtctaatgggagttaaaaacaataggaaacgaagagtttttatccctgattcagaaaatgtggctggaggagtagtgctcttcctcacaaaattctcctgatcatgttttccctgggcaatttccaaatctttttttagttaatgcaatttagtgatgtatagtatttcccataagtatcccaacaaaagtagagctgcccatcacatttgttttcctggtatgtttgtagtaaaaaattaagataacataggagaggtatttcattgaaccattaacgttaaaaacttgcctttaaaaatatttatatgtctttcctttgcgtagttattcataaaatgtttccatttgcttttcaagcactttgtccagtcttcttaggtatgaagaaaagtcagaagattgaaaagtaaatttctgagttgggaggatttaggagaagagatatgcatgagagatggaaatgcagtctgggaaaataaaatacccaatgataggacctttcgatgctatctctgcctcgagccacttgggttataataaggttgtggtctaccctgactctgggaccagggaattgagtgctccggttcaatagtgggtagcttggcaccatcactaactatctttgaccttatacttctgaaaaccaagtttttgtctctattctttgtcaccaagtgcccatgtatagcatattctgttcttgcctttttggttttaggatcctcctgggtacctgagtttctacggggttttcctcacactgtactcaacctggtagggacatccccaaatggtggatggtggatctctctggtcaaccaacctttgtcaccatcatcacccccgatcagggacttcccagatgggctggagctggatctctcctccaggtctggccttctggggtttaacccatgcggccactgaccacatgacacctcatgcatggagtcagggagcactggatgccaccctgcagggactgtgttccagtcaaagccacactaacagtgagcactcaccacaggctgtgaggcctcatcactgaaccagggctgtccctgggtactcaccagaaaagcaaattcaggatgatgtgagaaagaaagtcacgtggctagtgaaggttgagcatgttgtgtgtgtgaaggatgaggtgtgtttcgtatgcccatattttggattggatggaccaagtgaaggacagtcttaggacggggacaaagagtctgaggagtgggacgttctgtgctgtgagcagcgacgggcacccagcagccctcgccttgtcttcctgcgaaggttcaggagccagtgtgttctttcctctggttcagcagagagcagtagaccctgtctccaagccgtggcaagtgtctaattctccctcctgcttagctccatttgcccttaggtcaggcacattgacgtgagctcaaacccccatgtactgcagagggataacagttcttcagccttgaaaaaggaatcacagaggaaagggcagttagggaagaaatgagggaaaaaatggatgaggaagagggcccaaaaagagataacagacactgaaatcatcacatattcctttagaaaggcacagtgagcacgctcattttttttccattttagacaaataatgcatgataagtataaatgtgtcatgagcacactgttttctctgtagaaataacaaaggccctggatacagtagaatgtctggccttacttttctgtaaactgcggccactttgtcctttatctgtgtggttaatttctatgaactgctggacagctgatttgaccgaggcttcttggctctgcaccgggtgataattctacctgggcagcaggccacgcgtgagagcagcttccccgaacctctctcatcccctcagtttgggcacagtccagcaggagaatatttaaaactgggtttggtttaaaatgcagataacagacagaaatgcagataagctttgccataagaaacgcacagatgacttcagataaaagtttcgccagagaatgaattaggaccgtcgtcctgggggccatgagacaaccctttgccccacacagcgtcccatctttcaggaccagcaaaatacgtgaatcagttggaaggaactatttgaaaaaccaagggatacatgaaatgtgattttatgaggaaacgaatgtactcttagaatacctacacctttttttaataccactgtgttgcatgggctgttctgctcttcagtaaaaatgattaatagcccccatccatcacattgtacagtgtggtacatctgagaagcagagagcttataacatatacttggcaataagtcacaaaaacattcgtattttttaataacatttttgaaggagaaaaatctgtttttcaataaattctggcgtggtttccctccagattttatttctcatttaaaatgaccttggggtcgattcttttcttcttctgttcgttggctctttacgaggtctttgccttaaacagatacattttagagatggattaaaaaggggactagctcatgagcatagaattcccgatttccttctgtttccacttctgatgagttgtggcagcattaacaccaatgtaacttaattttacagaaatttttgtagtcggtgctactcataatcaggtaaaattattcttcaacacatttctttgttaccgtaatatatttggcttttctttgtggactattttatttctatacattattgtgtaaattgcagaatctttctcgtaaagtggtaggttgccactatttttattggtaaaactctgaatttattatacattacatagttacccctattattggaaactccttgtttctacattaaaacaacaacaacaacaaaaaaaaaaaaaaaaaacagaaaaaacagcttaagctgggcgtggtggctcatgcccataatcccagcactttgggaggctcagatgggcagatcacctgaggtcaggcgtttgagatcagcctagccaacatggcgaaaccccgtccctactaaaaaatacaaaaaatagccgggcatggtggtgggctcctctgaaattccagttgcccaggaggctgaggcagaagaatcacttggacccaggaggcagaggttgcagtgagcgtagatggcgccactgcactccagcctgggtgacagagcgagactctgtctcaaaataaataaataaataaaataaataaataaataaataaagtttataattcatagtcacccaaggccaacaagttgatgatgtggaatgtcagctaagggtgatgctaattgtagaaaatcctcttggcccttttccattcctaggaattccacatactttttaatttttaaatttttactccagtagtttttggggtacaggttgttttggttacatggataagtccttaacatgcgttattcataggtgagaggacaccttcattcaggaccacatgtgagttcctaataaatatgaatggaactcactttcatttcctagagggtataccctctaggaaatgaaaagggaactttcagaagtctgtgaaattcattcttatatttgaaaaagatgatactcaacccatctgacacgcttcataccaatccccaccattcaaacattaagtccatgaatgaaataatgtgcagggtttttcctatccacaaagagttcccgtagcattttataatgtgagatgtttttaaagcacagaacaatgtttaacattgcaagcccaatgaacaggtaccttggagataggaaaagcaaagtaactctctttctgtgtttgttgtcaagggaggtctcccataccagctctctgattttcttctcttctgtgaattggaaggttgcattcaatgaaacaaaatccgcattaggatgcagatggcagcacgttgaaacaccaggcaaagaggtgtttattccactaaacacctttggggctgtctagttagattttgagacttgactgtttctaaaatgctttgtttctgaatcctgtttcttttatgggtgtttgagagagatttagaaggggaaatcaataggatattatgatggattggatatggagggtgagagatgatggtataaatgatgactcttggatttcttactggtgtacttgaatgaatggtggtgttagagagctagttcgctgaaagggatcaggtttggagggaatgatcagcaacttgaggcttccgatatgtggggtgaattacaatacttctgagacatccaaatggaaataccaaatagaaaataggatgtacagatcggtatgtcataagaaaggtcttggttgaacatgtaaatggtgactgtatataggtgtaatttcagccatgggtgtgaatgagattgcttaatgattcctgagctaggtagaggaagatgagactgtgaagaagttagagagggctagctctcaagacatagagcaccaggagagtgttaatgtcaaagaacccaagacatgagagggtttcaaggtcagagaaattgacaacctgggtagtatcataaatgactttgtccactaattcaggtacagtcagatattggcaacatcatgatctaaaacttctttgtagaaaattagctgtgctttccacacagcaaggatccacccttaataactggctgactggtaggtttttaccactgtagcacaacggaaacacttgtaacctctgcataccaagcatcatttctcccttgcctggaataattttcctttaatatcatcctgtgggaaatgtatctagtttactgctccattctttgtatcttatatggaattataatgatctgtacttttgttgacaatttcaataatgacaggaaaatatcattattgttgaggtatcctggtttaaagcaatttcctgggagaaagcatcaaactcccataataaagttatagtccaaattgtaaaaatgtgtttttaagggtgtttttttctttcatatagaagcatcatgggcctttactgaactaattgtcatggtagagctcttgataagccactgtggttgattagtataatagtgtccctgtcaattttacttaccacattgaagttgcatagtttctgaatttgacattcttagaccagactgtaatccagtgaatccattacctaagcaaaaataaattcacagaagtagcaatagcttttacttaagccttccttccagtccatggcaaaaataggacttcagtggatttcaagatacttgcccgactgtgctaattctaaagtaatcaattaaaagagaaaggcattagctggttcttctttgtataagaaacaaatttaaacatctaagcaattctcagttcataaggtaactttacttttcctatataaacagtttctgctatagctgaagatagaacaaatgcatatgctattgaatcttttagcaagttacatggctctaaaattggacttcttttcaggcatcgcaagcagaccattgtctgtagctttcatggagatgtgtgtgatttgtccttgaaactcggggccctgttctcctcccactaccaagttcagccatgctggtggcttcagacagcgtccttggaactcttgacttttacatccttatctcaagccctgcttttttcttgaatgccagtaattttggattggaaatctcttcctaggcaaccaaattcaatgtaaaatggagctcatttccccctttctttctccatggaagtcttataaaactcaaccaagcatgccttggaatcatgcctcactcctttttctctctcattccccacagctcatgaaaccctcagccctgtcagttttttctttctcaatttaaaaattttcctttcttttcatcgtttatggacagaccacttctcccttgcacagttggaacaacctcttcagccaccttctacctctacacaaaagttactgatgtttctaaaacctgagtctcatcttgttactccctattcagaattctccagtgcctctcctttgcctaatggttaatgcatcaacttctcagcaagtcctaagggtgcctcacaatgcggctgcaatctcccttttccaacctcttgttgagtgacttctgtacattcttcaccccagctagtcacccatttatcagaattcgaaaaaaatccacgctttgccagagccaaccccacaccatgcttacatctttcaagattaaacttgaaagagcttctgttcgtcattcaagattcaactcagatgtaatttttgctccgatgctttcttgtacattatggattttttttttttttgctttttttattcccataacattatagaagcttttattttcacttacatttttattaacattttacaagaggctgcatggcctagtgctctttttaaaaagcctaggcttctgaatcggataaacctgtgtttgtagcctgattttttttttttttttttttactgtgaactctgaaaccaggttatttgacttctctgaacctcaatgttctcatatgcaaaggggggaattagaacagtacctttctcagaaggtcgtcatgattatctgagataaaccacacgcaactctcgacacatgaaattaaacattgtacctggctcatgtttgatttgttgttgcaggggtggtattggttatatttgtccttccctcaagattgagttctgattactggttcgtagtagaagtccagtaaatactgaataaatacctaacaagtgggtgaattcgtatatagatgtagttaggtagcccaaaagattaaagtagaaactcttctgagacatgatactgttactgggatgggaaggctaaaattattgcatattttaaaatctggaagggtagaatttactgactcctaaatttaccctttcctgaaatgggagaaatgcaggtaataatatttatggtcagttctgtttttattcagcaaagcatgaaaactatttatttaaagaaatagactgacactacccttttgctcttagtatttggtctccagcattaatctgatgatcactgatattgactgctgttcctattaaaccatgtttaatataccataaatcatgtcaaattgtacaagtctatatatttggaggaaggtaatttttaaagaatgttagcctgatgtatttatttgcattctgatttatttacttgcattttttatgtcctagaatctattataatcctctatcaggtgatcaaactttatgagattttaaaaataatagtttcgacttccagcaaatgacatacaaaatactctgatgaaattgaccttatgaacctaagtatttcccagggttcctggaccctaagaaatacccttgagcaaaccacagtggcttacacctgtgatcctaacactttggaaggccaaggcaggagaatcacatgaggccaggagctcaagaccagcctgggcaataccttgtccctacaaaaaatacaaaaattagccaggtgtgtggtgtgtgcctatagacccagctaccagggaggctgaggtgggaggatggattgcgcccaggaggccgatactgccctaagacgtgattgtgccactgcactccagtctaggtgacagaatgagaccttgtctccaaaaaacaaaataacatactcttgaactaagaaaaatgttcactaaatgcactaaggtaaaacattattgaaaacaagatacaattcattttctaataatgctctttggagttgataagaataggaatcatctgggaaaacaatgacatgttcagagcctcagtatcaacgcttgtaggtagtatgtagtttggctccatatagcatgtggcaggcagaggtgacctcttgagtgtgaaaactgagctgcaggggcagctgccaattacagttgtgtaatcaccttctctgaagctggtccactgtcacagaatgaagaccctggttcagctgcgatgtagtttggccaagcatctttttttccaaccctgtgatttcctgatgagcaaaactgaaacagtgattcaaaacataccggttgggttatccgatgggaaataaaactctaagtccagattagacagtacctcatgatttttcactaaacgaaaaacaaatatagtcgtgcttttttaccacctgcagtcctaattgaaagtaatgattctggagccagcctggctgggtttgaatctacctcacttcctggttgtgtggctttgaattcatcagtttgcttcctgtgctttaaattcatcagtttgtttagtttcctcatccgtagaatggaataattaagttacctatcccaaagtggtgttacggagaccaagggaggttttgtttgtaaaatcatagaacagatcctgaagcagaataagacatacccactgctcttgctcttacccttccagaagagttggccatgacttgattatctccaagacaacagtgactcctagatgtgtcttcagcccctgccttttgtgacatcatttgcattttttcaattgcccaccagaggtggccactgggttttcattttgggttgcgtatacctaacctaattccttctctgattcccccagctcaatgtaaatgttctcctcatcttgtgttctcttagccaggtcattctgcagctgtgtgctctagcaccctggctgctcctcagacaccttcacacatctctgctctgggatcctgtgctctttcccgctgcatgtccacagagcttgcaggctcccccacctgatagagattctgctccagtctccactactccctggaatacgataccccagtcacactccacctcatacccttctttagatttcttcatagcacttactatctggcattatatagtgtctggttcacttagagattctttgtaatgagaacaaaaaatcaaagctatgcaggtattcacttggctcttttgatagaatgtggttactgggtaccagggcttcatattgcagagaaatgatgaaaagtttttatgattttcacatggcctcattatcagatatgtcttgatcatttttggaaggtattacccactttacagacaagcttaaggcagaaaacatccaaacccagaacttggtcatcttggcacttttattttattttactttattttatttatttatttatttatttatttatttatttatttatttttgagatggagtcttgctctgtcacgtaggctgaacagtgcagtggcatgatctctgttcactgcagcctccgcctcccaggttcaagccattctcctgcctcagcctcccaagtagctgggattacaggcatgcaccaccgtgcccggctaattgttctatttttagtagagacaaggttttgccatgttggccaggctggtcttgaactcctgacctcaagtgatctgccctcctcagcctcccaaagggctgggattataggcgtgagccactgcgcccagcccatcttgacacttttaatattagtcttgaaacaggaacaatatgttcatttctgtagaactacgaaatggggacaaggacccagcaccctccagggtggaattccctgagcatttgaagtagatattttaagcaaggatgaaaaattaacataaagagaacaatgaatactctatgaagtaaacagtcatcatttgtacttgtggtctttacggaaggagctaacacctgaggagggaaagggcattgcagttgtggttctgtttacacacccagcatgggattctgagtggtgtagtccttggggacaatgacgcttcagtgtgcaggctacttctcagctcagacttactatctaaacctctctgcagaaaggctgctggggcacctcctgtgcctgcaggggagagctccagtgcttcccttccctgccttgttatcccctgctggtgcccagcagattgcagagggagcccagcccttccagacatcccacttgaactgggcttaaagcaaaaacaaagaagtaagacttaacatgttttgtactaagggagctgcgtggataccggtttcctcagcggctcaggaggctgcctacctagctgtccccacccagcaataagtgattggcggcagaagcaaggcggccaactcaggtgtccctgaggcctggtgagcagtgctggttttgggaagggggctggggggctgtggcaaaccagcagcacctgcctctcctaggggggcagctccaggctaaactggcctgtgggccccaaattcttcagagaactggattccagatgtgtgtgttgatgtggacaccacacacttgtgagcttctgggaaggaatcctctcatccaccaatagccacctccatgttttggagtgcggtctgtagagtttggccgcttagatgctaccctacagaagactggaggaatggcaacattgtccacaggaggattagttgtagtttgaattcacacttactgcagtcccaagtatttgacaaatacttggggattgaatactatgctatattttaaccaaacatatttctagaagttaagatacctcacttccattttaaagtcttttactctaatgtttggcttctgaacccttaatccggtccatgtgtcacttctgaaaagaagcagtcaagccaggtctccccttgttccttctctcattcctggatcctttctctcattcccccttttgcttcctctcattcttcctttcccctttcctcttctccctcctccctcttcttccccctcctccctcctctgccccctatttctccccatcccttctaccatctcctcccttctcccatctcctcccttctcccatctcctcccttctcccattctctttccttcctgtcccccatcccgtctccttgctctctcttacccttctttcatcccctccccacactccccactccccactccctccctctccccactccttactccctccctctcctcactgtctacctctccccactccctccctctccccactcccttcctctccccactccctccctctccccactccttgccttctgtagatgtgcagtgctgattggcagaattctccccctcaggccatgcagggatgctctcattttgttttccccacagcccctactccctgctcattcccttcacaggttaccattaggatgtgtcaaccctttgtttaggtgtgtgtgtatcctggaaaattagatacttgcatgaattagttttataatctacatgaatgggattgtggattctggttcactgtttttttgtttgttttttcagcctgtactgtcttcagaactgcctgttttgctaggtgtgcatcttactccttgcttctgactgctgcgtgggtcctataacatagatcacccacatgttatctgttccttcccctggtaatagcactctcagcggcctcccagtcccagatacttcccatagtgctgcagtgaatgcacatatccccttagggcttggcgggagggttcatctggttctgttctgaggctgcagggcgcaagcacacttaacttcatcaagtgtgggagatcctttctgggatgactggacccattcatactcccaggatctgtgaatgaagtttcctgtttccccacgtctccacttggtgttgactttctcattctaatctgatagctgtatcattgtcattttcatttacgtttctctgattactggtgagattgagcttttctttataaacttcttagccatttggatccatttcccttctctcaattacctgttcacatcgtatgcacatttttccattgggtttcttgtcttttttgttaatctcttctatagtctggatattaatcctctgttcactgttaggtgtggcacacatcttccagttttgtctactgtgtcctttgtaggcagatctgtcagtgtgtactcctggatgacttaaatcatatttaagaaattcttcctcatcccaagctatcaaggatattttctccagcagttaattctgttagctgcattaggtatatctcatatgtagatgtttacggccctcagaagggagggatttttgtgtttctgttgctcctgtggcagtaagttacggatccagcattttctctcaatagtaagctggtttttatggtaccatatcctaagtattccatctgttttcctgtaatgtgtgttgctacctttatatgtaacaagttgccacatatccatgaatctgttttaggaccctaattttgtttctggaatagcaaacagacttgggcatcatgggtaaaggcctccaagaaagcagtgatgcaaggactcactggagcctcaagtacatggtgaatggacttgagtttctatctagaattcgaaagctgcaagaaagagcctttaaatcatgcctgccccatgttgtcattttcacacgaagaatctgaaagttaaagagagatcacagtgccggtagtcacataccaaagacagacataggactgtggcccaggtttcctctgacacagctaggcactctctgaattcattaccctgggctgcttctttcctttcacaggttagagcaggtgattttttcagtctctctacccctcacaatctattcctgcctatgaaagttttgtgagtttctccttacttctctttaaccttgttgaggaagcaacgcttgtgctctgcaggccggttatttaactcctgcatgcacatggtttatgttttcccttcctctctccccgccccctgactttgtagcaaaaggaaatttattggcagcagtttagtcagtgggtgggagtcgaggcaggtgagagagcagtctgacaggagtggactcatgatgtttcgtattttaatctgtgtctcaaaaaatgaacctgggctggaagcggtggctcatgcttgtaatcccagcactttgagaggctgaggcaggaggatggcttgagctcgggagtttgagaccagcttgggcaacatagcaagacctcattgctactaaaaatttttaaaaattagttgggcatggtggcatgctcctgtagtcccagctacttggggaggggagagcagctgctgaggcaggaggatcacttgagcctgagaggtcaaggctgcatggaaccctgaacgtcctaccgcactccagcatgggcgacagagcaagaccatgtcttaaaaaaaaaaatctgctttttgttcttttctagctacattacatctttagatgtattactagagtgtgattttctgtgtgagtattcatccccgtcattgagtggaacagaaaaaatgtgaaacgatgaagttttaggaagccatctaacgcttagtacttcttttcccatctcctactacctaagtcgggacaaagcttctgcttatttttctgcttcgtctaaacactgctagattgatgaaatacactaatgcatggagtagaaacagaggggctttaatggaggtcatgtccctaagcagagcatcagagaggagaagagaggaggaggcctgggtggcattttgtttgctgtttggtgagtggggagatggcagtgagacagccagtgtgacgttgagagtgttctcatgggtcgttggcattctcagcagtgcatcaacaaaggcccctttcttctggaattccagagtacagtgtgcccacgggaggcctcatccgggggcagtttctgcttgtcaaggaactgcaaccctgaccttaaccaccacctcatttcatgcccgagagcttggaagcctagacccccactaacaaggagcaaagcccttggaaacgcagcactgcaatgagcattttattgaattctttcaaaactggaattacagaacgtccagcaaggcccttttgggagaagggttataaggttggaagataatcagctcagcctctcccactctgagtaccattcggttaggatgtactctccacccttttccatcctgctacctgcctctgaagtgggagctgtcatttggaagtgatttgaaatacttggatgagataataatatgtggcatttattaatggagtgcttttttactcaggggctcagactttctgggccttctaatgtgttaatctacatcttcttcccactgcctggttttacttacttttaaaaacttctgtgattaaaataggcaaatcgaccaaacaaaactgttgaacaacttccctgttcactaggttaggtcatctagtgatatttaaaagtaaagtagcttcatagagtggattctgttgcgaggcctttgttactgataagtgtttgtcagttgtagttaaaaatgattcataagaaaaagcttagtttttctttgatctgcattcaataaaatgtgtctcatagactgagaaatttttcttcctcccaacatagcccaccagttctagaggaaggctattgtcagtcacaaagaggatttatgtttctttttttttccctaatgggtaactgttgttgcttatggattggagaggattctaaatgcttgtctgtctgatatgaaggcagtctctcttttcacataggcaacgtgccctatgtcgtacaggttagagatgaaatacgattgaaatcatgtggatgcatcttcctgtgctatgtctttcctacaggcagagtgccccaagttcacgttggatacgccgaaactcagcgtgtttccacaggcaatttaagaacaaatcaatacctcagacagtaatacgtcttagaaagagatttctcatataagcaatggaagttttatcttttgaatttggttgacttataataatcaaatgtttggaggaggagagacctattcttttgacagtcagtgcaacctgtatgctcggcctggtttttgtaaggaaaacaggctacatatgtgatggataactcagagtagcttttaaaatctacttactggcttatttctggtctccagttttggctttcaaggagacctcttagatatttgtacctttacatatacatggaatagtacagcagaactttctcaatggcctgtgtctaggcagaccctgagctgatgctcttgcatgtgccacattttactgggtgcgaatgtctttcagcaaagtcctgctttataggctcttgcatattattcttcatctccaccttgggaataatgagctttttcctttctttgagatgtatctcaggaggtagaaagcaccatcaagatcgcattcgctagggacacatgaagaatttgagatgatgtgttatgcagtacgggaaagggagtcagaaactgcaggagttagagaaagacgaggacatgttgacattcctagtgacgtatatgtacacacatacacagtacacacgtgtgtgtcacctctcattacacatgcacattcacatgagagggactagaaccgttggccaggctcggagtggtgcttcagctttccaactggttaccagttgttttctgatagcaaaggaagaagtagatgtggtggatagcgaaagatgtcttgatgtttaggagaagaaattcaagtggcaataaaatgtaaacaacgatatttatgggaaaagcaatagtaatgatcaattttaatgcaagcatctgtgagaccagaagttggggcaacacaaatgatttatagacaaaggtatggcaagtgcaaactaatttgtgaagggagctatctttgaaacggaaccatgagtaaacgcagtgcatttccacatgcgtagcccatatccgaagcttgtgtcctgactgagtcatgagtaaacgcattgcatttccacatgcgtagcccatgtctgaagcttgtgtcctgactgagtcatgagtaaacacagtgcatttccacatgcgtagcctatatctgaagcttgtgtcctgactgagtcgtgagtaaacgcaatgcatttccacacgtgtagcccatatccgaagcttgtgtcctgacttcagcaacactgggtcttactaccagtattgggaaagccaatgaacagggaaacacaatttttagttactgagtgaatcaatatcttcttactttaaaatatagatggctttcacttgcattctaacctggatagtgattcttgccaaggtaatatataagcactttgtcatgtttccaaaaggaaaatcaagattgtgttttattcactgttaaattggcatttttaggtgttttaaattcaccgaggatagcatcatcagcatcatcattgctattaatgtaattattaccaccactagatggtgcatggggaattgggggcaccgaatgttataggaggcgttctcctctatgctatcactaattggttgttaagggaatatagaaacatatcagagggtggaggaaaagggacgataaaatatgatggacttttctcactaattaaagctatgctggagatacagtggtggaaataggtctggctggagagaaggtcttctatgtttgcccctttaaatatacgtgggatactaaaatagaattttataaatgctctgtatcagaagcaagtattccttaaattggagaaggcctctggtgttctggtggggctaggttcttgagaatcccttattaaatacgacagtccacctcgacctgggttcccagcgggtctgcctgtatggatttgcatgagctggggtcctgcctagtctcctctgtgcagccagcctaggaacacaagaaacaaaagcaaggttcttgatttgacaggtgtcattttcgaggaccatcacatcttgattttttctttcttctgttcattttgatagacttcagggagcctctgctgtcagaaaatgtgctggctcctggcttcatatatgatttgtgtctagcttcctgtagactaaaaatatcagcagaaggaattatagatggttcaattaaagtagtaattgggcaaaaacggctcataacaaatccaattctgggaaatgcttctgtgctttgattattatgttcctccctatttctccctctgcttacttttttaaagtttgatataatagctcatttgagggtttcctagttcttgttggtctctctcattttaatacctagcaaagggccaggtgctcagaacatgctgagagtaaaaacaatgaaatgagtaatgatcaaaaagactttaagaaatgttttgaacatagaaataataatttcttaatatccacaagcataataggtcaatagtatttatgtaaaatgccagtacacaacaaatgtgaaggagtattaatgaatgaaactgctgtagcagtaaatacataacatatcaaagaaaatgtgacagttctagatgctgtgtcatatctttttataacaccaaataaggatttgtcacaagccacttaatgactctttaaaagttgctaatgttcttacttacactctcgtcgagtcataaatcaaaaaaggacttgaaattaagacccatggttggaatatcaatgcagtcaaatatctgttctttgtatgaggttgagtgagtggatgatgatggtgaatttgagaatgaaagggttctaataagtgattgttgagtggcaatgggttggccacagcactttagttcttttgacttgagaaattgaaatgtatcctaacatattaaacttcacaaagatgtttatactctgaaaagatcaatacctctttttctacacccactacagaagatgcgatcatttattatacgattttgagttctgatcaaccaaaacatacaactaaaacatcacaattgtgttttcttttttaaaggtcatcaattcagtagatagctgattttctgtatgtaattctgtccctttagtatccccactggcttcccaacatgtagtatatgtaccttctggcacacagtagggcctcaataaacatttttgcaaggatgaattcaaattgaatttgaagaataaataccggaagaataaaattggccccacataaatgtgtggggatctacttgttgcaaatggtccaggatgcagattaatatgcagtaggcacgtgaatatctggaggtcagcaaggtacagtagtgagatgtacacatctacacaaattgattttttcaacttcgtttgattggtaacactgattcaaatgtagtcataagactcacagtaatagcttaagagataaaaagggatgtgtgttttcactagcattttatatctggcccagcagctgcaaagaacctgatgctacaggcgtttaacatacttttcttggattgttgaaaaggggaaaggaagaacaggggtcattaggaattcttgccctttcttgtagggaaaagaaagggcttgcttgtagtaggagggagttgtatttgtgagtcatagggatccattatccatatctgctgaagggctgtcagatatgaagtaaatttagagacctacttgtccctttagctattcatcactgttgattggcgccagtggcaggcagcagtatttttagagaagcgaatgatatggaatttcttcaagtacagaacattggctgatcccattactcaaagctactcaaaaagtcacagctgacacttgacagaactacagaggaaaaacaatagacctaagaagcaaaatactgaaatgcatgatgaaaacatagggagattcaagttactcatcaccactgctaatccagtttggtgctgctggttgtcagtggtattaaaaatataattttcacaggaatcgattttatgcatgtctctttgccctatcatagagtgaaaaataggctgatttttcacatcttgtaccaccttcctttgtaatatatctgacatttatgctttgacaattggtatgtgaagaagacacatgaaggacctttttccctgtagcagccagcatggtgctgtatcttggtttccaaatgataaatgcaggaaaatagcaaacagttttaaaaatggccttaatcctgtgggacagtattcgtaatttctcgataaaatccttttaatttaatactctaaattaatgttttgaattgcttctctgcaagaatgctagatcgtagaaatgtacaaaccatccttcagaagagtaaaagactaagccatctacagttgtaactgtcagtgaatggccaagacttaactgcagtggagccttttcagcagtctgttattagacttaatttttaaaacctaatcaccagagatgcctgagtctgttgacttagtttgacaagaaatctgtgcatgtttacaaacttaacatggtcaagaagcctgtgcatgttcacacacttacatgtaggagaagtctgtgtgttcactaatttacacgtatgagaagtgagcatgtgttcactaacatacatgtgaggcctggagtctaaccagaaactgatcagcaaggcttcaggtctcaggtcttgagcgctagtgccacagctgggtgtgctgataacttggcaaaatcagttggtggttttcgagctgtggagagaagagtgcctggtgagttcagcgaagttggttggatgtccagtggtggtcccttcacttgttaaattcagtgaagaaagagaccctgtgctccttttgatgacatggccaagaaaattatcagaatttgtcaaaagaaactttgaacaaaggtattaggtagcgtctattaaaaattcatcagtaagttgtttatgtcagtcggagaagtacactgaacatcatagtagaataatttattcattcgttaaccaacacttacacaacacctaaactatggtagatactattttgaacggcttacagatactattatatttaatccacatgacagtcatatgatttaagtggtatgatcaccctctttttagcgataaggaaacttgggcacagttaagtcatgtgcccaggatcacacagctggtaatggcagaactttcacgtgaacctgagcggtctggcttcagaatccacactcaagccactatgctgtgctgcttctgagtaatacaaggcaatgatttgtaaatcacagtgacaaccagtgataacctattttattcctttatatcatcccgctctactcacatcttttaggctcattaaaggatttagttgaatgccaaatgtgtggacttagaagaactggctttgaattccgacatttactggctgtgtggctttggaatagtcacctttctgagttgctttcttcattcaacgggtgtaacaatataaatcctgctgatttcacaaaagtcaaaatgttttgccctgtagaaattggttaggtatcattcgaaaaagccagtggctctccaggaatgaagatgctcaaggaggccttgctgtctacctgtgctaccagctttcctgtgctctgcagcagctctagaggccactcctttagacctaggtccatcttgaggtgttgttatacagcctcttaggggtttttatgtctgactccataatatttatgataaaaacaaaaaccacgtgtgtgatggtatcatgacatgaatatgatccttgctgacattaaaatggagcagtggtctccattccaggtgatgaatgacaaaatcacccaagtatttttaaaatgtgtgactctccagagagggtacccttgagtggctcttccactgaccccggaacttccaaagcatcaggcttgggtcaaataggattcatctgagcttctggttctgatcttgtaaaagctaactcatgcatgcacaacatgataggccatgtcactcctcacagcctttttctgcgctatccttttatacattttttataaggcagaatgctttgaatgcattctgcctcaaaaggcattttgctctaatggctgtgtggaaatgttcattctctgcttctatgtttttaaaaaacaaaagggtaatcagaagcatttaattgtcttagatgctcaacaaatagtaattaaaagctattttttttttagttttgcagaagtataagcatgcctgtgaattaaataaggccatgtgtcaagactgatttgcacagtgaaggtaatatattttagtagcgccaactgagggctcattgcccaattgcatgataagcaaaccccatttgaatgggtgtttattcttcatcctggttctcggtagtctgaacccaaggcttggtgtactgttttcaataggtcacctccacttgatctttgttttcctcttaagtggcatgctgaaaaaccacattcatctatggggagtctttttgtgttgcccaggctggtcttgaactcctggcctcaagtgatcctcaggcctcagcctcccaaagtgctgggattacaagtgtgagcccccatgtgccttgcccccaaagctttgagtaacaatgctcaaagatacgtcacttctgttaaaagattagtatattcagtaagtagttcctaatgtctccattttgtagagagaagaactgaggcatggtgacttcagatttttgcgtaaggtcatagctagtcagtagaaaagctgaagttactgactttggggttcttggccttggattttcctcaccagttcaacagcttcttatttgtatgttgaagagaaatgttaaagcaaataaatgtcttagctcatcctgtacaaggatgagaaaatcaaaagcctgtagtgttattttacagctcaggagtcacttctcttgtccttgaatcatttgagcaggagacaaggaggtcagcaacccccagttctattttggtcctgaccgatgactgcttgtatgacctttcgcaagtcacttaactcctgtgtcactctctgtgaaatgaggatggaggagccctgctcccctgccagtctccgatggtgacttcatcaggaaaggtgagccagagatgctcagacagaatggcctgcttatggcactttctcaagccgccatccagttgaccagctacatgaacaaggctgaaactagatcaggactgatgagtcttcaccaagaagatgcaccagaaaagcagtgccaccatgtcaccttctgtgtccctgtagtaacgaaggcaggagggtctgaaggcacattttttttccccttaaactttagacttcttgcataaacttgagcatatttaagagagcttgataaaatagagcaataaattcagttgttgaaattcagtagataggcgtcctgaaagtcagatgttactttggtaacaatcctgtgtcctaaggacagtagatgttcactatccaatacctccgaagaagctggggagtgccctgggattcaggatagcagacctcatttctttcatagcactttaaacaagattttaaacagaaaaataatgtcttatagcaatcagatttatggttttctctagcataggcttacccattaataacttatttaatcaattccagaataaatgtgtcattcagaaatgtcatgtttgtactataaatctttagttcctttttaccaacaaattaactatttttaatatttaaactttcataaattattttaaaaatcaaaaaccctaggaaaaaaatgagtgagggatacaaacatacaaatagacttttcacagagaaagaaatacaagtcgtaaatgtacacatgaaaaagcctttatcctcctccccctataatgatcaagggagtggaataccacagtgatcaagaggatgcatatatctggattcaaatcctaagggcactgtttatttgcctggctgcttgattccgcctccccccccccggcccccgcttttttgtttattgacatattatttgcatataatagaattcatcgtttcataggtacactttgaattttgataatcacatataattgtgcaacttccgccacaacccatttagttatttgtttatgcttccatttcccagctgttaattttcctgacataagcagaatttggtcctatcactgctaattctccaggtgaaaggagaggttcatttgagtcagcaagcatcctttgagcatgtcgtgtgtgtcaagcaccttcgccaggtgtcaggggatactgtcttcagagttcatatactataaggataggcatttgctcacagatgtatgcatatttagctcttaatttacacatcggtgcagaaaaggagaccctacttaatagtcccaaggagcaaatattccccaaatagttagtagcaagtagcaaaactgtgccattccctgtgctccttccccctagaagcaaacagaaaagctttgctgggttttgctccttagtttttaatgttctaacaggtttgcatttcacctgtttctatgattgttgaataacagaaaatgaaccaagagagcataagatttcaagcttgcttcttgttatttagagacatgccaacaacccacaccatctatgcagttgaaatttctgcatctccaaagaccctttcccctccccaccagaagtaccagctgccactcagggagagcactcttgcccttcagaaatcccaaggagaatctaggacaactgcattcaactgtgaaaccctgaaagagcctttgctgttacctttgctgcatctagggagtgcttaatttctcctccagcttccccacccctcaccagcccttgcaacccatccatgctgtggctggtttgggcccttgatttcatagattactacctgaaagcagaaaaggaccatagtgagacttacggcagcactacagttagcgctgaggctcttacaaatactttgtgagtgctcctgcctgaagcttggagtccttgaagtgcagaattactgcaggtgcagcagctcaaatcaacagcttttaagcgcgtccatttgcagacgtgccaagagcttgcaaggaggtgtgtagcctgtaaatgagctcagtgtctacagtttccattatttagaccccaaggcatgttcctgtcgtggacagaaatcaccaccttagacccatatcttgcccgagaagtttataagtctacacaattggacttttcaactacatactattttgcaaattcagaaataataaaattcccaccaatttccaggcatagaaaaccaatttcttccttgatgggtccaattacatggttgatacaaaattttaagacctatcttagtgttttcagaggctagccagtctctgtgggcttgtgaataaatagcacacataagatgctggagtctttgtaggtctggactgtttgcttgaaagaaattaggcaaattcttctgatgccaaaccattaagcagcattttctgttttgcagtaccctttgtttttgccttcattcctctctccctctgtccttgctgtccctcccttctttcttctttggtttcttctcatcttcccttaacaattatttgaggccctactatgtggttggtaccatgttgtgctggggatacagtgatgaacagaaacaaatggttcatgcacttcaggtgctcctggtcaaatagcgacgcagacgttagtgaaacacaaaaataaatataagttaatattctggttagtgcaatgaagtaagcttgcctagtgctaagaggctagtattttttttgttttttttactgtctttgactttgatttgtggaaaaaaatgcttttgctgtgtctgtttcttaatgaaggatgccccatagtgtttcttgcagaaactgtctttccggaggtcttaattctgaatacacggagcccagcatgctcaaagaaatgctctgatgacaggggagagtagagacgatgtacatttaactgaggaaatgtactcctcaagaaagggctcagtgcagactgatgaggggctttattttgtccatgtgtgccagataaccgcatagcccagcatgatggcagattatgagttcatcttaaagaatctggaacgctccacacccaggtgaggtacactatataattgaggcatctctggcaaatcttggtttctatcctggcttccattgtgtttttaagaagctgttgaatggaacattcttttttcaatgcatagcactattcgttatttggaacagtgtttttttgaaaatggatctctgcagcaaggcctcagctgtatccctggatcctttcttaatatgacagcctgtcatcccccaaactatacagaacagccttgctttgcaacctcatgcactttttaaaaatttgcaataatgatggcaaccattaaaatgatagaaaccacttactaatcagtttagtaaccaaggacatctgctttacataatacagagacatattaaaaaggcttttatgttgttcagaaattgtcaaagttaaaaaacctagtggtaaaatcagttgattctttgtgctgcttttcaaacagctttacccttcaaacagtgactgtagaaagccacctatttgtgttgattcaaaatgtcttgaggaagtaagcccttcatagagcgtattccagaaggcttcctcacttgataaacggttattaggatttgagttcctttccccctccttttagatttgttcctttaacactatgagaaacaggcctcttacaacaagcagtcgtgaaagaaattctcatgcataactttaaagttttattgatgcatatcaagtatttaaattatagccaagctcaatttttctcatcaggaaacttaccttcttggacagaaacctaggaaattattttcaagtttgcaattgctgttgtggagatgaacagcagaactgtgggagtatgtgtcgggcacctggtctaccatagagtggggccagggcttgagggaagctccctggaggaggcaggagagcatctctccgaagggctagtcatgcagctgcaggatctgggagtacggtttatagtttggaatataagttcccgaaagtagcaaaaagaagaaaaataagggcaaatacattgtacatccatagttttccagttcctcccggtcctcagtctcccagctctccagttgtgtgtctggagtaaaatcctagatgttatgggaggaggcactttttacagccatgaagatttgtgatctctaaagtccttgcttacaagcacactgtttggaggtcccaattctgagtcagggtttgttttttgtttgatttttaaatttttttttagagacagaagcttactctgtcacccaggctggaataccatgacacaatcctagctcactgcagcctcaaacttctggactcaagagatcctcctgcctcagccccctgagttgctgagactacaggcacacgccaccatccctggctaattattttattttttgtagagacagggtctggctatgttccccagctggtctcaaactcctgggctcaagagaccctcccacctcagcctcccaaagtgctgagattataggtgtgagccaccatgcccggctgaggcaaggttttgataggtggtgagggttaagagttgggtgataatcctctgtgatgttagtgagtctctggggctgaacaccatgttgggacaattcctttgcatgagacatttgctctttgcagaaaagagcctgctacccccatcctgctgcgcagtggccattacttctctagtgatgagcacattaacagagcacaatccagtaaagtccttctaagatgaaaaacaaggaaaaaaatattaagctaatatgtacagtaacatgaagacctgtaccttttgtttttcttacagtctcttctttcttatgtccctgtctctctgtattggtcagttctcatgctgctaataaagacatacccaagactgggtaatttataaagaaaaagaggtttaactcacagttccacatggctggggaggcctcacaatcaaggctgaaagtgaatgaggagcaaagtcacgtcttacatggtggcaggcaggagagcttgtgcaggggaattcccgtgtataaaaccatcagatctcatgagacttattcactatcatgagaacagtatgggagaactgccccatgattcatttattgccatctggtgctgcccttgacacatggggatcattacaattcaaggtgagatttgggtggggacacagccaaatcatatcactctccctctgtctctcttgataatgaaagattagagatgtgtgtatacatacatacctacacactcaatgtagtcgctcttattattcttatatgaccttcctatgaaatgagatgggttccacctgttcatgagccttttttgaggaaaggacaatatcacttagattcttaattcctaataaagatggaaatgggatgggataaaggttgctccattgaaaataaattgcattacaaagatgaatgtaataaacttgatgttttttagatctaaaacagactgattcagctttttaaaatgtaacatgaaatggcaatgttttaaattttccaaaaattggagatcatttgtgtcaggtgaatgggaagttcagtaaggcattatcagtctgttattcaagcatctgtcccacatgcatctgttgagtacctaccatgtgccaggcactgcaataagttctaagcgtacaaggtacacacagcattcatggtgcctgatcccatggagcttacagtctattatacgtgaaatttccaaagttgctgaaaagattgaaaatacctttggtacatattcataaattcttctgatactttctatggcttatggatagcatatttcactttgattcacatatgcttatatatattttttataaagcatgagattttcttcttacagaccaggatgggggagaaaaaatgttggttgaagttttctttcctggaacaacaggtagattacaaacaggcataaggcaaaatttgtccccatattgtgtgatattgttttactcattacttcagtctacgtgacttcctttctaatgggaaccacttagctggaccattaagtatgatggtttcaggttcaacaggctctcttttgaaattgacccagtcagtggttagaaatggccaagaacttacacagatgtagtgtgaggacctctgggcccagctgagtgcagatcattaaacagcaggggccatacaaaccaaactctccagcggtcttacacccagggctcagggagtgaaagaatagtcagttctcttgttggctgttaatttggatgtaaatctaaacttttgagagctaggaatcgggatttttcagtgtcctttgttatttgtaatgtggccatagggtgaaagcccttgggtatgctccattgataaagagaggcaggtttagggtagtaactggataaaaaaaaaaaatgagagtttcacacaagcaaccagtggctcagagaggagagctcaaccgtaacaactaaattttgaaaatacttctctcttgaggggattaagtctctcaattcactcccttttttaaaataaaccaatgatgtgttataacatgctgtcttcattttaattcactccaaaatggcgcagtggtccagggtttatgctgttagagcggtgatggtagcgttttgccacactgctgtcacctctcggttttgctatcctgtccacttactttgtcactacagccttaaatccctactgcccccattaaagtgtctacttgtctcctaaaactcatttatactgtttgtttttgatgtcttccttggcaacttaatttatatgtctgctgtttttcaaacggagtaatactctgcgcttactctaaattttgtgttattaaaatcacagcttttgggtttgtgtggcttccaccaatgtaaacaattcgtctcattttcctgtcaacacacgcttataatttttagtgtatttcctcaaattgtcttcccatcactcagaataaggtctttctgttcacttgacgtaaaatactacatcctgcagctatgctggcttgagctgctttacacctcctttgagtagtcaagatacgctgtctggaagacaatgaccaagtaaggatgagttcatttacgatgattaatgttttcctaagtttccagttctctgtgtttttatttttaattttctgcctttcacagcattttcagcaataaccaaggaatcctgaatcctttcagaaccatttttcgcctctgtatctgctaaccatttcttgccttttctctcacatgtctactcacatttcagggtgtcaaaaatggaccagtatacctacaaaagtagaaacacaacccttgcaaggtggactatagtattaagcaaactaggaagaagagaggggtttgacaactcactagacgttttcaagatggcattcgtcatacatacaagtatagatacatatatatgtgtgtatttacagttacatcagaatacagggattatattttcaataattccctaaaaatgcagacattgttgatgtatataaaaattgcctttcccgtggttcactctggctgcagctacttaatatgcagagctgtgtccaaatcagtgctgtcaatatacaaaacacaatgtattcgagaatatagaataaaacagtcatatctgtgaatacagagtaagtctttgacatttcataagtttcataatatatacatttctggtagttagcattttatatttcctactcccttgtaataattggagcatttgccttcatggtttattacatgcccctggggatatagttgctcttcagccatctgtggtcattcatacttttttttttaagttcattttcagcctctttattgtcttttttttttaatactttaagttctagggtacatgtgcacaatgtgcaggtttgttacataggtatagatgtgccatgttcgtttgctgcacccatacactcatcatctatattaggtatttctcctaatgctatctgtctgccagccccccgcctcatgacacgccccactatgtgatgttccctgccctgtacatgtgttctcattgttcagttcccacctatgagtgagaacatgtggtgtttggttttctgtccttatgatagtttgctcagaatgatggtttccgactgcattcatgtccctgtaaaggacatgaactcatcctttttatggctgcatagtattccatggtgtatatgtgccatattttattaatccagtctatcattgatggagatttgggttggttccaagtttttgctattgtgaatagtgccccagtaaacatacgtgtgcatgtgtcttcatactagcatgatttataatcctttgggtttatacccagtaatgggatcactgagtcaaatggtatttctagttctagatccttgaggaatcaccacactgtcttccacaatggttgaactaatttacactcctgccaatagtgtaaaagtgttcctatttctccacatcctctgcagcatctgttgtttcctgactttttaatgattgccattctagctggtgtgagatggtatctcattgtggttttgatttgcatttctctgatgaccagtgatgatgagtattttttcatgtgtcttttggctgcatacatgtcttcttttgagaattgtctgttcatatcctttgcccactttttggtggggttttttcttgtaaatttgtttatttctagattctggatattagccctttgtcagatgagtagattgtaacaattttctcccattctgtaggttgtctgttcactctgatggtagtttcttttgccatgcagaagctccttagtttaattagatcccatttgtcaattttggcttctgttgccattgcttttggtgttttagacatgaagtccttgcccatgcctatatcctgaatgtattgcctgggttttcttctagggtttttatggttttgggtcttacatttaagtctttaatccatcttgaattaatttttgtataagttgtaaggatgggatccagtttcagctttctacatatggctagccagttttcccagcaccatttattaaataggaaatcccttccccattgcttgtttttgtcaggtttgtcaaagatcagatgattgtagatgtgtggtgtgatttctgagggctctgttctgttccattggtctatatctctgttttggtaccagtaccatgctgttttgattactgtagccttgtagtatagtttgaagtcaggtagtgtgatgcctccagctttgttcttctggcttaggattgtcttggcaatgtgggctcttttttggttccatatgaacttttaattttttccaattctgtgaagaaagtcattggtagcttgatggggatggcattcaatctataaattaccttgggcagtatggccattttcacgatattgattcttcctatccatgagcatggaatgttcttccatttgtttgtgtcctcttttatttcattgagtggttgtttgtagttctccttgaagaggtccttcacatcccttgtaatttggattcttaggtattttattctctttgaagcaattgtgaatgggagttcactcatgatttggctctctgtttgtctgttattggtgtataggaatgcttgtgatttttgcacatggattttgtatcccgagactttgctgaagttgcttatcagcttaaggagactttgggctgagatgatggggtgttctagatatacaatcatgtcgtctgcaaacagggacaatttgacttcctcctttcctaattgaataccctttattgctttctcttgactgattgccctggccagaacttccaacactatgttgaacaggagtggtgagagagggcatccctgtcttgtgccagttttcaaagggaatgcttccaatttttgcccattcagtatgatattggctgtgggtttgtcataaatagctcttattattttgagatgtgttccatcaatacctagtgtattgagagtttttagcatggagggctgttgaattttgtcaaaggcctattctgcatctattgagataatcatgtggtttttgtctttggttctgtttatatgatggattacgttcattgatttgtgtatgttgaaccagccttgcatcccagggatgaagccgacttgatattggtggataagctttttgatgtgctgctggattcggtttgccagtattttattgagaatttttgcatcgatgttcatcggggatattggtctaaaactctctttttttgttgtgtctctgccaggctttggtatcaggatgatgctggcctcataaaatgagttagggaggattccctctttttctattgattggaatagtttcagacggaaaggtaccagctcttctttgtacctctggtagaattcagctgtgaatctgtctggtcctggcctttttttggttggtaggctattattattgcctccatttcagagcctgttaatggtctgttcagagattcaacttcttcctggtttagtcttgggagggtgtatgtgtcgaggaatttatccatttcttctagattttctagtttgtttgtgtagaggtgtttacagtattctctgatggtagtttgtatttctgtgggattggtggtgatatccccgttatcattttttattgcgtctatttgattcttctctctcttcttattagtcttgctagaggtctaccaattttgttgatcttttcaaaaaaccagctcctggattcattgatttttgaagggttttttatgtctctgtctccttcagttctgctctgatcttagttatttcttgctttctgccagcttttaaatttgtttgctcttgcttctctagttcttttaattgtgatgttagggtgttgactttagatctttcctgctttctcttgtgggcattcagtgctgtaaatttccctctacacactgctttaaatgtgtcccagagattctggtacattgtgtcttggttctcattggtttcaaataacatctttatttctgccttcatttcattatttacccagtggtcattcaggagcaggttgttcaatttccatgtagttgtgtggttttgagtgagtttcttaatcctgagctctaatttggttgcactgtggtctgagaaacagtttgttgtaatttctgtttaaaccattcattcagcaggcacttactttgtgccagcattgttataattcaccattttcttaatgctaaacccttagagtcccaaaactgtctcacaagctcccctgagcaggtaggggctggcctctaccaagtcttcacatgttgcccctccttgcaccccaggatggaagtttggtttccttactgggatgccccatagcactttattcttgtaagacatttatcactctctgctttgcactaaaagtgctctgctgagatctgaagagtatttgtgatgtgtgtatgtaatacatatttgtattaacggctttgagttctaaagtgtagatgtttttcccatttctaaccagatgacacatttttgagagcacaatctatctgatttattaccgacagttagtaatgttgtggggaatttaaaaatacacttaaaaatgtgtacttaaaaaacagtatatgctatgccaataattgttgggtaagtgaagattattgaaacatagtctgttattagcccactaaatgtgagaattcctttttctgctccacttttcattactagtttatacacaacagatgtggcaacatttcattactagtttataatacagctagatgaggagaaagccagtccctccaaagttagagatatgagaatcccctgaaagtagattttagtgcatttgcatattaacaaagagacgctcatggaaacatccaaggtgaatccagcatccaactgttgttacatacgttgtggttgttaaccacaaaaatcttgtaaaataaatttgaatcacttgtattacattgcagttctactgaaaatacttgatagcaatacacctcaaagtttgaatatttgatttcttcaaaacacttggcaggacagtaattgaattgggcgtgatatcgattgcttaaaagcctaacaagaagaaggcagtttccaagatgacagtggccttaagagtgtcatacaggaaaccagctgtcatgtgcttagcttcagggagaatacgctggagcaagaagcacgaggactcctgggactcactgtggacactgtgtactcagtcactcgaggaaaggtgccgtgatgtttctgtaggacttccgcccaatggtaagatctgggattcatcatcctagctgaatagagtcatgttaactgttggggttatcctggacttgataaacctgttctgaaagctgactttgacctctgtcttcataactggtttgtaaggtccaaagacactaaaacagccagcacaccttttgtgcactaagaatctttcacatctatcaatcacgggccacctcccctcgcatgtttatgtgctacgttagtatggatccatggaggaaggtgacatgctctcagctatgttgtggcagtagccatgggctgctgttgcaatgacagggagctataaactgtgatccataggatatactttgcagctagttgcagctcagtatataagttggctttggtgactttttttgggaaaagagagggttcagtggtgaaagaaacatcattaaaaggttgacccaggggtctagtattgcggctggttagacataaaagccagaactcctgcattataacatgtaatcaaagagttgagtttctgttaattcatagagaaaactcatagcagtcttggagtgatattttgggtggatattgagttttaagtcctgcattcatcaataaaaccgtaattttataaaagtggaagacttgtgaatattcaagcattttttgacagaaagtacagtttatatctgtgcacatgtgtgcccaatgtaagtctgtcctcaagttatccactggcatcacccaggtcccttacttccttcccttatgcgttgtttgtaacaattttgctgccaattaaacatgtctaccagtgtgtagtcaagagcaaagaatataaaacaaagatcattagtgttacttcttgtaaaatatttactttttgctaaagatctattacttaaaatgagtttctaagtgggttttaattattgttacttctctatttgtcccagtttttacaaggtaggttgtcttttcaggagagcaaaagcctagcatgtaagagagtagaatatcaagggaaggaaatacggacatattttcatcccagtgaaggctaaattagctcaagagcacaaccaagggatacaaattaagaaccttcataattcagcaaatgtgggcaataaaggtagaatcctggaaatcagcctgatcgtgaatactcaaaggattatgtattaaacaagacagggcccaatgaaattgtctttgtgttagaaattttcaattgcagaaagttacagctcattcaagacctaatatccataatgcagtctgacagcagcaaaatcactccaccggcaaaagacttaaatgaaaagcaatgctaaatgcctgcctaggagaaaaagtgacacagtgttacataatcacacgtccaaagggtatcatagaaagcaaaacagggccaccaaatggacccttaggcctttgctcatgatgcacccaaaatattagtcattcatgcagtgaaattgctttgttttaagcaccaatagagtttcttgacctcaaaacaggataaataacgattcaggataatctaagaggtgatggtggtggtgatctgtatcagaagctacactaatatgagcagggatggcagcaatgtttggtcaaattgagtcatgaaaattccattgattaaatactcctgttatgtttgaaaacataaaactataaagagcttaaagacagctgtagtacatgtgtcctctactttagaacgctagcatcatttcatcgtaaaatgggaaagcaggaaacataaaagtctaggaaagaaggcaaacacatctaacttctcccgaagagatctttggatccacaaggaaccattaaagaagaggacaaccaggtagagtaacagattgttagagccttgagttgaagatgtcaggaacctacatttcttactttagaatggaattctttaaacagaatcctgaaagctagagacattcaaatactgctctctctcccattgaatcattgatctttttgatccaaaagcatatgccgtgggaccaagaagaagaagaaacattcgaggtggttctttacttttcacagtttagaggcctgtgcagtgctcctgcaactaatggtaataactgtggtcattgtaaagggaaagttgtacatacgtatacaagatagggaatgtgttactaatgtcagaacaaaatcacaaacatcaatacttaaaaacaaaggggaaataatacacattaagcctaatctgatacatataatctcatttaatcctcagtacaatccagtatcactccgctttgtaggggaaatctgagtctgaaaacagctgagtaaattcctgtggcggcccttcccagccttgcacacctatcaccttggcctgactttggggtctctgctgacccagactctcttccctggagttctagtaaaaggtacagcttcttacagaagaaggtaattcctctggactgaacctacaaaggactttgaagtctttaaagactgtcccctccccagcttagcagatgttaagcagaggctgaaacacttgacacttagccagcaaatttggttgtatttttttacagttgtctttcgtttgtcacaaataggttctctttgtatttgtggctggaattccgtattattgtatactttgcatagactgtaaatgactagcatagcgatatttgtaaatattttactaagaatataattatactcttctaaagagaagaggatcgccgtccttcccttccttgtgcctgaatgaatccccagcaaaggcctgttgcagcaaagctaagggattagaggagataaataacacagtggcagcatctgcctgagggtgcaaaggggcaggggccctgcaggaggaacgttggcctctccccgtgttttgtgaatctaacgttactacttaggtgagtttggattctgtagttgcgcatcttcacagtaaaaagtggtggagttgctaagggcggatgagtgtggcctcagaagactcatccccctgggaactttcggtagccacagggaaggcttgcatagaattaggtcttgcctgatcaaagccttggagctgctgggtgattggacatggactgtgttctccctaggcatcttgtgcttgtccttccagtgctgattgtcctcggcggtgcccataggtgactctgtcttccgtaccagggctgttctgtggagccacagactgtgtgcctctctgttaccgctgtctccagcaccttgaagggtgcatctgctgctcacagaccttcagtaagttcctgctgagtgaatgaacacacgcttgtttgtaaggattagtgcttctgttggcagtgggatttgagaagcagggcacgaggagagagcaaggaacacccgggaacctaccctccctcagcctccaccttgttagagttcctcctgataggaagtggcagggaaatgcagtgaatctaaggaggggcacgtgtctatctttctgattgaaacacttttcttttctgtaattgaaatagctgtggccgctggcttgagaaaatatcccctaccttgcagtgtctagcatcaatgctgtttaaaatcttagatcttcgcatggccctcaaataccagtgtttgcaccttcacaaaatccttaaaggttagtcttgtagatgggtgttaggttgacttgatgctctgagaggctgagcgacaccctgaggaaaaaatgctgctttggtcccgactccctgtgtttttcctcctgagaagtctctggtcctgaccagctctggcatcatgtgccgatgctgtttaatgctctctcttaacttaaaatactgccgtggggttctccagcagtgccactgatgtctcagtacttgttttaaaataatttatatgcagcgtctatattaacctgcacacctctttttagcaatttctcccttccctgacaagtcttttctcgtacatgacgtgaaatagtggagggcagaggcccaggccaagtgcatggctcatgcattatgtttcttttggtttgtcaaaaaaccattgaatgtctgtgaaacgtgcatttcctctaaactccactctagttcaacacttagctaacagattttctaaaaattaaagcaattgtatcaatgcctatgaaatatgctacaggaaagacccttgcctttctgtgaaatactgtcttctaaatagccaccgtcatttgtgcctcctgctcaagagagggatgtcaattttgagtcctagagtcaggggtactctgagctacacttagtccttttctcattcatcctccctttatgaaatccatcattactgctcccccacattttgggcaaattgcatgggcatccctgactaatgaatttttcctggagtcctagaggcaaagggatagggctagcacttgtcaaggtatggtctgaggtctgtaaataatgtgtatggcctgggcggtggtggggaagggtacagattctagcatctcactctagacctgctgaatcagactctctggggtggagcctaggattggcagttggaccacactcatgagtaactcatggccctttgagaatagttacgtccattcagcaaatatttactggtggactataatatacaggcacttggctagatggtgggaatatagggatgtacaaaaacagatgcagaacctgagtatgctgctttatacttactgagaaatgcaattcaaccttggattggaaggttcagaaagacaactggaaacctgggatggagattttcaatcaactagccaaatagcaaatatttattcagttctcaggagaaaggtactatgctgactacttgagatgatagagaatatagcatggttcctgggctctgaggatcttatattctggctgggaaaacagcatatgaaaagttaaacttggccgggcccggtggctcacacctgtaatcccagcactctgggaggctgaagtgggtggatcacctgaggtcaggagtcgagactggcctgcccaacgtggcgaaactccatctttactaaaaataagaaaaaattagccaggcatggtggcaggcacctgtaatcccagtcactcaggaggctgagacaggagaattactttaacctgggaggcggaggttgcagtgagctgagattgctccactgcattccagcctgggcaacaagagcgaaactccatctcaaaaataaataaattaatagataaataaatataaagaaaaaaacgaagttaaacgatagcagacaaacctggttaattgctaagtgagtaaggctaacaataacagtgttccggctgtcactagctcttcaccgaatgtctccttccacctcaattttcccacatcctgattccatcctacttctagtgttttgttattttaatatttataatttaaacatcactattaggatgttacaatttgctgccgtaaggtatttggaatttttgaaacacaggccacctctgcttcagatggcatatcattctgctgacttaatattatccaaccataaagcaaaggtgaatttctaattacttagaaatatattcagttaaaataagctttttttctttttcaaaatgctatctaatttaaatacatacatatatgtgtatatgtgactatatggcatatatgtaagattatatatgtatatacctatgtatgtatgcacatgcacatgtgaaaagtgtacagcttggaaaatacaatgtgatatcagaataaagtaaggaaaagttatggtgtaagagctttttggatcatttgaaatgttagagattgctgtaggttggctttctaaagtagaccagaagatcctcgcttgggagttctggagtcaatagagtagagttagaaatgttctatttaatacttttcagtagatcttctggagttagccctctgtgacttaaatagttggaaattaaggcatattctttgggagttggatgcatataaattccagagggtggaagccgtgttagtacaatgctgtgggtaagagctttggttttagagtcagatggttttgtgtacatgtgtgtactctgactatattgtgtggccacaggacttaaatttcttagactcagttttctcttctataaaatggcctgagtaatagtacttatctgatagggatatagaaaatgttaaatagatgttaagcacttacccaaagtctggcatacattaagcactccattattgactctcattacatcatcatcattttctcagttagttaaaagagcctactgcgtgtatattaatttgcctttccctgaaaagtacgacaaattcagctccacagagtaacttactgtcctttttaaataccatttctgtgtggatctcagcaattgtgtaaacttttaaaaacagaattatccatattctttcagtgattgaaaattatagaatttggagccaagcttcaagtgttcccttgtaatgtgtacccaaagaggagaatctgactgtacgttgtttagtcattcatagcatgtataccaaccagtgtttgttcaatttaggatggtaaaaataatttgcacagtttgttaattgtgccccaataaaaatgggggaaaaacagatttagatgatagatgaattttggcttggaatatagacctaattaattatattttttagacacaaatttaaagttatttctagcacattaaaataaacaaaattagcacaatgtgaaactatatggaaacagaatatagcaatttccataagagactttgaaatactgacagtaatgattatggaattttcatttcccagcagctgccatttcttggagatgtttacatattaaatattagatcatttctaaaaaataaactgagacacgtaaatggaattattttttatcctgaggctcagactaaagtcccagagtatgacatttcctgggcattttctctgtagctctcaactgtcccagccttcggttgcagcacagagagcttctgagtggccattgctgttcaagacggtacagcttttccatgcttgtcctgggtctcttccttgacagacttattttattcattctgtgtttacacaccgacagctatgacacacacaggatcgggatactctgctgggtgctatggtgcaaactcgcaaagaatttatcatcgaacagtaaaaagatgagcctgaaaacatactgccaaacgtttacttttagaagactgggggcaggtgtcatgaactggctttgtttattgtatttcaaatcttgttttctttaaagaagccaagatgctaaaatgagtggcatgtgttcagtaggaaatcatctctcgtgtgtgttaaacagagcagtgttctccctcctaaacaatttataatgatgtaagatggaaccttgggtgctgtgactgaaaacggccataaattatcaagtgtaagtgggaaagttggtgcttaccatttaacttgagcctggaacatactgaaggcattaagtgcagtggtatgtgactgaactgatgggagttaatatgtaattactgttttttacagtacagttatggcaattatatttattctattttttggaaagtacatataatgtaattataattaataactgcaaagataggctcaattacttaagtcatgaaagtgaattaccttaatcatactgagaatttttcagccgccctgtataaagaatatctatggaaacagtaatgctctggagaatgttacttgtaaggaaactgaaataaataaatgtggagtttatgctgaaatgagtagttttaaacaatgaagaaaactatcagaattttatagcttgctactatctttaaatccttttacatagtgcatgaatcatcatgctttcattgtaaatttaaaattttaaatgaaatttcaagaaacattgtctttgcaaaacacagttctaaatagttgaaaagagtgaggaaagaaattctgttaaaattcaggattatttttgaacccttgattgactttcgaggaatattttaaactgtctagaaaactttgcattattatttatggtattatgtgctaaataaaaggggccatatcagtgttttcttataaatagtttagttacttttggggatgaaacttccatatagattatgtgatttttatgtaaaaatgtaacctacaaggaaggtatcgctcaagcttgtgagttatttgagtgcaattaatgtatacatctttccattattagtctattttaggtaacacttttaaagagtttaactcttccttcttacctaccccctgctatctgatgacttgccttatgcttcttctaaattttagttgcacaaatacctattctttacctctccccgtttcctttcccagtaccctaaagtagaccacatcattcagtttttttttttttttattcagcaaacaccccctcaggtcatctcaacaaacctctcaattctgcctctctcatcggctcatttctcttcgtctccactgttaatatggtagagtaagccatcttcaatttctcacttgcgttattttccaggaggttcaaaccggaaatggtttcgtgggatttcatttaaagtaaaatagacatttttagtttttgagagatggtgagccaacttttatcttttgagaaactgcctctgctcaatcagttagtcagaagtacctaaccgtaactaaatttgccttaaaagaaatctggttggtatattttcactcttccccaattataggtacccaaaagggcaagaattatattagatttcatcttttgatgttggtttttgtttttgttttgtttaggagacgggttctcaatctgtcgcccatgttcggtgcagtagcgcaatcatagctcactgcagccttgaactcctggcctccggtgatccttccatctcaccctcccaggtagctgggattacaggagtgagtcaccatgcccaactccgtctttagacatttaagtgccccatttcaactatctggtatgcttctctgtgaaatactgtaggtgtgcaatagtcacccgtccatccacctttagcgtcatgtagctcttctgtgtttgtatttatgtagacaagacttactgtattttatgagcatgtgaatttttaattatgaataagttttggtatattggaaaaaagtacacaatactgtatttgctttgtcacttataaatttcgctatttaagatttaatactctcaaatttgttaaattagaacaatttttaggatagtgccagtcacttatttgtattaaaaataagggttaggcgcagtgactcatgcctgtaatcccagcactttgggagaccaaggtgggaaggattgcttgagcccgagatttcaagaccagcccgggcaacacagcaagaacccatctctacaaaaaatttaaaaattagccaggcatgatggagtgcgcctgtattcccagttacttgggaggctgacatgggaaggtcgcttgcgccgggggtgttgaggctacagtgagcgtgatcacaccactgccctccagcctgcgtgacagaaggagaccctgtcttaaaaaaataaagcatagttgctaacttttgtgtattcgtagagtcattcattgagtacaattttttgaacactcaccacatgccgggcgctgtgctcaggtctgagaatgaaactctgaatgcttgactcctttgtggggaagctcttgtctaagtcattatgtggagctgaggttcctagcacagtgccccctaacctatgctggggttactggatggagcagaatagttccctgagaagtgttgtgaagttaaataggatttggcaaaaggaataaaggcaaggggcagtccccacgatggaggacattggaagggtgagttcagcacatttgaggaccagggggccgaccagtcaggagcagagactcggaggggtaggatgggaagagtgaggctataaaataagccacaagaaagctcctgaaaagccttcattattctgaaaggcttgaagagtacctacaggaactgtaaaagattttaaggacctggtgcaacagaagcagattgacgttcttggaagatttttctgggggagccaagtggaaaacacatttgtgtggtctagactagacaacctggggtggggaagaatacaaaagcaacagtcctcagttcctcaggcccttcactgttgactttgaagtgcagactaatcaatcattgcatgtttatttagttcctgtttcatggtgatgtgccttgatagataaggctgaaaattcagagaactgttagacctggttcctgccctcaagacatttagtctagttgggaggaaagataaaaacataatgtatggtatgtagtgtttcaatagcgtgcacagtagtttcacatatagtatctgttttaatccttgaaacaactgtaatctatcacattattgcagctgacatattattaatgagagactgtagcttagatgaagtcatgtcctgtagccctctttataagtaatgaagataacgactgcaaacaaggtctttggactccttggcaagatgccttcccacgacatcatactttcccacttgttaagtaataccttaaccaggtagctgcctgagatgaaaacatctgagattgcataaagtgtgactgcccatcagatggcttacatagatgacaatgtggtacgtttagagaagaattgatcactgtatcttgaatgataacttgtttcttgatgggagcaaattctgatttggaaacgaattctagggcgcagaagtgaatgaagtgtccagaggcagacaacagggtggaagagtttgtgccctatggttcttatgggggaaaatagggtaagaactgaaagtatcagttggatccagtggtgaagaactttggagtgacgattaaaagtggatgggctgggctgggctgggcgcggtggctcacgcctgtaatcccagcactttgggaggccgaggcaggcagatcacgaggtcaggagatcgagaccatcctggctaacacagtgaaaccccatctctactaaaaatacaaaaaaattagcatggcatggtggcggcgcctgtaatcccagctactcgggaggctgaggcaggagaatggcgtgaacccgggaggtagggcttgcagtgagccgagatcatgccactgcggtccagcctgggtgacagagcgagacgctgtctcaaaaaaaaaaaaaaaaaaaagcagatgggctgtcataaagagattaatgaccacaggatccgagaaatacacacctgtagttaggaaaaagaactcagtagtggtgcgtggaatgaatgggaaggtaagtcgtaaggccaggtagttaggaagagattctggtagagccaaggtctgtcctccctccactggggggactcagtcccctcgtgattcttctgtcctccctccactggggttactcagtcccctcgtgattcttctgtcctccctccactgggggaactcactcccctcgtgattcttctgtcctccctccactggggggactcactccccttgtgattcttctgtcctccctccactggggggactcactcccctcgtgattcttctgtcctccctccactggggaatctcgctcccctcgtgcttcttcctctcctcctgttgtcctctttttcctttgtgtgcctgtaatggacacttttccattccatatctcttgggttttggagatggtaaaaatgttcttccttatcccaccaattcttaataggcttctgtcaccttttcacagttctaatatccagtttaatgaaatatcttgctgttctttaatcatcatgattctggtttgttggaaatcggcaaacccttgaaatgctagagacttgtagaaaaacaaattcactttgtttcaggccctagggacttgaccattgcagcttaagatcgccatatgtgtgcttcctctcacttcaagttccggttttgtctgactgacggacccttccaggccagacagttgctgccattcatgccttcctgacttcatctgcatttggaatgatttccaccccagaagaattagttggatgttttctactatgcataccattgctttcctcttcccttatttgtagtttcttgcatatctcacgttgagaacttcaggcccccacacagtttaacgtgccctgcaatattttatgcttatttcgctatttcaaaatggctaccaaaggcaccagtcttagtatagaccttgcattaaccttttcagtgttctgccaagcatctacgttagaaagtctctagacatatatttgcatttattctcatcttttattaaaatacatttcttttcaaagtttatacctgacttaaattgtttttcagagtggtaaatgtctttactttattcttcaaaaaggaaacaaataaaatgcacagacctgaaggagacagctctttaaatattgtatattcccagcactgctgtgtatcagtgctgccactcaattggctgagaaagctgcttggcatttctgcagttaatgctttgctagtggtacattttcttttcatttttgggttcactctctaggcctctggttggttaatatggacattatctagtgaaaatgccgcatttcataatgttagaacaaagtttcacagtaattgccttcggaagacatttgcagctctgcatttacaacttactctcgctaatgcgtggcaaggtcagaaaagcagcaggcttgtgagtaagaaggaaaaaaaaccgtccctcttgctcataatgatttatgtagttgggcaattaggcaaaatacacaaatagtagttcgatattatattaatcaatttagccatgggatataaagtcataaggaatgtcatctgctggggatgaaacacagtgctcggtgcagaatgtttactgtatgcttctacgcaacagactgtatgtagtttccagcagaattatcgtgcttatttaacttggctctcccatgctcctgtgttgaattggtgttgagaaagcagattagacaatgttaaatgaaggaaagaaacttcaggaacaaactttcaaaaacatagactgtattatttaaaaaaaaaaaaagcacccccaaggacaggcacggtggctcatgcctataatctcagcacttcgggagaccgaggcaggaggatcacttgagccaggagttcaagaccactctgggcaacatgaggagaccccatctgtacaaaacataaaaaatcagccaggtgtggtggtgcacgcctgtcgtaccagctactcgggaggctgaagtgggagaatcacttgagctcaggaggttgaggctgcagtgagccatgattgtgtcactgcacttaagcctgggcaacagagggagaccctgtctcaggaaacagaaaaaaaaaaaaaaaaaaaaaaaggcacccctcgccaagccctgactggggagtggagagttgaaaatatgcgaagctgtaagactttcttgtttatttctgtgtcgaaggcaaggcagcttaatagaatttgaatataactaaatccatccacttagcataactgtgttcctccctgtaatgcagtagccaaaggtaatctgtttgttatgtactttcctttattatcccagcaagtcccacattctggaagcaaatgttatatttaccataatccatgaaaggaaaaagcccaggctaaaaatacagaacagaacaaatgtaaaacactgctgctgctcaaggtttgtaattgctctataagtgagtctcaggcatctgtgtggcacagatacttttatgtgttgttgaaagagctggctgagcttcagatgggtttgcaggagtgtcaggattcaggagcgtctctgaaaggtgctttgtgctgaccaagcaaataatagcaggttgtatgcaggactcccacgtttgaaaacatgactgcctggtgagtgattgcatttaatataagaatcaggtaaaattgtccgcacagaaccagttggtggggtggagatattaaaggatagaatttttctgggaaatctatattctcaaatcagctactgaaaagggtggggacgctgaaggcaggaagtggagagcggaagtgagctgtgggtgactgcagagaggttgtagcactctgtgcagggctcccttcaagctgaatgtagaacaactgcacataaaccagacatgctttagaaaatccagccaggcctctgtggtagataagaagttgcttcatttatttttctttttttagtgtcattaccagtattggttgcactactgtagcgttctgggtgctggggatcaggttaggccaggtagcttctgtttaaaatgtggattttatatacgttgtttacattttatgagagaattattccttatgtatacttttttctttttcattttctaactactacttaaaatccaagaacattgtgagaatacctacctgtactctcctctggtacttttagacggtgtaaaacatttcactaaatccttacaacagcatggagaggtgggcctctttgtgcttgttctgttgctgtaggatctggcactctgatcccagcccaggattgcatagcaagaaagcttcaggagctgggatctgaacttgggtctgaagcatcaaaaccctccctcttttccatttactacacttcctacaaatattttgtagtattttacagagattcattttagtgaatgaatgaattattcaaataatgacaccttattagcagtattttccacatgttcatgtgagggttttccaaaaggacccaaagtgtaattaatcgagctttctaccagagtatcttttcgaacatatggaatatatctgtatctctacacgtatcttaaaaaatggataagataatgtgtaagcatagctgtgtttcaggtctgaacaatccagctttcataatgaggaaatatctttgttatcatctaaacaagcaatttgttttccctttccattttattactccttgtgtggcctgtctgtggtcatggttaactggtggaagggaattactcacaaagaaagtggattggagaagaataacgtggggtcactaagccacattccatcattccccaatggccacacgctcatgtgctctgtcggtgatttgttactatataccattgctaaataatggaatctttctcataatctaagaggacttttcaggattctttccatgtgaggccagaggcaccttgactctccctgtcatcagataagttcatcttgcatttgcaactcatagccacatccccaggtgtgtttatccacatagtgttatctttgcctggacgtcctgatagcacgggtgaaaagtaaggcagctcagcagccagcctgtagccttggtgtgtgacatcagaaaggatgtgtttatttgaaagaagaagatggagctgatttggtcaatctagttctctaaattgacattcagattgcaagatgcctaaataaaaattactggaagtcattagaatgagatcagtgcctgaactaagagacacattactacgtcctgtttatttatctgatcaatctttcatccatccacccacccactcccttgtgcctgccaggctctctgcttgagtgtgccaggatacacagtgaaggtgactataggaatgaaaaagggatgatggattcaagagaaactgctacttggtattttcaggtttttgtttttgtgaaggatgatactttgggaaaaggaatcatacttttcatttgctctggctttgccctcttggtgagaaattgtggtgccagcagtagtggtactgacacaaaaccagtgtctggacaagtcaaatgggtcgcattttagtttgtttctaaatatttaaagaacacttattttaagattgttagatttagaggtagaagtaattaaaaaccaaagctacttccctccttttttgtttcttttaatatcgtgagccccaggagcttctgtagtcattaaaaaataaaatgcatgtgcaaagcttgtccccataagctttttggagtgtggcttttatgcatataaaccaggatgcctttgttaagtagggtgagtcttttaaagtgatttggttcagcgtttcataatcacatggcaatatatgcaaggcaagtggattcctcttgtatttaatgcagaatttaagttacagaaacacacataataacggtttgccgattttgttaggaggaaattgtcctgattataattatctccacggcatagagttgagatttcatattactgtatcacttgcaaatccatttttgtgaacacctgaccacaggtctgtaaaactgccaagcagagcctcgcctgggctcacacacaaggcaagatttccttcctcccagcaggaggcatggcacagtggcagcaaagaggtttctctctccctcagacggccacagggcagaatgaggaaggtgtgtgaaatagtacatgtatgtaagatagattttacattaaagtacgagagcgctgcttgtttatttgcataaatgaacagccatgaaagtgaccccagtccggcaagaagaacgtggcttgataaggaaggggctcctctgttttttctaaatgtgtgcattaagtttccttgtattacagttgagagagtaaaaggtatttcagccgtactaatattacaactgagagagtaaaaggtatttcagccgtactcaattggtattttgggcaacagtgagaaccctaagctgtgggcattgctcattgttcagatttagccagcggaggcctgtgcctgccttcacacagcgtgtaacggaaggcattgcttttgctgactggtctggaataggccaagtgtaaatattagtagtgagttttgcccaatatgcttttttctcctatctttaaccaatagaaatacagggctgtaaataattgaagctgagacgcatccagtgttagagacatatatgaattttaatcacagtcaagggcagtttgacactctcactgtctgctggcaaggcgatccaccttttctgtcttgggtcacgatagcattgtgtcctttctcattcttgagatgcctggcttcctaaaatgaccatctttatttagattaaggacccatttagagtagttttaataatgtatgctttcatacataagtggttccataatttatttcaccattattcttctctgtcagggttctggaatgtttttgttaattaagcgggggaagagcaatatctgcctccagccagccaagctagttgcccttgttgttatcgattattatcttaaaccaaacacacacacacacacacacacacacacacaaagcaagcccagtagcctgtcagtaaaggccagttagtgtattaaaaatagcctcaataaacctcatcactctggtatcactagggaccttgctctgagctggaatgcatttgtcctgagttttaacccatttaggagagtaacctccttctgaatgctgcccagtccctgccaccacactggcattattgacaggtgtttttttttctttcccaagtcggagtctccttctgtcacccaggctggagtgcagtggtgcgatcttggctcactgcaacttccacctcctgtgttcaagcgattctcatgcctcagcctcctgagtggctgggactacaggtgtgtgccgccacacccagctaatttttgtatttttagtggagacagggttttgccatgttggccagaccggtcttgaattctgacctcagatgatccacttgcctcagcctcccaaagtgctgcgataacaggcatgagccaccacgcctgacctattgacacatatattaaggaaatgtccccaccctcatcagcagatgcagttttatttcccacatagctgaatgcacagatctgtgggtttcatgtcatctaggtgaaaattcctcaggaacgaatcttttctataaagtaaatatgagccccgtggccagaggaggtgggatttccagaagcagtgtactaagtaaacccgaggctttgcgccttgtgagggtggcgtcaggacacatttcgtgttcctcttactgctgcatctcccgtgctctgctctcactgactttctttggcttctcatgttcctgtgtgctgaggtagaacgtttccaagctgtccacagagatcacgattctttgggttgctaacgaaacctctgaatggaagcctcaaaaacaagctgatcgctaagtgtgtgtgtcattataagcccataattaggaagttacctcatcatcttgcatcgaccccgatggaaatatactgtcttcaggtattcagcacttgtcagttgatctccaaaaaccctaatgtctttcccctgttaaatatatccgtgattctatggacacagaaaagctcacagttaaatttcccaggggaaatgtggtttccaaaattgataccatatgaccctgggaggagaattaaaattgtttttgtagtaatatgggttgttgttaatatttctgtatcctcctgtccttggtgagtttttagctttcaacatcagtgatatctgtttcattgttgtctttactaacataagacacaagtctttccaagtagttctgttttccctaaatcagtcatctagaaaacaaacatacacactttgtgattttcaaagaaaatgtagagctgaaggcaagagcacaggtatcacgctttttgtggtttataatctttattttgacctagttactttgtgacgcccctcccagcatagcaagtgtgtgcactgctatctaaacatgaaccctgcatgccatgtcttagaggaacttgcgatccaccttgttttgaaaagacttccttcataatcatacttgaatgacttcattgatttgggaattcctgtttagtttcttttgtttgattgcccttatataatggtctgcaagaacaaacatacaaacctaaaatctaaaagatacttttgacaccattcaaagtggagattatggttgaaccaacagtggctgcactgagctccagcttccagatcagcagttgagctgcctctgtgtacccaaacctccccatgtcaaccagcaggaagaaaacaaaacacctgggcagccatttgttttcagctttcacttttgcatttgcttttgaagctgtgctatgcaacacttaaattataatctgtttatttctctcacatgtggagctcccgtctctccaatgagtttatttagcaaatgttatgaattcaggaaaattatgattaattttggagccccagtctagacctgtcattttaacactgaagaactacagttagatgctttgtgtggttattaagaagaacagtaattatttcagtagtataaaaatatcaacaatgattacaggtgactttttggcttaaatattcaactccccaacacctttcaagaatgttgtgagatcataaaaagtccaggagcaaaatattagttaaggaagaatgaggctatttaattggttagacttgttggtgagaaaggcatgctgtttgtagtctgtttccatgaccacagctgtttccccacccagtttttagtagtataatattaagccttaatttacaactgaaagttttccacctccggtcccgtagtccaaatcaagttattaaatttaaaccttatggcttttcctgtatattccctggattcagcttaccactttggcccctattaaagaaccatattgctagtatcccgggctttgtgtgtacttgaattgttttttcttctgtatcttttccatggatgggataactgggaaagagacgagggagtgtgtgagtcagtaacgatagtgtaggattttgctgttgccgacagtttatggattgttggttttgtattgtttttattttgtcttttggcaaggctgtgttccttccagttgagtgaggtggatagagttttgaactctggactctaccatcaccttattcctggagatgtatcagtaccgtatacacaggggaccctatgtgtggccatgagccttgctgtagaacctgtggctccagagagccacctggccacagagagcaaaagataattttagccttgaactaaaaggaggaatgaggctgtgttttctggaccaaaccctaacttgagtccctggatgtttacatcttatggtgaattgagtcaagaaaaaaaaaataagtagataagggcttttaggaaacatagaatattctttctcctaaaaacaagggtgtctggtttaaaccatttcttcttttcccactctgccctgagtctcactcgggtcatgctccatcttgcaacttgggagaagtagccccctctctgagtaggaggcaggcgtggggcagtctacacaagcctttcagagttagagcttggtaaagagaaaaagaaatgctgttcagggaacaagaattgctgtagtttcttcaaaagcagcagtgaaagtcctgaccctagcaccatggcccagttatatcctagaccttgggtttgactcctgtgaattttcctcttgaagaatgggcttgggtaggagtaagtggatgggagaggacttgggctgttccacatgcaggggtgcagccaatagagttgccatgccccacaaaaacatattcatgtagtcactgcgaaactggaccaagtttggacagaaagaaaagaactttgtgacacctcattcaagaccttgaacattaggttgtagaagctactaaacaatgaggaatataagagcagtgacaacgcattgttcatcattgtgttctgaacacagtgcatgacaccaagtaggttctcaggaaacagttgttaaataaaaaaaaaaaatctggtgggaaagattaaataatgggactatagcaaggtgtcagatagcatcagctatacaagtctgtgttgtctttctagagagactgtgacttacaaaattatccttttaacttcccaccctttcaacttgtcaccttttaaccttttcactcagaatcctaaaggatgttcttgaacaaaacataaaaatctgctttatttcttagtaatcttttctcccaaaaaaggaaatttttccttcagttactttctgtagcatctttccttgaactgtgctgtagttcacaattccatagtctcaacttgtgtcttcagaatgcatcaaacttacataactcttgtcacagttgtcagtttctctgacctgctaaaatttcagtagcacctgtttggctgtggaataggcaaggatggctgtggactctggcaatcccattagagttatccagcaccccagcatcgagggaggtggtgggctccatcaatccaggtaccatgagcttggctgtggcgctgatttctctaaagctcataatcttccacggtcagacttagcaagtggagctcttccttccagaagcaaaaacagattccctggaccacattacaagaaaaaattttacgaccaagtgaagtcatgtatttctgaatgtcagctaaagcctcatttagagccgttggctcatgcctaattttcccaagaaactggcaatttaattttttttgctgttgttcaggttgacccaccacatttaagccattctagaggggcctttcacctgtcccctcttaaatatagatagatatttttgaatattctcttccaggtattttttgacaggttatacatatgctaatagaaaataggcttattatttgaagcacagagctgcttgtcaccgaagcttcattaacaccgttatcaccgtctgacatttatcttataattttctagagctgactgttgtgtctccatggaaacccaaattgcaattgaaacaagtaggataataaaggcatccaccgagattgacagcatgcaaagcccagttacatttgttgatagttccttcagtagctacagctagagacagagaacatgcgctttgtgtgtgtaggagtaactctcttgtgtcacaggtcgtacctgactctgcttatgtggcaagtttaccctaacacccttggttctgctgtttctaatggagatgctaattttccctggaatcatctcatctaaaggcattatgaatattggatgtacaattaaccgtgatcttatttggatccaagaagaaaaattcttcctgggtgattttgacactgtgaaatgttgatcagtccctaaactggcatcttgtggtacctgaatggatttctttttgggtagggggagcatccgcagaattgtacagttttttccccttggtatcgaggaacctgtgctctttcaagttgatgacttcacagcaatttggttgctgcctcaaagcaaagagtcatgaaactggagtgggtccagaatgaattaatctgaaattaatttgattctgaaagactccatctggctgtgtttgggaaaggcagttagacagatatataaacacatgatcatctgtattcattgtgccagatgtagtgtcaaaaaatgaagaaatggctttaaaaaaatcaactatggggagttttgatgtaatgatattcagcttcttagtataacagccattataatttagcacataattctacttttatttgtttagggggttatatctgatggtgtgtgttttaagaaataagcaaattaaatatcaaagcctattttaattggtgatttaagatgctaaatggaatttatgacttgctgagagagagaagaagcaaagagacaggacctatagatttccaaatcaaaatgtagtatttggtactgatttcatcttaagatacaatttagggatttaaaaactagcgaagtagaatgtcatttggcctttgccttttgagatgtggttttgtagcatgacagaccagcatatttgcatggaaaggaaacatgcaggatgaggtggcctgcagagaactctggaagtcctcttgcaaattgttttgagattgtcagagaggcgcacgtttgaactgctgtcgaggaattcagtgcagtcactgtagtgcatctgattgccttttgttgtgtccagacaggaaaattgtaggaaatgtacacttgtccctttaatgatatcactgtcatctctttggggcattttatatccaacttttaaacctcatcaatcatctgttgtgatgcgctgaagagaaagaactaaagtttacttctggattcatgatacattactgactgaaaaaacaaactcccaaaagggaacaactcattcattgctcccatgtactccacccatcgcccttatttctcccggacaagatgacaaaaacaatcacaggtagggaaaaacccagcaggatacttagtcagcattaacccaaacaaagccgaagagtttaggcagagtcagttgttgcattgaatgacagcaaattagatggtacacaaatctcgacatttgatacgccactgtgtgaaaaccagagtaacatctcagctcatccctgaggaatgagccagtctgatgagctaagtttgcagtacagttgaaagcttctcctttaaggcaccatttctctttgttgtctcattttgaaggaatgcttcttacaacaagttatatatttcccggcctccttaagcagaatttattgagcttaatgtgaccccttggatgagacaagcttgtgattatacaaatgaataattgcgctgtgctgccgtccttgggaatggctagggaacacatctgagcccctgctgcgagtgggcttttcaccacgaggctgcttcagaccctggtgtctgccctcatcatgacatgggcctgcctattgcagagcctcccttttgtttgctcctcgtcttctcctgcaggtttgaaatgcaggtgatcaggctgtggaaaaccaacatgagagatcttggaggagtgggttgaagagttctccagagacctcaaagggcatgagcatccggatgggaagtttgtgacatacgtttctgtctgctctaagatcatttttttctttatgctgactattcacaaatattggagtttgaaggcatttttgggaaaaagaaaaatacacttgaatgtaataaatacatatccctcttcacaagtggattctgttttctctctaaacaactaccgtcattaatatgacataattagctcccatggactgtcaacttttgattttccagatcagtggaaggagacagtggcgtccttaatctcaagtgcgttcacatccaacctcacactgctggctgccttccttagcctggcgtttcatttcagttgtattccttgattacacatcatttacgactgagaaaggtagcccaaaagcaggttgaggagagaccagcctgagattaaattctgccattgatagatgataaaatgaataatgaatggacagataatcagcatttaacagaaaagtaggtggagttctgaatgccgggcaagcacaaaggtcagtgacgcctttgtcctttagtccaaattaggaaagcccaccaaccagttttatattaataataatgtaatgagaacaagaggatagccagaatcaggacagtggctgttcagggacaagtggacccagcgggcatttggagaaaaataggcatgactcagtaactgactagtaataggtgtgttgactctcggatttaataggacggcactggacgggataacatggctcttaatagtggcgacagatcacatgacgtgtgatttaattttactgctttgaagacttctcgcgtgccgtattaaatctattcattcagtaaatgtgttttgaggatgtgctgagaccatcctcaccgtccagacgaggccttccctgaccaccttatttaatattgcagccctcttatttaataccctgcaacgccctcccctgcatgctttatttgtctctgtcaaaacggtctttttaatcgataaggcttacttatttgcctatttcatgcccactctagaatataactccgtgaagactgttttacccccactttagtcattgcggtatccccagctccttgaatttgtcagactcgcgtcataaatatgattaagtgaatgaatgagacatccctgtcttcaggatgtcacacttccaccatgcacttgatggggcttccgtgaatcgctgtttctgaggttccgcggtcagagaagggaaaggccagagcaagcagccagtccgcattacacgcatgttctgtgtgcagcactgtttctggtcatggattgctggttgggaagggaatttgagccagtatgaaagacagggaagatgagcctaaaagctgattggaggaaaagaagaccggaagagatgaactttaggtgtgctgaatttgaggtggtgccagagtgtgctgtgggattagagtttaatggtcaaaatgagggcagttattttcaaatacttgagaatgggtgacctctccacaggattcccacagcgtgtgagaatgaagggtggaaatggaaggtcctttgcggaacaggctccagggggtggcatttcaagagcaggttgggggatgaggctgtgtcccctgtgcaaagtcacccatgcacatgactgccgtcggcgccagggtctttgctggtacttccgtgcctctcacacatgcatggttgtagaggagctgtgctctggggccgcgtttcccaccttcccagctcccttccttgttagagccgcctttttctccccagttttttgtttcgtttcaatgccattgccaactaggtgaaatggtatagcctgttgtcttttgactttgatatccgccctccccccacacacacacacacaaaaatttcacttaaacattgctcacagggatgcagcatagttcagaatgccaaatgcccaatccccttggcttaatgagtcacttgtttctaactaactccaggcctttatttattgctctattataggccttataccacattggttttggttttatgttgtgtccatgtctgtctcttctaattggccatgagcagcagaaggacataaatgacctatttttcagctctctcaccttcaaacctaccactgtgcctgacataaagcagatattcagtaactgagaatgagaaggaaagaaaaggactcagggtaaacctcagttttgtttaagattctgcaaaggggaagaactggctttcaccacccaggcttctgaagtgtgtagagagggttgtgaatccgcactgaccgtgttctcttgcataaataagtccaggcaaagtatcttcagtggtgaaaacagaagttacctgccttgagaagcacagtcaccacaacctagtctgcagggaatcagatgtcgtgtgtctttcgtttgccccccttgatgtgggtccctttaatcatttgttgttggactgtggaggcagtgggggacattgtgttaaaaatcattcttcatcttgggaagcgcaggcccctgttgagtttccccctatatttgtcttcatcttatcattttacaaggattctctttgtagttaactgacggtgaaaccagtctcctgtcaatcatccaaagagccactttcaattagttgcccatagccaacaggtggcttcagcagcatccagccattggcaggtaagtcagactggaaggataccctagacctgctgtagaagcaggggctcctggaggaatttcctgtctgtaaagttaggggcagtcacactgagctcagccgcaggagagaggattcattggtgtcgtccctaaagcgctttgggaatgggaagccctcaataaatcttccttgtggtgattgtttccctgttgccatttctaaaagttcatctagaacacctacctctccctgtgcaaacgcctcctgcttggccctgaagtccactgaactatttctgataaatcacagaaggaaatgagttgcctgggtgagggctgtcttaagctgctgccttgctcccttcccagggagggttattgtctgttcagccatcaggtaccccctagatgtctccaaatttacttctttgtgggggttctccagctttgtgccttttactagcagtcacattgaaataaggtaataaggtttcccttttccaaatgcctgtgttctgtgatcttttctgcaggaatagttctctacgaattttggatgcattttaccctggcaagcatttgagacccccaaccgaacacagttcagcaatacctttggtaatccagcataatgtccccaagaacacaaatgtgttatttcttagttgtttgtgaataacaatgatgtcctgtacattcttaagaaactatttttttaattttgtcaaagtgcaggattgatcataaggtaatacgtgtgtatgtacatataggaaacctgaaccttttcttcagaggagctcaagctatttaatgacaatttgaccatttagagaagggctttgactttgtaatgtttagggtatttgctctggtcaattttccatgtggattcactagctgatgtgtggccatctcagagatggtttggggcctcattccataatttatgtggcagtgactcaaaaggtttagtacacatgataaatggtaacaataccttccacctaaataggggagtgtcattattttcacatatttttggtggcgtaactgataaccaaaacattttgttaaatttacccaaagttttcagcagccctggatgccactacagttaagacatagctgtgtcagaaaggtggcaaactctgccctgccgaaaggcagtcatggaagacagacgcgtttttcatgatgactgtgaagcagtgcattttaaaagggagttgcaattcccagagctctgggttggatgaccactgactcctcttcctaaatcgaaaggatgcgctaagttgagcatggacagggcgcctcctgagggtagggcctgagtttctgatgtgttctccagcatgcagtgtgggaaggagctgatgctgagaccttagttgccccactgccagtctgttgggaagagatttctcttcttaaataatggcaacaccaaaatgaacaatgtagagattgttaatattaatgaatttcatgtctgtcctgttacccgccggaggcaccaggcccatcgccaggttctttctgcttttgccttaagcagctgagtcttggacagtttcctgtaataaccaaacaaagcctgtttcttcgtgtgctattacttaagtacaagtgatatttaaaaatgattcctgagccctttgaaagagtggcttgttagctacagaaatgatgggactgaagttaggacattaagaagagcattggcatacctggcaagagatggggctctcgcagcaccccaattaaccggccactcagcggcctgtcggagcctccaggctactctccatagtgtcagtgacaccttgtcagctctccagcctgcagcctgtgtcacctgtgagccagagggactgaattggacacaggcaaggaatcacaacaagatttcaggcagctggttatattatctaaattagcttttccatgaatctctgggtccagaccatagccataggattatagaaattaagagccagatgggaactatcctcttgctttgttttacaagtgaggaaactgaggcgcagagtggtcacatcattagcctcagatcctagagttaagtggttgctgagccaggatgagaactcaggcctcctggcccactgttcactgacctgctgttgagggcctcaagcactgatggggctttcctggccccatattcttgtgtttccaaaacaaacctcccatgcaatgatgtttagataaatctcaactctaatcagtaaaaaacaagcaaaggacaagtatatttgcatctatagctatttaggtaaactgaagttaaataaaaattcaattccttagttgcattagccacatgtatctagtggccaccatattggactgtgcaaatacagaacatttccttcatggcaccgggttgggtagcactgacgtggattatcccaaggatcaaaaaaaaaaaaaaaaaaagagtattggagtaataagattattaataactaccaggcagattttctatctttacgcacaatttttctaagacaaggcttttttgtgtgtgcttttttatttagtttgcattctgaagatgacattttatgtcttttagcattcgtataataatttatagccatttggcaattcttatagccattttgtaagtttgttcttctttttatataaatgaaggaaatacaacacagaaagttgcccacagaacaagataaaagaatagaaatttccattcttttgtttgcattctcccaaaggaagcctgcaaatcactgggccttataaaagcttgttgtcctaaaactagtaaaaataatatgttgaatcaattattataatagtttactgattagagggacctcagaagattttgcatatactctgttgatctagttatttttcctctaaaatagggaagtaggtcagtgcctgggttaaaactaaaaagtaagcactcatcgtttttccgaacaagatttcattttcatcttgtctctgacactgagaatactattgcccactggcgtagtgcttgcagacttgcggtcttattccatatggcatctgtcttagaggagccttctagctggctccttgccaagggtactagcagaattggcactcaggatctcattgcagtttgcaggcaaggtgccagcagagatgtgtgcgcatgtgtctggggcctgcgagtggtcaccgagttgggaaatgtccacctggagaaacccaactcatggaacgtgaagcagaggcagttgaccttcacctctcactgcattcacattctctaggcaccttttgtgtgacattggaaaagtcaatgtatctctgactctcattgggttcatctccaaaacagataatgattccagcgggagctgttgaagagtattgtatatcaagtacttggcaaaggtttctggcaaagagtagctcctcaataaatattatttgaatttggatgtaaattcttggactgtaagaggcactgtactgggtgttgagaatggctagggagtgaagagaagcaagctagtctgattttctaagccctagatgaggttgttgtaaataggagatcttctcaggggtcttgctgagatttggggtgtctattcctgtaattacttctctttgaagagcacattggctgtccttagtttctagcaggtacctccaaaggtttaactgttgaacacataatttctggcttgcttagaagtgtcagtgctacagccccatgaggatgaaagaattcagtgagtctccgctaaaaatgagcatcagccagggagagagttgggagtccagagcaggattcatttgggtggatgagaagggagtaaaccaagctgcggcagtactgtggggattcagggcatgtgattcggcagtgccaggagagtggtcggtgggacaggaccacccataccacccatttcagcagtgccaggagagaggttggtgggaccggaccacctattgaggcagcgccaggagagtggtcgatgggacaggaccacccattttggcagcgccaggagagtggtcaatgggacaggaccacccatttcggcagcgccaggagagaggttggtgggacaggaccacctattttgcttttgatcaggaaggtggggggtggtgatatttcaacttgtacagcaagtggacatcattggatttacttaaggaagggattgtcctgcccttagaacttgatgcaaatctttggaaaagttacttccaaaagggcaggtagtttggcaaggatgtagatagaaatgagaggtgctcatgggtggctctgtaggaatagagaagaagggaatctgtggagatggagacacactatgtgactgagtaaatgtaggtttcaaagtagcctaaactggggtggggggggtgaaaaaaatgtaaagtacctatcacaatatttgctatataagtgatgaccaaaatacacatattattatttaggataggaattgtggttgagtctatactataaaaattttgaattgaaaagtagatttttgatggtcactcatttcagatgcttcacagatgcaaagaaggaattaacagtaggaatagccgacactgagagagcccttattttgtgccatgtcttgtattaagcacatgagtctaagagatggagtccgctatacccattttacagataagagtctgaagcccagagtagcacatttaggaagaggtgctgccagaactcagagcccctgtaccacactgcctctagatgagaggtctccaggcagcggtgaagcatggctcatgggatgaaatactaatgtacaccagccacatacaggccagaggcatgaggcattggccggctcctctacttcccttacttgatgcatcttggtgagtttatatttttcgaaaaagagtaaatggcctcttatttgcagaagcattgaagactgcttgctctagaattctgacactagaactagtacaatgccactcccttctccattgtgttacattatgtgctccgcagatgaggtgcggcagccccattttttgaacttctgttttctgttagccgagacctgtggcaataccttcctcttttcaatctagctggttgtcaacagcagtaaccacaagtctttcctgtcccagaaataagtcttgccacactctcaacccccgacagggtgtgaacatgacatgctgtactgcaaggggctccactgcctccaccccgctacagccacagacccacagggttcaagtgttgattgaattctcaaagagcgacttaaaaaggataggtgcataagaacaagataaacaatctggctctaatataaacaaggattacattacaccaaaattgttgagagaagattttgtactcagtattttattcagcagaacattttttataacaataaggttgattagagcaagctctgaaaatgcttcaagttagacagtctgattgtttatttcaaggataaaaaaataaagtggtaaaatagggggatacgaagaagtagaaattgaaaccaggacctagcgaagagtatttgacatcattttcctctctaggttgaatctcattcaggatttttccttaccccgtagggttttggctttttaaccatgagtatcttgtttttaggggcttagggccatcctagacccacagcagatttaaagtgctctgatggtgtatttgtctggtgtttcattttaaccaagtaagtagctctctgtaagatctttgtctaccttcttggtagtaccaggaagctacagggagatcacatctggcccttgcagtttagtattagttagcatgtcccctttctgacctctctgctttttggggtgggtctgctcatggaggaggctctgtaggggcagcttctgcctgctttgtttcggcgccttctattttcacaggctgagaagctggagcaagcgcgcagtgctgcaaatgagctgccgagaggcattcagccttgtcacttggcagagtagctgggttcagggtatatttggagcgggggtagggggcacaaaaagggtacatggttttgctttactgtttattcctgctcaaaggagggtgggggcaagtgaaaaagacatgtcttcatcatcgtattacttgatggtgactagaagtgcgggctgtacacagcattctcttccaaatggggattttggaaacagcgttgaggaggactgatatgcaaaagcttatggttgtgctctctgtcagccccaaatatttactgaagctgggagaagaaaaggcagactttctttttttctctcccaaacgtgtgattgtttagaactcaagtgcaacatctggaagtcagatatacagagaacaatttatggagtgtgagagatttgaaatattcagtgtcttttagtgggaactcaactttctggggctgcttttttttttttttttaacccagcacaaagcaggcaattctgagatctcctttgcctctctgaattaaaccctttgtgcctgggtcccataaacaatgtgctttttaaaggggagccccctcccagctccggcctttttctccagcgtgggcagccaatcagctgcgcagagctgcatagctggaccgctttccattctgagtagcaacaacgtactaatttgatgcacacatggatgcctcgcgcactctgcaaattcatcacccgcatcttgcattagtcatctgacggactgccaagtgtttcattttctttccatgtgactttattattaccacctctctcctctcttccaaaaacctcccaaaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggtacagagcgcggggcgggggtcgccaggcgtccaggtgggcgtcgcggggcactggggctgtccgagcccccagcctgcaggaggaagggcgggtaggcaggagggctggaagcagccggtgctggcggcccctgtgctccaggggctgctcccgactcctccccgcacccccgcccgcctgcccgccgggacaggttggaggcgggagagagggaccgaggcagggcgggagcgcagaggctcggtccaggcgcgtgatcgctcccgggaggtcactttctaggcagcccagcctgtgcttgggcggggtggttgcttctccgaggaatcgcgtttcccagccttgtatttcaggacctaactcttcccacccctacgttcctaggcttgcccatgtaattacaattgcatttcacttttccatagcctgtggggacctctaggtagcttataaacagttgacgtgatgccactggtgcgagggagaaaaggctcccctgaagaagggacacccattcctgggggtcaggtggggaccgtgaggtgaatctgccttttggagctgggagcagcaccctagtggcctgacatagttaggacaccttcacaaatgcttgagggttacgcccttatcagtgtggagatgaaggtataggatctggtagttgttactgcctccattttaagatgacggtgatggggggcagtgggtgccattaatgagatagagacccagaaaccattgtgaggagtgtgatgcttctatgccctggagtcttactttgtaagctctttgcagactgaatttaaaatatctactctgctgctaccacttggtctctgttgctgttttaacgtttttgctttagtaattttttcttctttctctgttgttgatctctcagtctctctactgaggagtcctctctgttgttctgcgggcctcacagtttcttttgctctgtgccttggtgtttctgtctggcatgttattttatttctatattgcttctcctaagacctctgaaagcatcacttggcttgtgtatacacttcggttgggcacacgaacatattggcacatacttttctctaacccttttccttactggcaaggtgaaatgatagaactaggaaatctttaagactgacattctgtgactccgagaaattttgggctgttcctcttgttccctgttgttgccagggtctggcagggctttggaagcctcttaaggaactgaagagcccctggccagtactcgttttagaaaggtggacatgcgtgtcttcggagtgtgttcataacactctagttttccaaacgtagtagcaaggttgtttcaaaaagcacatagaatgttgtcaccacaaacttgattgcctcattatttgagacgtagaaagatcagataactgagaatctgtagatttttaaacttcacaaatgagcgcaatattaaatacctttattggacatattctgatactggttacctacatgttttccaaatggagaagactagagtttgttttaatacttccatggtatgctattgaggaaagacaataggctagagctaaaaaaattaataaatttaaaaatcaccaaataagggctctctcaccagccagactgtcacctagggaaaactagaccagaggcagtaaactatgctttagagaaataaccacaattcatccttgacaaggaaaatgcgactccaaattttggtttatcagcatttttaaaagttacctttgacataatggtcagagctcacttactgttatgatgcctggttccgggactttcagccatggaatacatgtatcttaccttggccaaaaagtcctttttcccagtcaggtaagtacctatgtgtggcctagttattctcccattgtctctctcttgcccagatgttcctatgagcagcattttttaccagcctatatttgatactatacattttgttaacttctgttcactgtgcctgattactaatttggcgaaaatagtttgcagaagcccgtggggctgcagaagaagggaggcctgatgagggaagtttttttgagcacgtgctatgtatctcagaccctgtgtcaggagctttacatgtgtcctcattttgtccttaccaaaatccagaaggtaggtggtggtagtcacattttacagatgaggaaactgaggcttataagaagttaagaaacatagccccgtttgcccagctgttaagtgacagagtggagattcggacatggtccatctgtcttcatggactacaccattttgcgtcttcatgagatgagatggcagagtagccctggtgtgctgtgtttcagggcctgggtcaggggcagtctcctttacttaagtgttccccaagtgaaaggaagaaatttcattcttgaagaatgagttgatttcatttctgtctttgtgtttagtttttatactcaggtgtttagattgtacatcattcccaccccatgatatcatggggtaggagttagagatgaaatcattcaaatcttacctttggaaatacaggtcaattcccattactgtgaactccaagtctcacatcaaatattccttaaagtatgtgggctgtcagccaaagcttgaaagagcttttgttatacagacatctctgttgtgaaggtatttgttgtgatgggatttgagctgtataatgacattgctctcagaggattacagcccttagccgcttacctagagagagcaacagcccccactttattcatgttgatacctatgcatgccattattattttgcctgtttacatgtaaaataagacctcacatttactttgattcagactttgtcggcagagtacaattatcatgttttcacagggctgatatcagagcctcagaaactagaattactggaggtggtttgggttatgtgagtgaggcttttggagaggccttgattcattgccttacccgtgttgatggtcccaggcaaagagacagtcaggctgttacctaataatcctggtgaattagattttccccctcactttccatttcatcttctgtttagtcgtgagacacaaagacttggtcatacttgtgaaatcatcctttcagggttcgagcctgagatacctatattctcactgtaggggcatgtattgaccaagcaggctgagtaactctggggactctggctcagtaaactctctcccacatgaggactttggaaaagtgtgttttattcagggttcatctgtttggtctgtagatggtgagcaataccacagagagttaagaacatggcttctgaaattggagaaccctaaatttaatttctggctctactgcttctttgctacgggccttgggcatgttacttaatcacatcttaaagtggaggcagtccttgtagtgttgctgtgtgatgaggtgatgtgctctccacagagctaggatacagtaggagctggttatggcagtcatgatgatcatagttgttgttattatctccatcaatgtctccaagaacgtaaactctaaaagggacaagaaggcaggtccacaggtaactctcatacaaaagaacatgagctaagagtaaatgagtaagaaagagatgggcttactggaaccatggaagttgagcgaggaaatgaataagtcgcagcttatgggagatgaaaaagatggcatctttaccaaatcttgaaaacagtcttaggatttcagtaaataatgatggtgaacattacaaatggatggactggcctgcttcaggcatgcaggtgcggaagtgcagggcaatttctgggaactgtgaattctcccacagttcagaggaaatgggaaatacgtgacatgaagtagagaagggaaggccacaaagcctagagctataggctagagcagctcttagcaagccttccttcccaggctgaaggatttaaaattcctttgttagactctcgagactctaggaatattttagcaacaagaggctcagaggctgatgcagtgtgttgacgtgtgttgaggtcaggatgtcgtctgtcatgggaatggaaggggaggctgagggacagacggacagtggaaggaagaggacttgataactaaattgggctcagtgaagaccaggaggctttggcttaactgggaggattgtgagcacagtcagcagtggtgggaatggaggagaagagcattaagttcagttttgattgagttgagtctgcagtgtcacagaagagtcaagaaggatgcaggccaagaaaaaccatgggatttggtgactgggaggacccaagagtatttcagaagaaggatagaggttgtggggaaaggaaatgcatggatgtatacatggtgctgagtgtagatgtgcctttctagtagtctggcatgaagggagaggaagcttagacatgcagtttgtttgttcagcaaatgataagttgtacagcaaaggagattgtcaaagtgtaaggtagagatgactctgcctcaggtctgtgaaagagtggaaagatacttcatttgagacagaggggcattcaggaaggagtaacaacacaaagtttcagaaataggagacacttcgtacaagcgcctgccctcagacttctcagtaaataggaaatttctgaagtcccaatgaattgaagacttaaaaggaatggaaaaggtttgaaatgactgctttgggaaattgaatggaaagagtggtaaaactgttgaagagcagggagaggccggtcacacttagatcatgtccatctggagtgggccctgatggttgtggactgtttatccctgagtgaggaaagatacagagtcatagagaacccagagttggagatgttcaagaaggcatcgtagaaggccaggaagggtagcagatatgctaggaagttctctcggaggtctgaagtaaggaagccggcaatgctgaaagacagctcctggtccaggaggtggaggaggaggagttgaagggttggcagttgatgttcaatgggagaagttggcagatatggaaagtgtgttcaagcgagaccatacttggaacctagaatcagtagataaattatgtgctttggatcatcgctctcgtaatgtgttagttaatcaaagttacaatcccaaatcatagcactctgagaaagcgtgttctataatgaacactttacatttttctaaacttaaatggttaggtactgtcattctgattttatggaagtgaaaaccgagtgatagattaaaatcacttggcatttgagattagaaggtaggaacagcacctcagtcctaaccaaatgtcttgttgatcacattttactggtctcttttggcaacttctcagctcaaagagaaatagaaaagggaagtggcttttgttgactatcactacgtaccaaaggaaaaaacttccttttttcttgcagtatgttgggaggtcatggcataactgctgtgcaactgcatcgcaacagtactgcaagccagagctttctggatggatcagaaattgtattcatggcttctttgggaagagttattaccttaagtttcacaagagcagcttttgtgtgggttagatgctcttgctgtttcagcctcgtcttggtcaggctgcagtgagggttacactggggctggcccgactgatcttcgaataggatgatgagttgtttctttccatcttaaaggctttacttcagccttcaggaagtcgttagtaaaatcttagtttgtctcaatctctctctagttcagtacaatggaaaagtttcttgagaatcagaccagactgctggggaatgaacaggaagaaggaaacaggaacagaagcataaagacaccaaagactaactttacttatttcagaattggcccgaaggtagccctaaatccagaagtttcttctgtgccatggtagagtgagggtaggccctggggaagaggacttagtactggtacttatcatgaccagctcatgcagagaatgagccttgctttctttatccatgcagtagaaataatacccacttcacaagttgctttacatattcactaaggtaacaaatgtgtgagtgctgctggcatggtctaaagcgggttgatcatcttacaaaccatttgtttcttctttaaaatgttaaaggtttgtaaggaatgcctttggccgctttatggaggactggagtggggagggtcattttcatgtttcatgcctttcctttcttcctaaaaacatgtccgaaagttcacttaagtaatagaagtggacctgggagcccgtttatttaagcaatgttatcttgaaatcaggaattgagaaagaattcaaactgcaggaagatgaacctacactacattttaacgcatgcaagtagggaatgggatttctgtcctacatttcttgaaaagcagggttgctgccctagattttctgggacagccccagttttggtgctgcctcagtggcccacaggaagggcatctcatcctgaattaatgttatgttaacagaaggctctgtgttacttactgtgacatcctttcattgttggctgaccgacgacctatgggacaaacataaaatgcagtcagaatttttagattcatgcaagcggaggatccttgtcacatctttgtgaaaggtggcttcactgcctacatcatacagctatattaaaagatataacaattcattttatgaaatgcaattttaaaatatttttactgatactgactctagccattgtgctgattgagataaagccagggacaaaggttaaataagcctcctttaagttacaggaagaaggaatccctttaaatgccccatactctggtgatgccgagactgtgcccgtcggtcacagtgctgaatttctgtgacttctatcaaagggcagcgtctgccctggcagataatacctatcatgggtacgttttgatccttatatctctggagagaaaaggaggaagaaggggaaggagggagacaaaaaagaccgacagagcgagctaatatcaaagaagaaaagaaattactcctggccgcttttaaccattttgttttcttctcttctgtctggggcattaagacttcagctagtccccagtcgtcttttccccagtagctttgcttttctggaattaaagtagcagaagaataaagaaaacaggcgctggatgaaaggagaacagacttctttggtagaaatgtgacatgaaaagaaaacccagggtttctaggcttctgtttcaatccctccagcacgtattgcaggtagattgaaaaagtgaagtctaggtgatctcacaatttgcatttgccactgagtgcatgtctaggctgcctgtctaggctgcctgtctagaagcctcacttgcctttttatttgcagccagcaagaaagagatagctccccactagagatgtcttaccatcagtcacccagttgtaccactctgggctaccataccgtgggggcattaggcaaccagtcctttggaggggacaagtccagtttcctggccagaaggagaggtgttgtcaacagggtgacgctgttagttactctgaaactcacacacattgcctcagagctgccttagcgtgacctacctgcctttccttgctttcgctccagagaccccagataatcaggcattcgggttgaaaggtttacttgctgcctccttcacactctgcttctaatgaaagtttaaaattaaccatagttaagttgtattttagaagtgttcagaattctagcattaattaaaaaatcatgacataccttttgaagaagtttattatcttgaataattccaaccatggtgaaacgtgaaacaccactagcataattagtactgctttttgtatcttatgttagtagattcttaaaagactgaattttcatccttggacatacagccccagattctaacctcatcataatttcactgattctgaggccatccattctcctgcttcattatctaatattgggtgggccaaaccttttacgagaacagctcacaggcatgccagagcgtacagccatgaataagtacagaataatcattatgatcttcgaaaccattggaacctaagaagggctggaaagataattgaccaaaagggaaaaagtggaaactaggctaaaataagatgatttagcgacagattgacataggtttatatattctgaaaatagaaatgatgacgataatgtgttgggttctgagacagtcgggagaattgaagatgttccgacccatactgagaaattccgtggggaatcagtcagacatgaggttatctgagtgatgtatattaggtataatactaaggaaatttgtagtgaactagagctcttacctatgttaaagaatcaaggtcttcaaatatgtcttcaaatgtttctacatttgccttgatgagtctttgttacagagaaaggaatgcaggaaaaaaaggcatgtgtgagctggtggattatgctgtacaggaatttgtcaaagcctgaatcacatagacaaacacacacacacaaatggcaagcagagaagaaagttttgctgtaaatggaaaaaggggctagttagctacactggggaatgctgtaatggtaaagccaatgggtcagacagtggagatggccttggaaacactgcaggaattggtattttggatcagtattcttttcattctctatgtaagtgacagacatgtttctaatccagtatccacattcaggtattaattcacattggagaaacccataagatacactctggacagtgatcagtttgaagaataaaggaatataatttctctatttctactggaagatcataaataggaattagggagaagaattaaagggctgagagaatatttactcaccacactatttaactgacccaccatctgatcattataaaatatgttgggctttattgcttatgtaggacaaattctgcagctttacccgcatgtgggtcaaaacctgtctctttatagtagtcttccagctttgtctgcatttactaagttcatgaattgctgctattttgttgcctttttagcttttggggaaaaaatccttcccaaactactatagtttaatgggaactgcatcctagtcaagtaaagaaataacgcaaacatcagggagggggaggagcagaggaaacaaggccttactcagaattgctatcaattttaatacctccctactaaacattctgtgtaggggatgccttagtaatctgaattttttagaaaggggtgttttttagagagggatatttatgaaagctagtattaacatgtttaaagtctgcccccccgccccaaatgctaaacgttcccagtgatgcaccagacaccaagtgttacggaacaggtaatccaccacttttcacagaaagctttttagctcctaactaggccactgtacctgatattgggaaacgtttttgaaggatatcaaggagatggaggagttccaagggagagcagcatgaatcgcaaaggtccgggaaggtgagcccacatggaaaggtctaggaggttaacttaaaagacctcagagcattgagtcatgagattgaaaagggggaaaggctgtagcaagacattaaaaggagggattgtgttctcaaaaaaaagagagaatatgattgaagttttgaagacgctaaagtgcagagtgaagctatatatagataagttctttcaattaatgctaaaccctgggatactgctgctgatgtttaaaatgttggaacagcaggcaacatgtagagtttgagccaaacttttacagagacgaggtggtgaacttagagcatgttacaaaagttaaggagatggtggggcagctcacccagcagtccccaggagggggcctccggtcagctctcacataggcttaatgcagagcccttttgtaacaatgagttgaggttagggtacccttcaaagccctgggaccgttttaatgttgaactgaatatagaacagaaacgatgaaaaatgtggtgccggcagctgacacagtgtttaccaaagcaccagtcatgtggcagtagatgcttctgggtgcctactgtgtgcaaggcatcattctcagtgctgagaacataaagatgagcaagccatgttctttgccccagaaggagagaaagaattgtctgtagtaaagagaggagagccacaattacctcgaaatgtaaaaccagtttcgggttagccatgtccgttgcacacatgcatgcatgtgtgttcttgtgcgcgtgtgttttctgtttagcagagaatgcgctagagagcgtgatcatcctgtgctattcatataataaagatgaagtgagagaacattagaggaaccaaggccatgtgatggtacacgtctgacgttttttcctttcggttacatgcccgtatctcctctttcccctttttcccctttgtcttcatttggttcccctccctatagggagtttaggacaagaagaggctaaagtttcactgatgagcctttctgagggttctccattaaatccaaggacagaaaatgtacagtcctcttattagcataacgaagccatcagcattgcatcaagcgggtcctcgtacccttttccttgtaatggtgtttggtgtagggtcctgaggaagagctgccagcccctacctgatggatcaaaatccccttggcaccaaagagtgactgatagtgttaaccatcacaggagacatgtatgtatgtgtgtggaactctgacgtgtattttaaactttgcaatagcccaaagttaatttgtttctttgccatttgttttcgaatgggtgtggcattgcttataaaatgttgaatgtaagttgcctaggacagcgcctggcatatggtggaaactgaataaaggctgctaggtagtgtagactagatggactagaaaacagtacagatgcagatgctttcagatgttctctctgccacagagagacctttctgtgtgctttgttcaaagttgacagtgtgagtaaactaccatcaacaaggcgttacttttgggtaattttttcaatgtttatcccagttccttcatccgcttttacatagcctcttgtactgcaagctacactcagttttgaagatggtgggttagcgttagagtggtgttctgtggccagtggaggaggaagcttgctcactttaatgcagaatgtctaagcatcctgcgctaaccattggcaggaaggttatttcagtgagacgctggttccttctcacccctgcacccttcctggaatcaccactggttgcagaagcctatatagggtggctcatttggacgaagtattgttaaggtggttattagaagactcgcaacttagaaaaggaagtaaacatgttaatactagctttcataaatccccctctctaaaaaacacccctttctaaaaaattcacattactaaggcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaagagaaaattaggttattaaaaggaggatatgaaccaaaatgttggcatgaattaagaaaaatcagtgaagaaatgttgcttaatttgtacacttccctgcagtgctggaaatggacttttcctttgcatttccatgagtcagggagaaaacagaccagcctggtttcacgttccagacagcatgaagtacctcaacagcaaagaaggaaataggggccttagtttttaaatcctctgtaagatagtcaaggcttctccagtagaaagttaggttttgtaataagggaccattttgtcctttctgttcaggattcaacaattgcttgttgatttggggtgaagatgccatgaactcaggagcgggtgaggagggcctttctctgcctcccattcccaaagcattctccctaaccccatggtggaggctgcggagagtgttgtaggcagttgcagtgcccgtcactctctgggtgaagccagtatgtcctggtggtggccttagaagacagcccctgtgaggctcagtaagccgcagcctagattggaacagcgtgactgcctggtaggataaaggagacgacatctgaaaagagggtttcaggtgtttgcaaagaggtcagatccctacacatgaaacgctgcggccacagctgcagccatgctacctgccacatgccctggcctgcgtcagcgttatggagtaggcaacctggttcggcgcaaagaggaaatgcgcgttctgtgcccagtcctcgctcccctttgccaaccgggctgctgagtgtgatgctccctttgtgaagtggacatctgtctaatgggaactggacggtgaccaccagtccgttttacacaggccaccatacagctgccaggtggcgctggctcttagctgttctgcaagtccagcacagggtgtattcagctctagaggtggcaaacacggggcccttccaccaggcccactccctgcaaaggaagtgcttccgagagccaaggctttgctctaatctctgtgaaggaagaaaaagacttggggaaaggtaatgaataaattaaagacacacttttgtaatcgtatattttaggctttcctctctacctaattgtgctctaatctgtacttaggagtatagttttttaagtgggacatgtcaggcttttatgccacagattaaactccaaggcaaataaatgtgtgacagcttaagaggcgaaaagaagagtcttcgtcaaatggcagagtttgattgtttaacctagactaatcagtctttggagggcctgccacatgtcttccagacggctagaatgctcaggagataagagtggggcctatcgctctgtggctttctccccctgcattagccgcagagctgagtgagtctatgaaaacccattggtcgggctgccctagcaacacagaatgctgtgctgacacatactccatcacatgtttgcgatgaaaatgctgtatttttagaacacttcaaagtcaggaaaccgttaaaccacactgcatcctctcttgccctctggccacttcctccacacccccaggaacattgcccccatttcacagaaaaggagcctgagacaaagattaagtgatattttaagcaaagctgataatcccagggaaaattgctgatcaagtcttgaaatccaacacatccttcggagtaatttttaatgctttcgcttcttttacctaagccatgtgtgttccatatgaccttaaatctaagccctaatattgtaaatggagttcagaagacaacttagtctcccattttctttcctggcattcattcaaataaaaataggcacgtaatactgtactgttaaaaaaaaaaaatcaaagctccacgcacactttgaaaatcttttagaatttatgacgcttattttcttaagtatctttatgcaaataaagatcagaagtcctttgagtttacatcgcttgctgaaggactgtatcttgtgtgtctctgaaatttgcgtgcctagctcggtgcctgacatggaatagccattgaaaagtagctgcagattgaacgaatgaagtaaatgctacctctctctgatccaccactaacttacccatttttacagttactattctgtggagcagagacatgcttgtattcattcttaggacatgtgttgagaaccctacgtgccaggcagtgtgccgcatcccaggaatacaaagatgactactggggcatgatggaatggagtgaggaacatgagggtatgtgtgtgcgtgtgcctgtgttggggagagagcctgtgacagtcttcttttctttcccccctgaaggctctgtgatcctataaaggttaagaacaactgcattgtacaaacagggggaaggagggtcagagttgtccagctcgtatagagtgttgccaggtgcatgctgaaaatcaggtcttaaattagcaaagcttacgtggtgtcaggtaacagtcacactcagccctagttctcaaaatagtcctaaaccaaaaaatgttcactcggactcctagccccctagtcttctctgtcagcagccccaaatatataaggctgaggtgtttctaatgtgaggttctgttagcctgttggtgctcctcagtcactgggggccaaagaggaaaacataataaagagagtgaaagactttctaaattgtaaaactccatacccgtctgagccatgatgtctggttctgtgcgtttcctggtttcggtgaatctccatgtcttgcttagcttttttctaccctttggctaccagatcaaatgccactttcccagaaagcggcaacaagagtggaaggtggtgaacctaaaaggcagcatagggtggtggtcgagaacagggccttggagactgcgtgcctctccggatccctcctccaccaccgcttctgtgacctagactaagggttgacttccccacgcctctgcttcctcatctgcaggatgaacagggccgttgagcagattcagtgaggtcgtggaggcagagcagtgacaacagtgtctggactcggtaaaaccgacaccgtactcagtctcctcctgatgaggaaacccaagtccggaaacatgaagggggcccttccaggctgacgctatctcccagtgacagctctgggtatagcctgccatccgagcagatgagcctttcagtgacaggaagatcagttctcggtagtattgacaataagaataataactagtatttctctggagtactcgccatgcgctaggtcctgtactaagggctgactatacattatcttgttaaaatgtgtcctcacaataatcctgtgagattatactacttatggtgcccattttacagagaagaaaactgaaacttagcaaagtaacacatctaagtatgtggcagcatggaatgaatgaatgaatgagtttatttatttatttatttaaagaccaagtcttgctttgttgcccaggctggagtgcaatgacgcgatctcggctcactgcaagttctgcctcccaggttcaagcgattctcctgcctcagcttccctaataactgggactacaggtggctgccagtatgccctgctaatttttgtgtttttagtagaggtggggttttgccatgttggccaggctggtctcaaactcctgacctcaagtgatcagcccgccttggcctcccaaagtgctgggattacaggggtaagccaacattcctggcccagacatggaatttaaacctaaatattttgttggtagcatccccacttttaaccatgacattgtccttgttcggttccagggtttctgtagcgtggagctgggcacatctctctgcctgctgtgcttgtcaaactgacgttacctctctcatttcggaatgaatactcctctcgactgtcagttgtcattgatgtctctgtattcataccagttagcacagtgtgtggtaaccaataggtgcttaatgtttgttcaagtacactgaattattccttcaacattccttggatttcgtgctcccatgcctgagtcttgccatttcctctacctagaggtgtcatttcttcttcccagttctgatggtttctgttgtggcctttcagcatccagtgcatatgccattgcatccataatggctcttcctcctggacaccccagcagagtcatgtctcgctctgctgaaattcctgtgacgctgtatgcccctctcactgtgcacagtactttgtgccattctgcagttgcatacgcatttgtcatctctaactctaagtgtcttgccttggggctgttttagtccattggtatacattataggacctcatcgaacttagtacggtgccttaaaacagtgaagaacatttcctgatggagagaatgcaaagcattcaagataaagggacattattttcccaccagcctgtatcctgccttgttcttctttccttttcatggcacgttgacatggaacaccccgttgcattcctggttttgaatcagctgatgggcactccatggagcatgaaaaaatattgtttcagctgaagcaatggaagtaagagaatcattttagggtgtcactgtagtgtgaaaagctttgacatttaaaataaaataaggaaggagaaaaacagttcactctgtcattggagtctcttgccagcaagggctctgagccctctgagcagcgtgctcacctgaaaccccgccagacttacagatgtttcgtttggctccagtgtgaagaaccacactgcagttctcaggaacaattccattctggcaaggactgatgtaaccggggagcggggcagcaaacagaaatgacttcataggtcctatccctctctactttcctagatcccgtagtgcacactgcccttttcctttgagttttcatccatcactttattcacttagtgccaagacatacgacccttttatgaggctatgaaaactccacttagccaagtgcatgtttggaactctaagacaatgatatactttgcccctagttgtgatcctagagcttccctgaaggtcatgtgtaggtgaatggaactcttccagacttggattttcttcctttgaggacttggattataacatggaggaaaatttatttttggggatcagagaagaatttgagtcaaggataacaaagaggtatgaagagaaaatgagagtggaagttccaaaggctagtgtctctcacctctccctaccaccccatgttttaagctgccccttttaattagacattctgccagcatacagcttgtccaaaaccaaacacattatctgctctttggttggccctgttgtgttaatggaacagtcttccttcttgtcgcccaatctcagaagctcggcattattcctgactgctgcctttcctttccttcacatccaaatcctgtgaacttgagttttttaatgttcctaccgccatttgtgcattcctactgttgtcacccttggtgccacctagaatatcaaagggtcttttcaacagctcaatggagacataattgatatgcggcaaacttcacgtacttaaagtataaaatttgatacatcttaacatatgtatacacctgtgaaaccatcacaacaatcaaaataacaaacacatctctcacccctgaaagcttcctcatgcaccttggcagtcccttctgtcctggctgccccatgcctcaattactgacctactttctgttgtatgtggttaccatttcctagaatgttacataactgcagccatacagcatgtgctttcttggatctggcttcctttgctcagcctgattcatccccgtcactcattgattccttttgattgctgagtaacgtttcatagaatggaggtaccacagctcatcacctctcctcttgatgagcctttgggttgttgtcatttgctgaatattttaaacaaaaagctgctgggaacatccatgtacaagtatttgtaaagacaagtgcttttgtcgctcagctagacaccttaagagtggaatggctgtatcatatagtaggtttatatcgaacttcttaagaaaccgcctgtttgctaaagggattgtaccattttacattcctaccagcaatacctgagagtttcattccctccacattccctccaacacttggtgtaatcactattcctaattttaccccttctaatctgtgtgtagtggtatgtcattatggtcttaattttaatttgcctgatggctaacgatgctgagcatcttttgatatgtttgattcgtgtatatctatcttcaattcagatcttttgctcattttttacttgggttattgccttattgttgagttctgagagttctggatatgctctttgatcaaagtacttcactagatacacgttttgcaaatatttactgctagtttgtttcttgttatctcttaatattttttaaaaagcagtttctaattttggtgaagccttatttataaattccttcttttactgattgtgctttgggttttatatcaaagaaaacctaacccaaggtcataaaggttttttctatattttcttctagaagtgttacaggtttaggctttacattttagtctttgatctattttgagttaatttttatattcagcatgaattatttattgaagttcatctttttgcatgtggatattcaattgttccagcactatttgtcctttctccactgattgcttttgtatatgtgtcaaaaatcagttgtctgtatatgtgtcagtttatttaaagacagtctgacctgctccagtgatcttatttgtctgtctttgcatcagtattacattgcattagttactgcaactttatcacgagtcttgaagtcagatactgttagtcttccaacttcgttcctcattttcaaagttgttttggctagtctagattctttgtatctcctcgtaaattttaggatcatttgggcagtttttacaataaagtcctactacagtttctataggaaatgcattggatctgttcatcaattgggagaaatttgtcatcttagcaatattgagtcttcaaaaccatgaagtggtatatttctccacttctttaggtcttctttgatttctctcacaaatgttttgtggtttgccatgaacaggaccttgcatatccctagtcagatttatccctaggtgttttatattttccgtggtcttctaactaattttattctatttgctatttccaatcatttgtttctagcatatagaaatataattgatttttgtgtattgattatgtatcctacaaccttgctaaactcattctagtagcttttttaaagagtctgttggattttctacgtaaatggtcgtgtcatttgcacataaagacagttctacttcttttccaatctaagtcttgtcttttcttgcctgcttgcactggccaaaacgtccactatggaggtgaatagaaatagtgagagcagacattattatcatgttcttgatattagaggaagactttttctttacactgaaaagcatgatgtaatgtataggtttttcacaaatgccctttatcaaggacattgtcttgtcttcctgttttgctgagaattatcatcaggaatggatattagattttttttaatgtttttttctgagtctgttgagatgatcatatcgggttttttgtctgtttgtaaatatgacaaatcacattgtttttgtgtgttttttttaagacaggatcttgctctgttgcccatgctacagtgaactgacgcagtcacagctcactgcagcctcgaactcctgggctcaagtgatcctcttgtcttagcctcccaaagtgctggaattacaggtgcacgtcaccacacccagctatattgactgatttggatattgagccaaccttgaattgctgggataagtcttacttggtcatgatgatccccccgctgcacccactgcccccaagatggagtttcactcttgtcacccaggctagagttcaatggcacgatctcggctccccgcaacctccgcctcctggattcaagtgattctcctgcctcagcctctagagtagctgggattacagccacgcgccaacatgcttggctaattttgtatttttagtagagagggggtttctccatgttggtcaagctggtctcgaactcctgacctcaggtgatgcgcctgcctcagcctcccaaagtactgggattacaagcatgagccaccatgcctggctggtcataatgattttattggattccatttgctcaaattttgtttagaatttttacatctgtgttcgggaagaatatttttctgtagtttgtttataacttctttggctggttttggtataatggcaatcctgatctcatagaatgaattgggaagtgttctctcctcttcagtttcctggaaaattgtgtataaagttgtattatttctttagttgtttggtagaattcatcacataagtcacccagacttcaagttaactatgtaagaaggtttttaactacaaattgaatttctttagtacctataggaataattaggttctatatttttctttgagtgcatttttcctttcagataatatgtccatttaccctacgtggtcaagtttattgtcataaaactgtgtataatcccttaatatccttctaatgtcttcaaaatctacacataaagacagttctacttgtcatgtctcctgatactcctggtactgttaatttgtgcctgcattcttttttccctttgtcttaaagttcccaggtttatttgtctactaaagaactagcctttggttttgttgctttttttttttttttttctatttctttggctttcactttaattgttattgcttccattcttttgcttatttggggtctaacttgcttttatttttctgacttttaagatgaaagctgaggttactgatttgaaatctttttttctccaaatgaaagtatataatggtatataattcctcctaagtaccattttacctacatccacaaattctgatatgctgtagtttcattttcattcagttgaaaatacttcctaatttctcttttgatttcttctttgacctgtgggttattcagaatgtgtcatttagtttctaaatacagattgcgcatccctaatccaaaaatccaaactttgaaatgctctaaaacctgaaatttttttcagtactgacatgatgttcaaaggaaatgttcattggagcattttggatcaggaaagggatgctcaaccagtaagtataatgcaaatattcaaaaatctgaaagcaaaaatccaatacatttacgggcccaggcattttggataaaggatctcaacctgtatttgagaggggtatgggagttttttctgttactgatctctaattaaatgtccttttggtcaagaaatataccttgtatggcttaagaactcttaaattcattgagacttgtttgatgccccataatatgacttatcttggtaaacagtccatgtgcatctcaaaagaacaggtatcctgttgttcttggactgagtgttctacaaaagtgagtttgattgagttgtgttctgcaaatcttcagtatctttactgattttctggatattaatacttgttctatcagttattgagaaaggctattgaaatctcgtgtatttgtgtatttctcctttgagttctatttttgccttatgtattttgaagttctgtttttttgatgaatagatatttagaatttttgtgttctctttgtgaattgactccttggtggttttgaaatgacctttatttctgggattatcctttgatttgaaattattatgatattagtatagccacttcagctttctttgactcctgttaaataatatatatttttacattctctctcttcacgtgtatgtatctgtctatttaaagtgcatttattgtacacagcaggtagtcggatcataatttttttgaatccactcagacaagttctaccttttaattggagtgtttagataattaacatataatgtaattgttgataaagtttggtttaggtctctaatctcactaaggtcgccccccccccaacctgttcttcccttttgcctcttcttattacttcaaattactttttcattttaccttctttgttggcttactagttatagctcttttttgttgttttagagtatttgttacacgtctttatcattcaagtgatagtatgcaacttcatgtatagcatgagaatctacttccatttctcccttcgcagactttatgctgttgctgtttttacattttgcttttacatgttaaaatacatccacaataccttgttacaattttgtttaattggccaaatttcttttatagatatttccatcataagaaaactatctcgcctgtttatgctcgtagttaatacttccgtgctccgttcctttgtgtagatccatatttccttctggcatcattttccttctgcctgaaggacttcttttaatatttcttgggcagccaatcatctggtggtaaatcctttcaccttttgtgtgtctttcaccttttgtgttttgccccttttttgaagtatgtatctagatctagatatatatattttttgagactgagtttcgctcttgttgcccaggttggagtgcagtggtgcaatctcagctcaccgcaacctccgcctcctgggttcaagtgattctcctgcctcagcctcccaagtagctgggattacaggcatgtgccaccacacctggctaattttgtatttttagtagagatggggtttctccatgttagtcagggtggtatcgaactcccaacctcaggtgatctgcccacctcggcctcccaaagtggcgggattacaggcgtgagtcaccacgcccagactgaagtatatttttactggctatagatttctaggtggacaggattttccttttctttcagtatgttaaagacattgcttcactgtcttctcacttgtattgtttcagatgtcatccttctccttctgtttttttttcctcagtctgcttttaacattttctctttatgtgactgggtttgagtaatttgattatgatgtgccttggtttggttttctttgtatttcttgtacttggagttcattgagatttttggacatgtgagcttacagttttcatcaaatttggaaaactttcatccctttcttttgtcagatatttttaatgtctgctttctctcaactctccttgtagactcagattacttgtatatttggccatttgaagttgccttacagctcactaatgtgtttttttcttccttttttaaagtctctgtttctctattccattttgaaacacagttcactcatcttttcttcagtgtttaatctgccgttaatcccatccagtgttttcttcatctcagacattgtagtttttaatctctagaagtccgtttcggatctttcttagatcttccaggtctctgcttgtcttgtggaacataccaaatacagcgataaataacttttttgagtccttgtctgctaattctagcatctgtatgattattttctacttctaaagtgaggcctctcctagtcctctacccaagaccgtgaattgtgagtattttcggtctggctggtaaggacaggcactattccaagcctttcatctttttggagggctctttgtctggtagtttcttcactcatgtgcattgatcatcactggatactcaagagggacctctgcagatctctttgactcctgttaaataatatatatttttacattctctctcttcacatatatgtatctttctatttaaagtgcatttattgtacacagcaggtagttggatcttaattttttttgaatccactccgacaagctctaccttttaattggagtgtttagataattaacatataatgtaatcgttgataaaatttggtttaggtctctaatctcactgagggtttttttcccctcacctgttcttcccttttgcctcttcttactactctctctctgcagctcattcctctttgctactctttacggtgaattctaatggccctcgcactctcagctcagggagtatactgggtcctgcctggtgtccagctccctgtgctgtggcctggaaactctttcaggccatgagctgttttcaggcaagaggactgtccatctaggccagaggcagaagtctgcaactcttaattatatttcctgtccctggttcttttctcacagtgccttctatttatccagaggaattccagcaccagcgatggtatgcaaacctttagtggcacacgttgactcagatacagcccagattccttggccatgctttccaggtcttccataaaccattctgttctttctcctctcattcccttcattaccttcatttccattcctacagatttgttaactggaatttctgtacttccatctctttttgttgacagcttctctttgttcaggttctccatttcctgcacatttttaacacatttgcaagttgtaaattatcttctttctgcaaactcctgtaaagatttatgtgcacctctttgattcaagccttcactttctaccttgtgttaacttatttatgcacatgtcttatctcctccaaccacttataaatcccttgaggacaggattcacgtctcatttacatgctcttagaaatttacagtgcgtacacagtaggcaatccatacatgcccattcagtacacatttactggcagtcttgggaatgaacatcaaattaggtattgatgaaattttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttcttttaaaaaaaaaaaaattcacaaagtaggctgtaccctcaaagtgctaaggagagcttctgtcctcgaaaatctccctgaaatactgaaagcatacaaaaaaggagaaagctcaaaactaaattttgactctcagtggctgggttttgtatctcttttctttaaaaaaaaaaaaaaaaaaaaaaaaaaaagccattgaaatgattccacttctgagttacctggagcagtcaaattcagaaagacagaaaataggttggtggttggccaggggctggagcaggagggaacagggagtaagagtgtaagggggatggaggtttagtgtggggagatgtgagagttctggagatggacagtggttacagttgcacagcagcatcaatgtatttaatgctgctgaccttcatggacatcctggtcatgtgtacagaaaacttagaagtaaattagggtttaaatccagttccctgaggttgggcaagctgctggtcctctctgaatctgttttcttgtctgtaaatggggcctgatgtattgaaaggcacctggctcagtgcctgtaacaatggacactcatgttcatctagttctgtcccttttcagctttacagagaggcttcctacttagatggttctctctagctatggggcttggagagtaaatgggcaggagtgggagtgtgggaaggggccatgctctgttgatctcagccagttgaagctgatgcctctgtcctggtgtttataaggggctccatcacacatgtacccgtcctctattgtgtgggaggtaccccaggcaatgaaacggagaggtgtctcctggtgttgcagtggggaggagacctctggaccaggacgtgctgtggggcgtcagctaccaaccttgtggtctcgggaaagtgacctatcaagggggcatacaacagggacaccaccttgaaatctgaagtcactgagtagcaggggaggttggagcctggggcaccccatggcctgcccttgggtttcatttaactgtggcctccccaggatgttacacgtcctggcctcctccctgcagaagatgaggcttattcccagtcggcagactggacttcttcataagtgaaaaatagttacataatggttatctcattggtgtttagatttctgaacaaaacgatgatccaaaatctgagtgtggagaaacggatccccagtgaaggaggagggaggggccgtgtgcatgctcatgctgtttatcccaagcctgttttccaccctccctgccctcccatgcagaggccccgccctgtgtccactctacttcttaggaacctggcaaccccagggaattttcctgacaagtcagtgtcattttatgggttattgctgttttcccagaatagccaattagtattgaggaagtgtcacctgctcttctccatgttcagccccttcctgagcacactcatcaggtttaaggagccagctgtcccacctgctcagctgtgcacccctacaggctgggatcttgtgagattcatacctactgaggagggtgcttgcgttcagtcatggttgagatggggctcttccagcacagccccaaaatacttcaagaggcgcagaggaaactcggcctcccgagtgagcatccccttgatcccagcaaggctggagggaggcagtgctgtgggtagttagttggaggaaccaagggcatggcctcttttattctagtgacattcaagggcaccagctgttttgactcccaggaagctgtttttcccatgctgagtagtctcatggcactgtgtgccaccacagtgctgcccagccctgccaccctggactgaccgatagaggggagaccacagcgtcagctgctaacatggaaggacttgattgtgcaagagctgggtttcctgggaagtcaggcaccctgctccttcacctccccataacagctgtccccatggcagtctcatgacaataacaagccagccttgctattttggaaagcagtgagggacgtggagatccgatctggacagtattcatctcctgtgtgacctgggtgagttgcccaccctcacagagttcttttcaccgagttcacatgggactcaaatgggatgccatggttttaacccctggcgtgcgttagaatcacctagaggaattgaaacagagaaataccagtgtcccaaccccaccctcaggaatttggatttaattcccctgctgggtcccaggtggcacctgaaggtattgaggtgattctaacgtgcagccaaggttgagaaggaccaagctggacgttgcgagagtgctctggtaaatttcgtttggtgttactctcattacattctccactgactttggcagtgtctgtgaattttcacatttttcatgtaaagatcttcatgactttttttcttaacattgtttccaacaactactgcaggtcatttagcaagaattagtcatggtagttcacagccctgaacccaaacacccccagatcttcagcctcgcgtggggcttccagtgacttcgtggaatgtcatcatagtccttcctttggagagctggattttctcaggcaccatgaggatctgggccaagcttctccagggctgtcattgcttcctggttggaaaacccctaggtgccaaatgcaagaggagaaagagtgaaattaaccagctcacccatcaatagcagtctcaaaatcatagaactgggagcctgtaagaaatcacacatttctgtgaatgtgtagagaataactccaaagtttcaccgtgacaagtgcagaaattacatttaaatgagtacagaagaaaatttcgccacaaactgtgttagccaaagaaggttctgtacaatgagacgtaactgaattatgggtaagttctgtgttcctgctgatgccctccccactccgtctggggctggggctgtcttgagccagcattcctgttcattccacctgaggactccagtgtgtgggaaggaggaagagacttaaacccacctaggggccgggtgtacagcagaaggatagtacccattgaggggccaatataggtttcgtagtgagaacataataatgcaggtttaaccaaaagaatgtgatctttgaagactgtttgatcttatgcatggtttatggtattttgtaaatggaatagcttttccaagaaattcaaaaaagtgcccatatgacgcttcatgtttatagatttatgaagtattggttctcagtataacctgggaaagaggctggggaggtccggtcatcttcattttctgatgagacaactgagatttagtttaaatagtggtcacattgctaggaatttggtagttcaaggacaagacttacagtgttgaaactctcattttggtgcgtttcatgttttagaatttttcacagtatttttactttttaaaaattttttattttatatatatttttgtgacagagtctcactctgtcgccaggctggagtgtagtggcatgatctcagctcactgcaacctccacctcccaggttcaagcgattctcctgcctcagcctcctgagtagctgggactacaggcacacgccaccacacccagctaatttttgtatttttagtagagacggggtttcaccatcttggccaggatgatctcgatctcttgacctcgtgatccacctgcctcggcttcccaaagtgctgggattacaggtgtgagccaccacacccagcctatttttactttttaaattgagttttcattttgaaatgaaaaatgagaaaattcaaaatttttaaatgaaaacattggtctttgcccagtaacgaacatgtgtacacctttgcattcatacagtcccctagaaccagtaagtcctttccctgcaaagctgtcctgaacattcagggtccacacattgaccactgaagggtaggaggaaaggcaaagcgagctgcacaaagggaagatggcccgtagccttgaaatgcactcttgctagccctccccattttggttattatcagcaaagatcagtgacatgttaatatattcggctattttactgtgaatataatggtaaattttaatagaaattgagttagatagcagtttctgaatctgaaagaaagtgacattgcttgcgaatgctcacagtagcacttaacattgtgaagttcaactcaatttttatttgctgtttcacagaaagcaataatccctcatattttatagtaccatctgggttacaaaaatcccgatgcgtctttgttggacaagccaggatctcaggaaggagtggaggggagcttcatctcagtggcttctgccctgaatttgaatttttaacaggcagcttttaagcatcctgtggcactcatcccatctcagtgtagcagagacagtaatgtctttccctctatggttgagaaggagcttctgaatgcccttttggaagctgtagaaatctatgatactcatcgtcagcattcgaccatgaacttaaactcctatcacacctctaggtgtgataatatttctccttctgttacaacagagtaatgtcacacttggcacttttactgtcctcttgcgagactatcctccaagtgctgtctgagagtgttaactgctatttggctcatttttctgcaccaaggagaacagaaacacagcaggcaccaagaggaggtttagtgtgcagtgggttgttctgaaaggcagtgagtaaaatgaggtattccctgacttctgcttttgctacatgaagtcatgaggtccttgaagccagacttaggtaccgtttctttcatcccttgctagttcctaatcgtagacacaaaccttccacatccatccaggcggatggcagtgcttcttgtagaaagcaatgtcactaaggcagtgtcactaagggaaacaggacaaggcaacagttgtgttcagagttttgactggcgtctgattggaattagaaggaagattattttgccataacctaggtaccgtgacccaagctcttttggcagaccttgacgtcacaaaccgtacgcttgctggagaagggaaaaggagagttgcagccactaagagagtcaaggctgtggcctgcctggtggtgttttataggaactggctcagggaggctgcatgtcctttgttttctgaggccttgttccacgtggcctcccacttgaggccaggaatattgcagcaatgccgaagagtgggtggacaaatagccttattattaacctaagttggaaacatggctttttgagtgtcttcattcacagatgcagtcacaaaatattaatactctttttttgaacatggcaaaacaaagtattcatttaaacctcctttgtccacgtccatggtaaaagagcacctcaggcaggggagaaaaaaaaaaaaactggtcccttgagaattactttatcctttgcatttgcatatagtttgaattcataattaggctatttttattggctagcagctgtattatcatataaatccctgaatatgtaatttggagtcatttagaccagtcgtcccacagtaaccctgggaagcacgtgagcagcgtcagcgtctttctcgaggaagaaaatgaagatggggagtaacttgctgcaggcagcttagctcctgctgtggtggattgggtttttacgctaaagaacatagatacctgttcagtaataacttacattggcatagaattcatctattaacaggatgttttgaggccagacgtggtgactcacacctgtaatcccagcactttgggagaccaaggctggaggatcacttaagcccaggagttggcaagaccagcctgggcaatacagcgagacccccagctctgcaaaaaaaataacaaaattagccaggcatgattgttcatgccggtggtcccagctactcaggaggctgaggagggaggacagcatgggcccaggagtttgtggttatactgcactccagcctggcaacagagcaagaccctctctctttaaaaaaaacaaaacaaaacaaaacagaaccgggcgcagtggctcacacctgtaatcccagcactttgggaggccaaggcaggcagatcacgaggtcaggagttcaagaccagccagaccaacatggtgaaaccccgtctctacaaaaaaatacaaaaattagccaggcgtggtggcgcatgcgcttgtaatcccagccgctcatggggctgaggcaggagaatgacttgaacctgggaggcggaggttgcagtgagccgagatcgcaccactgcactccagcctgggcgacagagcgagactctgtctcaaaagaaaaagaaagaaagagagaaagaaagaaaggaaggaaggagaaagaaagaaagaaagaaagaaaagaaagaaagaaagaaagaaagaaagaaagaaaagaaagaaaggaaagaaagaaagaagaaagaaagaagggttcccattgttctcgcattcattgtctgcgttggttgagtctgtaggcagggtagggatgagcatcttcattttcttcattttacacggaaaagaaatctctggttgaacgtggtcagtgacttgcttcagctgggagacttgggactgaagctgccctctgtgactctgcactctgtccgtgataccagggaactggtgaatccaggagcctcccattgtgatgctcactccttctcctgtccattcatatgggtaaaaaaggttttgtggcttaagtagcatccagtttcatctcaagtttcagttcccataaaataaacagatactagggtagcaaatggtcccttattaaatgtcacaggggaaaaagagaacaaaaatcattttctgtactctccagaatacagttgagtgtcccgattgcctcatacctccagtgagaacagcagcagcatttatgggctatctcagtgagccacttttctgttaaacaatccaacacggaagtaacacaggctgtcctttgggctcccccgcctgatccgctgaacagaatctcagttctgtttgacttacacggtcggtggcagagggaggagggagaaactcttccatctttattcccaaatggggatctcattttgggtgcatgtatgcaaaatctgttctgtctcctcatgcttagtgtgctagtatatatttactgctgactgcatttctttatgaggactcttctgtagcgttttgatactgacaattttatgaaggctatttcttgatatttgtttattactcctttaaaaatgtatttttgtggcagcttcaaggcagttgcaagatagtgtatttttcaatagagaagttggattaaaacttacagcaactgtcacctggtaaccagaccccatataactgtgtcaacattaaccagtgatttattgctttaaattggaatcagctgatttgtggttccacggcttttaacgctgcaggattaatctggaacccactggtacacatgaaatagttgtattatctgctgttctaagactgatgaaatgtttaaaaggatagctgtgtaatcagtccattatctcctggtgttccagcttattctgttccgtgtggcagtgtacaatttcaaaaataattattctgctgtccttaatatgggagccgaatgcagtgactgataaaaactgcattcagcaagccctttcccaaattgggtagttctattttgttatcttctgaagggaaaacatgggttgtgatggtcagacctcctaggagtctggaagctttagagcaagccctgggaggcagaacacttaatctgttgccaacatctttttctgtttaatattttgaattttttgtttgtaggtaaacttgtttagactacactttcatgtactcatctgaacataggtagacctcttgaaaataaggatattgatgcttacagttttcttttgttctgaaagcagtcagaacatagccatagttacagaatgtgggttttaaaaagcaatctagaccagtgtccctttcttagcatcctactttgacagccagctattgaaggagacccagaagggcatggtcaagtggtttgcttcagacttgcattctgtacaaagctcatccaaaggaaaagcgttgtagatttttttgcatagactaggtagtctctagggataattattcttgtttacaaagatgttcgtggcaatctatagactgttagtgatgttttgaggaaaacccaagactcaacatcttgtatataaaggattgcccatgaaatcacagtctgtcttcaaactgtaagtagaacatgagctttccagttaatagggaaaacataaaacaatggattttattgcagggcagtcctggccttgtatagaccaagagtagttgactttccaggtaaccatggataccttaggaggaggggttggtaggacctgagaggaggatggcatacaattgtatgactgttctctagtggcgagagattgtcaaggaagaaatgaacagttttattagaacccaagaccatgatctctgggaccaacatctttaattggagacttgttagaagccattcagttaagaagacagtatgagatgcatcaccttgtttctgcgatgttatcttctactccccgattcggttgctggttatctcttaggcctgcttttcccccctcttgaacatggagctaataactttcaaacaaatcttgagccctctaggcagacactctgttgttccttgagcccgggccatccttgctattgctacctgaccacaagtgctggaagtagatgtcacacctgcgagcagagaaggcccgcaggttgggtatggtctgtgtagagcctgaatcagaagggtctgggctggaaaggaagatggtcagatgttgccctctgccaccaccccttcccccaagtgtgccttctcttgaaaaatgtggtaaattccatgaaattcatttctagtcacagttaagagcaggccctccagactccactcagcttgtctgttatgaggaaaaagccatcaatattttaaaagctgctgagaggcaagaagttagcctcgatggctggaaattaagaattttttttattctatgcaaaatctgtccattgcttctctaaagcagcagcagggctgagggaaagcttagcctagaacagggatgtgatgaagactaataagataaaaccagtcagagtgtttaagctagaggtaacctggaagtgtcctaattggatggcctgaatttctcacccgggagttttccagagcagttaacacccagatatgccccggcattgatgtcacaaaactgggtcgtggcagggtgctccagagagtagatttcagggcagatcttccagggacagattttgttgacacgccttctggatttctagttgtggttgagaatgtatgatgtgaaaattcacccaaactttccagagttcaacttaatgagaagagaagaggtttaggggagtgtattaactctttgggcccactagaggagttttacaaatagttttcaagaaccagttcgcccacatgattttcagtctgcctacgaatttgttaggggttgcattcatatttataggtaggtatctcacattcagcctcacctttgcctccattctgtctattaatttttctttgttcccgtaccaaaatgctaaaagcctaagagcatgttcctacagcaaagatatgaattcccaaccaagggagatgaagaagtgaattggttaaatgtactgaataccagttctctgtcttttcatagcacatccctttgatatttcttatactctgcagaatgtgggcatgtgcttattttcatgaatacctggaaagcattttaaatgatggcagtgctacctgggtaccaagaggacttaaatgccacttgctggctcatgacttacccaggaacatggtgcagggtctccctcttttccttgcccagtgggcacagatctctgcaagacatttccaggtcagacttctgtgcccctctgcataggcctgcctgtcatttgatgctgctggtaggttggagaagcagtccaaggggatggagataagcctcagctactgggtcagcgttttgaaacctgctagcaaaaggaagggagaaaagattgagaaaaagaagacggaaattaacttctgtgtcattgtgggctgagtcgcaccgtacaagttgttttccctctgagcaaatgaaatttgagaattgttcatcagtgaggatgaaatgtcagatattcttgtcgggaagtatattcctctctcaaacgggtcagttttaccaagtggtttgctcaaaaaggtgttctcatcaagaaagtgtaaatgtgggtttcagtgcttcaatggctttgtctacctgacttctctacagcagttcaccaacttctaattttctgaaacgaaattctaaaacatactcactttgatcctgctagtacatttttcttgtagctgtgttgggtagtcccctgaagtgtgaggcagagatagcactgacatgggcagaattgttactgtttcacctgtattttccttgtgtgtgttttttaatctgtaggtattaggataggtttaactgtcagtattttcgcagacccaaaaatatattaggacttttaaacacagaacccttatggatattggtgggtggctttcctccatgtggtgatgcagggatccaggcttctccatcttgtcactctaccatctctttggtttttgtgtgtgtgtgtgttttgttactttttttgtcacctgtgtccattcaaaaggagaggaaagaaagtatggaggactcatatctgctctgttaaaagctctggctcttaagcagcacaggtcacttccacttgtatttctttaggaagcctttagtcacgtggcaaggggcaaatgtggtttcaccatgagctctgttccagtgttggccctgaggaaggagaggatggacttcagcagacactggtagtccctgcaacagctgtcctttgctgtgttgtttcccaggcttcctggaggataagaatcccagggaacactgccctatagatgaccaggcctttcgcctggaaagcctgagctgaggggcatggcttggctccaagaatccatgtttttgccaatgttccaggcaattatcatcttcaggaacatttgggaaatgctattgtaagaggtgattagattgtagaaaggtatttggtaccttcgttgcagttttctgctgagaatcctgtgttgtaaggaatggtggtggactcggtggtgaaacgtaactcctggcacccatgcttaactctcttcagtcttaaaatttggcctcactgcatagacaagatcatgactgtaccatgtaacactaagacatctgttcctacctgaatttttcttggagtagcagattgtttcattgagttgaccaagtttacgactcattttgacagatggtgattctatggtttatatcaactacttggaatttatcatctaatgacagctgtttaacacataggtcagcgtataagattgactagtaatgaaatcttcggggcatttttttcacctcctgtcataatgttgaatctttgggaaacctaccaccttggaaatgaaaagcttataaatatattgggtgaacagcagttgaattatttatgtgacaaaaaattctttgtcatcccaaaaagaaaggatggaaaagttgtccccgatggtttcggaagctgcagtgagatggacacagtatgtggagtatctgtggggtgagcttttcgtagcaaatttggatcctagactgccctctctgagctacccagtagtcagtcaaatgggtcaagtccttttccacagtttggaatgtgctcagggaatcaaaccgactttaatattagcctgtgacagttatattcagggagctaagacttgctctcactaacatcgaaagcgttccagcacatgttggaaaggtgtttggggtagccactgtttagacttgccttagctattgatcttcttgttatcgaatataatttagaactaacagtgagacccttagtggtgggagaatattattatcatttgttatctgcacaattaggaagcaggagagtacagcagaggctttatcctataaaccatctcgttgcctagagcattttagctccttgcagagtggtctaccacatgcctgccttcccacccccatcctcatctctctctctctctctctctctctctctctctctctctctctctctctctgtgtgtgtgtgtgtgtgtgtaatccaaacaggcattggccctacagtccaaagggctaaaaagactcagaaatccatcctcatccagtcatccagggaagaaataggagcctgcagggtgtttcttttcttttttctgaaggtttaatagaatcagtgtcattggcaatgattgagaaaaatgaaagtttttagatcaaatactactctagcgtgcatgcagcatgggaacaattgatgggcggcgtgctcttcctcagacaaaacccagtggctgctaatcagtgtgtggtgtggagagttttttgttatcctgaaatcaaggaaatattttacttttccctctgaggtgttccagagaaagattcttgatcaaagaagataaatcctcttcctacctgctaatgagtgagcagctggatttcaagcacatcacgtacaaggaccatgtgttacatttttttagtatccataatcaggtacacttatttaattttctaaaaatggaaagccaagcattctctttggttagagacatggagcggtgaagaagtaaggcagtgtttggcaagatgagtccacctaactggaatcaggccaggctttatcgggaaccagaggggcgactctgtcaagacaccccctctccatgcctccacttctttaactggaagcaagaacttaaaccagatggttaagatcttttttctgtcttccgtctggcatttaaagttgatcgctgtcaaatctagaatggacccttttcagaattacaatgtgactgaagtttgtcactttcttcccagccatccccattttgggggtcatccttcttcttttaggacatcccctcttgccccatgacccgcgttctcaccatggaaactcttatcaaacctagtggccataagattcattgatactacagcgtaaatggttgggaaacagattgcggtgttgtgtcttctgaggcatttttattttaatatgaatctgagcctccaactgaaaggatgaagctcagaggctgagtggagagactgggggagaggacagaagaggaggggcgcagagggtttgcccacatcagccccgttttcttcttttgtcccagaatcatcgttaacattatcccctccgctttcaaaagggtcctcacttggagaatgaattatttgatcaccctggatatcaagaaacccttcatactgcccctaaaattgtacagtggaaggaagaaaagaagctaacctcttttcggtattttctttgtgccagattctgggcttggcactgtgtatacattattttactaaatggatcaaacagaatctatttcacctagccattaaaccgcatctctcttaggctagaagtaactataccagagtcatttcacaggaaatgggttgagagtgttgcatggaccatttttacccctaggaacctgaatcagaaaggctcatggaactccaagttgaaaagaaaaccatattgctataggggaagggggtgtgaaaatgctccggtgagagtcaaccccctgagtatacagtaggaacctccggtgcctggcaccacgccatgccttgtcgggggccggtggggggacccaggaagcgtaagaggtagcagccacccgcagagagctgcattccttaggagaacaggagcacggcagcggaaccacagtcagacggcagtgatctcctgcgcttgatccccgtgtgacaggaactctcaaaatgaaatccagctgctggaaaccccttggccaagaggtgcctgacacacatggtggtctgtgccccaggcttccgccggacatctcctcctccccgtcctcatcgcagcgtttaggacatcacgtcttcttgtgaagcccagtgttaactgcttttgttttttcttcctctattgttgctgagataaaggaaagtgaccaatctggttaaactcgtatagtagtgaaacctgggtgtgctccttagccgtaggttttatttcaaataacaaactgttttagggattttttgcctcttgggggcatatcatagagcatacagttggggaaaattttgttgtaccctgaataagaaagtcatgaaaatgattacattaaaattgattgactatttagaggtcacgtaaatggatgttcagagtattcaaaggccatgcgaatgggtgaactctgctagttccaagtaattacttcagaaagcaagacaacacaatcaattctaagccctattaaagggctcgtggtcatcacttagaaaagcggcttccctaccagggaagcacagcggcagcgcagcctgcggcaggcctgtcgcggctgcatttccgtattgcatttgttataaaagtggagtaaagctacctatcccttacctgcctcaaagggagcctgcatagtgtctgttagggctcagcgctctatggagaaacatgttaaatttaaagtggacaatagctgctaacatttactaagcactcttatttacatgccaggaactgtgttaaacattttcatacgttgtttggcttaatgtgatacatctataatatagctgtcactaaccccatgttattaagaaccagaggcttagggaggtgaggtcatcagcttgtgatgctaatcaggaatgactgtaccagcctcactgcaaggattatgaatgggcatgagaagactatccagcatcactttgaaaactgtcatggtatctgccatgagaactcagggaccaccttggccccaaaagtgaatttcttaaatgatttccgctgttccaggcagtatggagaaatatctctgtctctgatctccgtacacatgaaatgcgactcagctattgccggagtggggtgaagacagttataacggccataaatattagttctccagcatcatatccaacaagaaaaaacaatctacaataagtacaaatgtttacttcagcctagccttggatttctatagccaaagggtttgcctctccatttcactttgactgtaaagaccagagtgaggaagtagattatgacgtccttattccatttccagaaaaaataacctttgttctgctttggattgcaaataacccttttgagagttcagaggcacctagaacccttgagtaataagttagaataccactgataggtgctcaggaacagagctgagctgtgttttattcaggctaacaataaggggcctgcattcttagtccagggaattcaagctgatgcatcgtcaaagcaaggcagtgaagtggagacttgagagatcggcctggcctggaagcatctaatagcccagcttgctgtgaattgagaatcgtaggaaaatagatgtgattctaacctacctctcattgccactagcctcctaattataatgctatcctatcctctacagaatctatactatgaaataaccttatattagaaactttcttctaatgaggtccctcagtactttagaaactaaatccttcttaattggattcaagacagaactaccttacacctaccgcgtttaaccccgtgatgcctccttggtgtatgggaagtgatcttggtttggttagcctgaaggcctgcctgctgctgagccactggtctccacctcaccatgagaccccagggagaccagctggccagggagttgagccaattaacgtccactttagggaagccagaccctctagttggcttgttacattcaacctgaagtttttcattcttccttaccttcagagaaaaatatggttctgctcactactttggaattaggttttgaaaaatacaaagcgtgataaattctatggctagcttattatctttcattcctatagtcaagtgacgttttctctaacaaagaagactccttgctttcttcacgtcaccccctgggggcctggacaaatgcacacgtcaccctacctttctgatgctcagagcagggtgggagagttcgtgaaacagctgaacacgatgattgtcccatcgggggaaaaaaggatgatgctgaaattcttccaatgctttcatagctattagacaattgaaatggtttaacataagtgtcttatttcaaagaaccagagaaggggaaaagcacattccagcaattttgcccttgttaccttttctatctgtgtcgtgctttggtggaatttacataatcatgggtgaggaagtgttacagtatacacatagctgtgcatattaggctgcacttgctttcccaagaggcttgaaaatgcagtcgatttaatctaggtcaaaaggaaagaaagaaactccattttcctcgcagaaaacagggagcttgctagtcttcacggggtcatggaaataacagaagatggttcctccagggaaagtccccagggcaacaggaggctgccaggggcctggatcttgtggccagttgacagaaagttggtcctagcgtgtcaaatggagagttggagggaaggtatggggttgccagggaccccagtgagatcattgttccctcccgggctgaaaaggtggctcagatttgctgtctgcgaggaatcttgcagggaaagtgaggaaggatgttggtggagcatcgcacgactgcctcaggcggccagagggcggtgcgggtcccacgctgccagtgtaagtttcccaggggaattcctgggatggcacttggtaatccaaaccgtggagtccacataactcacatacggaaggcccgatggcagcatcgcccgtcagcttcctaggcagtggccagatggtgataccgctgacatcagggtgccaattatatcaaactctataaaactaagctaattggatacggtttccttaaaagtagatttctacaggatgaggcgttcgtatttgggtagctgctactctagctatggaagtcccatttttaggtggggaaaaaagggttgtgttaggtgactgttggagagacatttcagatgagaggtttaggttataaagagacattttaggtgacatgaacagagtgtgaagcagatctttcagagtgaggtggaccctgttagaggtggttcagggacattctccctatgagaggcatagactttgaggggtgctcatcgactcgtggttgctgggatggttttggctttgctcttggctcctggtgtgacttgggggcagcctgctaacctgtagactggtgttttcccatctgtaaaatgggagggtgtggggagttaggctggtagaactagtgtagggaccaagagaaaacctccccttggccctatgaaggttcactaagagtccctgacaagaggcacatccacaggagaaaaggcacgcaggttgatgagatcacggtttctgtgacacaggcgccttcgggatgcagacccaaagatacaggggaaatggtatacttaggtccaacaaagtgtgcctaggctcatttgcatacttaggttccacaaagtatggtcagccatgtagtaatgtgattggacaaaaaggacatgacgtaacgctaacagactgagcagggacactcggcaaggcctgcctgtccgcattctccctggcctctctgagcaggattcttccttctgggtgtgggaaggaccttccctggaatgggggtcttatgacctacagtcaaacaaggtaggtcagagaatttgtttctggccagttttgtacagaatgacggaaggaaagttagagcagtatttttaagttttatggctggctttggggaaacggggttctggtttctgtgacctgctatgaggaagagagggattccagtttctgtggctgggcttaggggaggctgggactgagagacaggagggcaggagggggtcagagagaaactttttcttgtgaggcttttatgctggagtactgcttcccgactcccaacgtttgctacttgtaaaattttgtgattccacaggaaaggcaaaggcatggaagtcatgagaaggcaacgctaccttaacttcttctcattttattttttatagtgttcagtttaaaggcgtaaaaggctggaggagcagtacaacacagatatgtctgatcttcttggaggttctccctttagctaacttttgctgtgatgggtacttttttcatgcccctggttcctgtatctctcagttgatgtcattatagccatctgcgttcagcatcaaacacaggggagccacgataataaaattacaggcaggaatacgtgagagagctgagaggcaaggggactgggctttagacggagcttgtgaaatcggtggcctcatttgttcacttgtatctagcactcctagaaagcaagcactgcgtggaggtccagccacaggaattcacaccaacgggcccagagtcggtcatagtgccctgatgtgaccatttcctagcagtgccagttcttcttggtggttggattttgggctaaaaaaagggctacatgggtgaccctccaggatctcatatcatgtcctgaggcctccttgtactttctaagaatgtcattttgtcattgccttttgcctcaagatgctaggggtataaatcaccttctaccacggaaaaaggactactcttttttttttttttttaaggttaatgctaagttttcttgaaaattttaattcaggggatttttgatgggtttttttttaacctttaactgccttgtagaaagtgaaagtagggggtcctggcagggccaaagccagtgactgagagttgaaaccgtagtgcatggcagattcgcttgagcacaaaatgccccacttagatccacagcctttggactctggaaaaaaaaaaggtattaaattcttctccaagtggctaagattgagggagaaaatagatggcaaggggaatcaagtaagaggagtgtgtcctcttttgacttaaactggcttgcatgctactgacttgacaagaagccaagatcccagttgcagttcgacttgtgtgaagcaggcacctgctttgcttgcaaatgcacatacaaaagagagcttcattcacaggaaaaaaaaatagcgggttcactaatttagccttccagggccttcgtcccttgatctgtcagccccttagaattcaaaggcagcgtgtaaaggaatttcctatttacaacatgatgacttttttgatgtcctgaattcgaatataactcgagttgaagttgtctgctagggctattgctttgttgtttaataaaaaaaagaaaaaatatatagagagctcagtcatcagatgatcagtctggggctgctttcaagtgtttatgtgcttagatttagaaaacaaagtaggttttcatatatgtaagatgtcgaatggccttgaagacgtggacaggcccgtcttgaccctggggcagagtccacttagggagggaaacagctgttctcatgcccaaccccataagctccgaaacggaaatactttttatttgaccagctttgccgcagaattgcaggaaaccatttttcagtttgtctcattagccctcaagttgtatagttattttgtattccagaaaatgctccacagttccccataagaagatattactgaagggtggtatcagaaaaagaattagcagttagaactagaactttccagaaaggtccctcctgccatggtagagaacaccttacacaggggagtttctccttgcttcaggcgggtggctgcagaagagtcatgaggaatgcctccctgaaaccagccttgctacgcggggtcagctcctgcctttggcgttgtgactcgttggcatgtgatctgaagttcctgccctgcagctgacgagccagtgtttcaataattaaaaacaactcaactcactgtcctcctgccttgaatttgatcattgcgctttgcatgtatgtatcacaataccacatgtaccccataaatatgtacaaagattatgtgtcaataaaaaacaaaaattaaaatcccaatttttaaaaagaaaacatgaaagtaatttttaaaactgcgtcagccatgctcagtggctcatgcctgtaatcgtagcactttgggaggccaaggcaggaggaccacttgagacgaggagtttgagaagcctgagctatgtagcaagacccagtctctactaaataatttaaaaattagcctggtgtagtggcacatgcctgcagtcctggatactcagcagcctacagtggagaagatgactttagctcaggagttcgaagttaaagtgaactatgattgcaccactgcactctaacctggggaacagagtgagatcctgtctcttaaaacaaaaattgctttgtccatatattagagtcaaggaatttaaagaaaaccgcctttttaaaacagtgtctcagagcatcaaaccttggtttagaaaccttggaggaagtttctttaatgagtatggtgtcagttttcttaagggcagaatgagtttaaaatctgacctcatatcattgtctagagtggtgtctacattacctccacactgaaaaatataaatacgttattgctctttgattcacagcaaaccgtgatataaactggttatctttatatatcagtacatttttttttcctgtgagtattattacccagagtttccaagtaaagattttcaagggaaacagctgtggtttgaaaaggtttgtgataatccagatggtttctttgaggataaatctacttgatcatttaaaattaaagtctttcagtacagttgagtgtttctttatgattttaaacacactactgtgtgtgagtgagtgagagtgtgtgtgtatgtgtgtgagagagagagagagagagagagtgtgtgtgtgtgtgtgtgtgtgtgtgtgtgtgtgtgtgtgtaactaccattggcctttggggctttatctttggaaacagcaaaaatctcataccagtgtctcaaattatctaacagttaagcaggcaaaatacctgagggaactcttcatgacagcagaaactattagtgaaaaaatatagcgagacaccagctaccctgtgtggagtatgtcacactcagcctctctgggaattgccactctccacttctgatccatgatggcataatcatagctcacaattataatactgattacagattgctttccaagctgaacatatgcaactgtattgctaaacttaccaatttcagggaatctgggcgtcaaaagcatccacatccctgcagcaggcccctggggaggtaggcagggtgacagctgggaaatggggaaccagggctttccatacctgtctccttctctcagtgtccaggatcttcttgctgcttcatggctgccccgagatgctccctgtgaggcccccccgggcctgccttcacagacaatgctctgtgcccctggacctttcttctgtgctttttctgtcttgtgttcctttcctaagggccctgctagatgttgacagtgaacagcagaatcacagtgatgtgttagtggccagtaagatctggtgtatttcccctctaagttacagagaatcagcacagtctttttgtagtcaacagaagaagtcatcactagtgggactgctaggctctgtatggacctaagactgtgatatttggttctgggctcacctctcccgagttttccattggacctgatggacctatgaattttaaaagtcctggtgaggagtcgtgggaggtgcttgttaaactggcacatgaagaaggatggtgtttttttgtgttttgggtttttttttttttttttttttgcttcaaggaccaaagcttttattattacaatgaattgttgaggtcgctgaaacaagggatatcctgaagtcacccgggcatggaacaccatgtttgtcttttctaactaggccactgccactggcagaagctcctgaatgagtagataagcagtggcatgaatcgtcccatgcaggtgcttattagatagtgtcaaatgagcaaagtggaaataggtgaagcagcagaaattaccagcattaagcagcaatgggagggttgagacctgcagaagcacctggttcatcagactgcatcagcctgtgctgatccccagagccccctggccggtcacctctaacatggagcgaggcctctcactccactccatggacagtagggaaggtgggtttcccagaatgaattctgaagcccaagggactgtcccctctgatgcatggtgcgaccactgaccatcaaagagccagcccctgggtgttgtagatgtgtgactaccccttacaccgatgttggaaacagagcctgcaggggaggaggcttgcccctgaatcagactgctgagccatctggtgctgcagctgacctggagaggaatccagtacatttcagacctgagttacagctggcgtggggaaatctaggagacaggtggttcccttaacagctgtatatttggttagggctgacaagaaagaaaatttcatccttgttgagccttcgtggtttttcagggatctgtagtagctccttgaccttttgccataataattgtcatttcagggaaaataatgatatttctctctttgttgaaatattgtctgcaggtgggtaatctaatattttacaggagcatattaagtgataggtggataaaaagactatggttgttaactaggagaaactcatagaaagtctttcaaacacattccagtatctggaaaggtacacactacagtcctgctggggaaaaacactaattgctgtatctaagctgactgtttcaatttggaggtctgtattcatcctgcaaattttaataaaacttaaccaatcactgtacttgttaagtgaaccattatgaatgctgaacaaagcataagacttcctttagtctaatagaagtaaagaatgcttttgaccctttttcttttttggtcctgaatgaaacactttggctgcatatccacctagtttcgtggggggatattaagcagacctgctttttacttactgatgagactaggccgggcacagtagctcatgcctatagtctaagggctttgggaggccgaggtgggaggaccacttgaggccaggagtccaagaccagcctgggcaacatagtgggacccctatctctacaaaaatgtaaaaagtagtcaggcatggtagcacacacctgtactcccaggtactcagggaaggggcaggagaaccacttgagccaaggagttcaaggctgcagtgagctgtgatcacaccactgcattccagccaggacaacagagtgacatcctgtctcaaaaataaataaattttttaatgatgaaactaactaaggtactgaggaggtaagatatttccccacggtaagtcattcagaaactaaatgtgaaaaaccaaaagaagcctctggggttagtattcccagtctccttgtctgcccaggaccccacatttgtgtaagttgctaattgcacaagggtatcctactgaggccgtgaatagagtagaaatccaggctgggatgggcttatcaagccatggactgtggcaaggagctacgcccacctggagatgggatcccctcttggaatcggcacaaaggctccaggcttccctgccaaacgcggcgcctgtggagctgtgctggggctcagctcttgggtcggacagatgaacggtaaggcacattagcagtgttacctacggtatcctcctgcgtgtcacactggaactagagcttctcttggcatgatgttaaagaatacctgtttagatgagtgtacacttttaactgaaacacttaagaactatgcatagttggaagaggatctgtagtgataagtgactgacttcaccgtactagttgtaaaggcagagtggaccttggatgaaactagaaagtatttgagatcttggggatcttcccatctccccttctgtatgtttgagtcctttcttccttcctttctcctattcacctgccatcccaccctgcttagataccagcttcaatctgtccgtttctgaaaaacaaaaaccacccaccttcttttcactaagaactttgttcaagaggaagaccctttaaagtagctaaaatcacactaagctgtaataactagcaacaattaaatgtctccttcctcaagggtcatgttttagtatgtaaatagcagaaggactacaccttcctagtggactctcaggcagcgagccatggcagggattttgcttgggtgtctgaggcaggagtgctccctttatccctgagaccactgtatgttggtcaaagctctccacagctggctcacacagaagtgcacacaattcactccatttacgtcatcattgttccttgtcgcttttatcttagcgttgtttaattctctattttcattttccctgtcataccattggtcttccagaccaacctcaactcttcgttcttggctgtggcgtggccaaactggcatcggtttttcatctcctgaacttactctttcgtaatttcctttatttcagccagtaaatggctgcatccctaagtcttcttttttaaaacatctcattcccaaaagttacctgcctgaaagtatcagattctgcttttttttttttttaactgtggttattaaatgaggcggtaattcagaacttccccactgcttccttatccagaagctaacgccataagcccaggacagggaaaggagaagtcactgagactgtgtttgctagaagcgtttagtaaggcttgtcctgtttttctttgtataccaagcctgatgaggcatggttggtgtttttcttctaaaaatggttactggaaactgggatgttagtttccttttggaaattattccttggcatgaagcaattcctatggcttttctggggcttacatcacgccactgaagctgaactcaccagtgaagttgatcggttcagtaaaaaatctaccatcaagaagcagagccaagtggattctggtcaaagaactcaaaatagctgaaataagatgctcgtgaaaatggtcagtctcttcaggttgattctttaaagaaatgttataatgttcagttcccttcattcaagtgatacatttgaagggttcctgatctttggatgcgtggagtttttcaaatgccaagatgctatggtcatagtctaccttgtccaaaaggcaaaggttttgtatatattgactgtcagtagactctaactaaatcaagtgtaaaatgacaaggtttcaaatttctcttccaaacgaggaagaatcttggatgtctttagaaatcttgtatgaatgagattatactttattttccccctgaaatggcagcacctctcaaagctcttctggcccctgtctggctccgtgcgttatgttcctttaataaagccaaaataaaatacatacagtcttggtgagtgcatcactttactttttttcctcaaccacttaccaaagacagcccagatcaaaggttagcatctttgtttcttaaatttcaagtttttgtcctaccctcttttcccaaactgattgtgctgagaaactatattgctgaacaaatagccaatatctttatctacaagttgaagaaggtgcaagccctcctccaggatgcagaaggaatagtctaggatttccataccgttttctttggtggaggaggttggctggaaaaaggatatatgctggcctgcgcggaagggccggggactcccacaggctctttggaaaggaggaatcaaaatgttgccagttagtatgccacagccatatatgtaatgcatgggccagagtccactaacatctgtttgggcatgtacccatctgtattgtagcttaatttctaagccagttaaaatacagtcttccgtattggcaaatgagtattgagggtcatatgtacagaactttacatcatgtaatgtggtggagataaagaagaatgcactatcccagcttttaagaagcttataatccagttgtctgaagctttgagtttagaaagtctttcaaaaacctgacgttctggagatacactttaagaaaattataattaatgtaagcttgtgctgttgttattgtgattaaatgcttctcttcacgtaggtgctataacacaggtcccattcacatctcacccattcctccaccacctcccaccctcattcttgaatagctgtattccagagaggtgaggcacagagtcaggaattgatctccaacgtgggtaaagctaataaatatgatttaggatgaaaaggtactgtgtaaatgcttgagatgttgttattgctgttctcatatgctttattatttttaaattgtgcgtccttttaagtagattgtttgttcgccacagtctccattatatctaagcaaagcattcacagaaatttctaaaaccttttcatttctctctgtaggttgttgtttcgtaacattttatacaagaaaagctgcacttgaggcccagaatgcactgcacaatattaaaactttacctggggtgagtcggtttacttttgtaccagaatcactttattgcttgaaaatggtcctttcaactgaaggttctagttatgggctcttagtgccaaaaatgactttggtcttttgaggagtgtgtgctgaccccccagttccctgcagcagccacaccagctggccagcccataaaggagcgctggcattaacactgacgggaagcattctcaaatagtgcatcccctggttagaaaatcagagtgaccccactgggcagccacggctgccaaagagtattgggtgggctaagattttaaaaggaaaaaaaaacccaacacacacaagagaagcaaatggaaaagaaaaagcttttattcaccaggagctccttttcaaattttgtctttagattttcttttgaaaggacaaaatgtaccctttacagccataatattaagcctcctaatggtttctaaacagtcaatggtggttaacaaagtcagtgttttaatacccaatttgtggcttcatgttgatataggacagaaaatacaaagcttacaatttttttctccgtttccttcccagtaatatttgatagttggcacaattcaccagaaatgaactgatgttgcatgtaggaacaccagaatacagtttttctaaaggattttgtggcacttttatgtatttcatgctattaatttcctgatgctgtttgaatgttttccccattgacccaaatatcagtgatgagttcataatgacatgcatttgttataatgaagcacctgtggtaaccagtgcaaggataatgattttattgaaacctagtttgataagaataaaagaaagataaggtaatgtccctaatgttttcagggtataattctacctttgtgtcttttatttgtctctgaacgcatacacaaacacctctgtgtatatacacattcacacatgcacacataaccattgaaccaccacaggcccccagaaaagatagcatttgtatgattcatcctagactcgttcacaatacaagatcgtagtggcaaaaagctcagcaaaagattttcacaacatgaggttcttcatcacccaaaagtcataaattaagaaccttgattttgaatcatactactttggtattcccctttgtatgcgaggaaatcaaagaatagaaggttcgaagaagcaagtgtgtggtcccacaatggtcctgcccagtttcactgcttctctctgaaactgctaaggtggttcttagtaaagctgtttttattgagtctaagtgcttcactcagtgactttaaaaaaattgtattattttatctgcattcttcatgtaaatggacttttttttaacacagattctaggagattgcagtgttgggtcacattgtggaatgaacaagccaaggcaaatatttactgactcagccaataatagatgaaaatcatttttatttcccaggctcctaatcaaacccaaagaccactttgtatttcttcttttaaaaacaaatgctttctagtaatgagcatgccgaatcccttctaggtgtgttttttaaaattacttgagacagtgaactgttgttaatttagcatttaaggtatagtgtagtttgatgccaagtcacatcatattttaagtgaatgcagagcttggtgaatatgtatttatccctctactagaaacacagctcccagcatgcgatcttcatagtcgagggtgctctcaagaaacccagagtgaatatgatgaatggggcatgttgaaatgcatgaaagcgacttatgagtatgcttctgtttgggattcttacactgactcttagaaaacaacatgttttatattttttaaatattgtacgtgtgttacttcttttcttcctaaaaatcctgcatgtagaattcaggggaggtgatgttacagacccactgtcaaggacaataatttgggagctggaaaagttggtcggtggattatttttggttttctccttatctagtttcatatgcccaattacttgaggcaggttgaaggaatttgaaaagtcagatctgatttgtaaggctgatagcctttccagtgcacacacttgctacatttgctattccaaatatggtaaatgaggagagagtttcacatcttgcatttatgtacagcttcgtccagtacacattacccttaacagctataggaaaaacatgaaagtgttttccttttagctgtgtgagtctttggtggacagaaagaaatgggaccagacataaaagattaatgcatattcttggaagaaaaaatattacagggtgccttgcggtttgattacaagccttgaaattagtcaacatttccataattctaaaccaatatacacctgttttcccactgtgatgtgaaggcacaacttaatttaacagagaccctgctgtgctaaatctctcattaaataccaagtgagttcggtaatttaaagttgtacactactattttaactggttgccttcatattatgaaattaataagaaattaatgatgcactttgccatatgccttcaatttctttctgaataaaactaaaagtgataaagaaaaaatacatcaccagctgacactttaaagcttttctggttgtaatcattttcctgtggataaaatccattaaaaagtcacttgctgccttttttctaaagtgtccaaaactttcgatttaaaacaagatcaaataatgctagggttttttccgatgtaattttcttttgcagttgatgttttgtttcataaggaacttttattatgcggccaagcttgattgatgtttggagtttgctttcctctgtatgcgccatctttctttcttgagggacacaaagaacttggttagttaggaagcagaaacaagttgataggatggtctgttgtgcaatcaaatgtgtctgccataagattttgatttaaaggcaccctcctttacatgtcaggaatgaattttagaaaccctttacatggggctggagaaacgactcccagattgaggtgacagatcagggctcttacggagcagtgcaaaatcattgaagacacgtttctcaaacttgcctcttactgggtaaccaaagaagacgctctgttttacatcccctgaaattctcaacataaaccctagaaatacaatggcagtcataaaggaagcaaattcaacagctcaacacagagcaagggatgagagtctgggagtccttcccttggtttgatcacacatctcctctagaagtggttgctggatgctccagcaacagaagaaattttaggtacagtgcctcattagttactgacatttcatgagattaatcccaaatgatcatggagtgcctacagtgtgcctagctctaagctaggtattggcaggaagtagcagggatcgagcccaagggggcctctagctaatctagctggaagggtggacagtagacaggtagttaatacttacatggttcgtgctttcacgcttttctgctgcagaatacccattccaccacacacacacatccttgagatgcctagtaagtagagcctttgtagcctgaagataacactgtgagtgtatctgcacaggctgggctacctgagaagctgttggatttggtgccttgttaggctgacttttcctactgctgggccatttatggttttggactaattttggttgcacctgctttgatgatatgtcaatttggggttaaagatagcatcccttcttgagggttttatctaggcacaacctaactggtagtttgttcagtagaaatgtcattatctaccattgtgtttcccagagggacatctttgtcaaggcaacttgcaagattttcattttgttttttattgagctaatttagctcaattaaaaaataaagtaaaatagagacttacctgaggcccagaaaaactaccaagatcttttcaataatcagatgtcagggccaaatatccttgtgccggtgtcagcaccgtgctgggtgtcattctctttccaaggtcttaacacatattgtctctggtaataaggcttttggattgaaatccacagcagtatcattagagcattcactgtataaattaatttaattaaggatgtaataacagagaggaatacagttttgagaaacctcttaaattttaacagcaaggaggaagctgcggaatctaaatgtcttgtaaaatattaattgcaaatttcttccagacatcttctctgaatatgccttacccatttctttttagaatcaccaccagttttattaaatgcagtttatattaaggagttattgccctaagagaacatttgtttagagtgctccattttagcagcagcatgccaaaagatgttttacaataacccatgcaaggtgagcgaggactgccagagatctggggtagaaaaacaaatgagcctgatccaatcggaggaggcaggaagggaaatggcctcctgggacaagtgtgttcacccaggtggagtgaatgggccccttcctggcctgccctggaagagataatggaccagtgtgggtaggcaccttcctcccaagcaggcttcactctgctcgccatggagttggcctctgtgttctttcctagtggagtgctgcagtttctctcttcagcaaaaaagcttgactctcactggggccaaatttcatttgcccattttaatgcatttggaggtgttcattttctttgaaccacctctcctacttagtgataggtattaatgcctttgttctcagagccacgattatcatcattttatcattgtcatcatcattattatttttgccataaaatctctcaaacctcatctcactgtgtcagagaaatttctcctgaaaccatcccattggaatcaaagcctaactgggccaagttagagtatttttttctcacatgcctttggtttaaaattatcatggaaaacaaccgaaacatctgtatgaacaggtttgagtcctcgaagtcttgtgccatgcggggcacacaaagcgctgatgcatttctttattcggcaaccatgtattgaacgtttattgtttgccaggcactgttctagataccagggaatactgtagtagcagccatgccctttataaccaaatcaccaaaccacaaagcctgccactatgcttacacgtggtatgtgtttagtaagtagctcttacatagtgaatgcccgaataagttagtttttataatgaaatatttccaaaggcctacagttttattttctaaaaaaagataattatgcctaaaaatatttcaaatgttccaaaatataaaatgaatgtagatacgttatcacatgtatgtgtgtttagtgatacaaattgtttcatagacacagatctatatatgtgtatgtctatatgcccataaacataccttccacacgtacacctgtggatgtcagtccaaataaatggaggaagatgaaagttaaagtcctccccgttctctgtgcagcctgctggcttagtctcaattactttgtagcgaactttcttatttgaggcttcaccaacgatctcagttccttggtgtaattataattctttgtttatgggtgctttgagtccggatcatggcagattcatggtgcgtgttagagagggtgcttgagaaatggccgtgcgatgatggtgagctctgcttcccagcatcctcacagtcaggcctgagcggggcactgcctgaggagcttcctgagccatgaggaaacatgcctcaaaaggcactgtgtctgcctcctcatttgtgtaggtgtgaactctccttgtggagcaccccagcatacaaacgtgtggaacatacacgtattccacacatgtattctgctgcggaatgtgtcagtcaggacatccatttggtgcagatgcttcagatgtacatttgcagaatttggcctgggctgagaaattcgccctcatgggactgcctaggaggagccatttccctgccatctgtgttttcagataatactcaaatctcatacaaataaaagccaaacaaacaaaataaggactttgtttctcttggagatgactttttaaggactgtgacagagagtagcagggggagctccggaggagtccttgagggtgcagaagctcccttccccctgcaggagtcacagcagtatgaaaggggtaggggcagagtgtagacccagccccaagtcgggctcagccaggtgcaacaggatggctcccagctgagcggtatagatccaggagaggatatcggaggatggaaggaaatcctgggcccagtgagttccattctgcaggcccaggccccagggcaatgggaaagtatattttaatgcttaataaaaggccattacaaattgtctatttcacccgccataaagttttacacactacctgaatagcaggttgttttggttttggctggcagtctgttgattcagtaatgttgatgggcagttatttacgtacggctttgattaaaataaaaaactagttatttttaaagcatggcctactcggtataaggaattgtacgagagaaaatgtatgaggattcttcagtggtgcaaagttgaaaatgccagcacaggattacagtagggaatagccacaccacttttggcctcagaacccagtggaaggcaatgtttagttttgcaaacaacgtagtctcagctatatccctaattaataggactgttgccagggcttgtgtgagaaagtatgttaacgcgctggtactggtgcctgatcagatttgcaaaagtgccttgtgtcattgcttgagggatactggtatctcattagtatcttgtgaggggatggtaggatggtacaatggcaaaatgaagccatagttagatttcagagataatcatttctctacgacagcccaagattaaactgggaatatgcagttcacttacgtcgaccttagttcccaaaaggttgataggatttcaaaagaagattgtgggggaggcgggggatccatgaatttgattaaaggtctgcatggaattacagaggaaggaggtgagccatgataatcaaatgatgaaaggagaagtttgatatacacctagaaaattgtccaaattctgtcattagcgtatagggtttccatgagaactcatctctgagaatatcatatctggctggacagatctttaatctttgacatcagctgagcgtaactcaggagatgatgtccaggtgaagtgcgctcgtgagttcggagcctggagctttaggccacacaaaaagcatacagcatgggtagatgtggagagagttctcccaggaacaccaaggttcttcccccacacactaggaaatagggaatggctgagctggggagagccaaggccaggatcagagggagtcagggctctgccggatatggtctggtttgtgcagggaagcgcgctggacacttacaggagggcggtgtggggagggaaagaagtttcgtctgtccctctgctcgtttcaaccataaatggtcatagcatacaggtgcctgggaagtctcattagtagtatgacataagctgttgaagttggtttgataatgaaggaatatttcaggcccgtaccctcaccactctcactgcccaccagccgcagagatgaaagaataaacagtaaacggtgcgtgtggagatcgcagaaagggacactgtgacaaaggctctctttcatggtcctcattgtccctgcctgtcattacttcccattaacactcaaaacacacatttgtgctgccatcccctcctcctccagccttaaaaacgcttgcaatgccctctgtacttgatctgcaaaacaaaaatggttggactgagtggccctttccaatcttgcaaaactcttctttgctgtccatgcattgtctgtggtcatgtcctatttaacgaaaatctctacactgtgacttaacttggttctgtgatgggttagtcattttagagtacttcacgtagacaaacgtggattattcaagctttgactataccctttgagattgtctgggcatctgctttcctctctggttgagaaccaacagggagcttagtactcataatttttccaccgggaaatggagaaaagaaagggcaaggggatggactcgaacgagtcagtttatttccttgtgtacagccctggtttgacaagaaagggtatttaacctaatgaggtttcaggatttttggtggatttttttatctatttgattcctgtcctcagctaacatgggtaagtgactcctctgtgtttgtaaatggctttatagagttgtttatttgttatcccttctaaaaatatttcaggtgatgtatcgatagcattcaccttgttacactgaggacatctctgaagtgccagagattaaattaacttctctgacctccctaagcaaagcagtgatggaactggaattagaagtcgtcatttctaggactgcccagttgggttggcctcgtggtggtggatttaggtgtcatgctcactgcattgtagggtggaatgggcgtggcttaagaggccagcacagcacaacgggaacagtcaccgtgaaggaagtagctcctctttatgggttgccatggggaggctccatggctgtagtttaattttcacaactccacaggacatctgttgtataccctgttttactgacaaggaagctgaaactcaaagaagatgagtaacttgtttggggttaaacagctggcacctgactttacaggcagttgggtagaaccagtatgtctggactctaagccaaggaactttccattctgctgtgtgttggtgcaggcttgccggtcccggcaagtggtcctggcaggtggagggcctcagaaggaccacatttgcccctttggcactgtcacaaggtaaatctaaatcctcagtcctgccccactcctgcagctcgtcatagatgtggaacagcaggaccatgacagttctggctgtgtcagatggcatggacctgctgacagggtgcagcagcatgaacctagaagtcagctgggcaggcagtggccacacacacacacacacacacacacacacacacacacacacacgagctggccctgccacagcaggggcatcggggcacctggcagcggctgtgcccaaggtgggaagccatgttcccttgcacaggtcctgaaaaacattcagcgagcgaggcaaggtatttgctagagacttttgggtgtgaagttactaacacggagctttctaagaggaagtgatagatcaaagacagtcatcactgtaagaggtactgctttgcgaaagtgattataaatgcaccatctttcttcagcagcatcatcgcattgacattcatgttattagggtgcatttctttatctgcatccacaggctttcagtcccaatccacaatctgcattttaatgcccagctccgtccaactgtcctcgccattgctctgcttccgtgttccacagacaggggaagggcaagtatggaggctcaccctggaagagtgagcaggactctgttacctgcaaccccaagctttaggcagcaggacaagaggccgaggttgtgaaacaaacggaaacctcaacctgcctgccatcatcacaccctcctgccctgaaaactcctggaggcctttagaaaggaactgttctaccctgttgttttactaatgaggaagtgatggtccaagcagtcaagtctgcataaccatctaagcttctgaatctgctgctgccgacaagggaccagactcaccaccacaaaccagggcactgagaggtagaaccaggcagcccacgccacagatggcacagcaggatgaacacggccccatgagacagcgctgctgctctccgcatcacagcaaagtcaaggcaaaggaggatgggtgccaggggtgcctctgcatgaagtgctggaagcttggacattcctaggccagttaggatcaaaggctgagcactggctgcgatattagggccagttctgggttggctctgtctagccatcacattgtggtttttgctgttatctgctgttagattcggccggaatctaagggatagagatgtatcatgaggtggaagctcaggctacctctatcttagttacaacagtcagagctcatgatgtcatggtggcctctggcagcttgggttagaccaggtggttatttgccacctgtaggctggcactttctacaacactgtcacgcatcagggacgagggtaccgagtgagagcaaaggataggctcctgcaaactcatctcctctcctggaggcttaactgagtgactgtgggtcgctgggtgtattttaatctgtgacattccacactttgtgtactcaccagcacatacacggtattattgtttcctcagaagagtgtgtatttaaatacctgccaggaaactgtgcaggtatttcacattaagtagcatatggggctcagtgtagtcaagaagtcacagggattaggaaagagaaaatgaattgctgtcattctatatatgttatatgcttagtaaatgtcagaacagtagtcacagaacctcaggatgtttctagcatattttggcttataaatgttttgtctacataatggatatctatcagtagctttcagaattcaagtaattttaatgaaataacactaaatgttcaagtattaaaagtagtggtaacagttaacagctattgagtgtttactatgtcctcagaactatgccaagaactttatatatacttgatctcacataaaaaacaaataaggtagtaatttgtcttccttacctgtttgccttttcaactagaagcctattgttctacattcaagaaagtgaaagtggctacacctcttagagaacatttctttaatgatacatcagtgagtatcttttatgggtaataatctacctattttaactagatacaagtatgataagaaagagacctttcagttaactgaagctaagctcatcctgtcttccttacattgctaatatctgacttacaatttactaatatttgtaaggtgtcatttaagtaggtgtggaagcattagcctagattttgactagttctttggtgtcttctgcagctcatagaggcactataatcacaacccccacccgcgcccctcgcaaaaaaaaaaaaaaaaaaaaaaaaaaacttggaaccaccattttatcatttgagaatctcagtcactgagttaacctgaatcactcctaaggcagagttaccaagattttaaaaactctgcaggtcactgacaaaaactaagtatcatcagtaaggaaaatacttaagagagaatcaaaagcccaggaaatcctgtagctgatttcagtcggttctggtttctttgaatgttatgtgggtcaacagaggaagaaaggacctgtgcaggaaagtaggccggatggaattatagatcacagaccctagaagcacgtcctgtccaagctcctcacttgatagatgaggaagctggagcccaggaaggtgggaggacaggtgagatgctgaaggtcacaccagtcagtgctggggtgagtacagatcacatctcctaactccgagcctgttgctcttttcagcaaaccatgcccccgtgatttctctgcaaggttatgccaagcatgtcaccttaaagaatcagaaatccagaatccaaatttccagtctgtgtgtagcatttcattccatgacttgaggctgttgaacttggtgttttctttttctcatttccattctctgggaaagacccagaaacctaataagattcttcctggccatctacccaaaatgatatgtgcagtagatgaacttataaagaaccgatgaagacaaaggaaagcggtcctttgtacttcagtccatttgcatataaaaccggggcagtgattctcagcctcagctgcacaggaatagaatccctcgggagcttttaaaactgtgtatgcccaggccacaccacagccaaataagactcacttgggatgagagtctggcatcagtattttttttttttttttgagacagtctcgctctgttggctggagtgcagtggcgcaatcttggctcactgcaacctccacctcccaggttcacatgattctcctgcctcagcctcccaagtagctgggattataggcatgtgccaccacatccagctaagttttatatttttagcagagacagggttttgccatgttagccaggctagtcttgaactcctaacctcaagtgatccacccacctcagcctctcaaagagctgggattacaggcctgagccaccatgcccagcctagtatttttacagcttcccaaatgattccagtgtgcaggcaagttttagaacttctgttaagagaatgaaccaatgttgaccccaagggctaggtggtggtgacataacttgttttcatcttccgctttcatctggatgtacaggcactgactctgacctgctcatcatcttcccacaggtacactggagtcttggtactcaagcagcagtcacgtcatctgagaaagtgttagaagtgcagccttgcaggccctcccccaggacctgcatttgaactagatccctgggtcttacacgttcacacagaaataatcatgtgaggtgacagatacgttaactagcttgattgtgatcatcatttcacagtgcgtctgtgtgtcagaacatcactctgaaaaaattaattttttttttaattgaaaatactgaatcctgggtgacatggatacatagcaaagtttgagaagtgctgttctgtagaaccggtcctctccgatgctctttccctgggagtccctcacagggtgcactgtagggcaaccccgtttgtgtgtgcacacacacttctcgcaagtgctgggttgctgtgttccctcatctgagtaccaaagtcaagagagatcctctggagaggctgccaccctccctgtttccttccagacattctgaaggtggggtggagtagggcagcctgactatggaggacaggaggtgagaaagtaaatggagatgtgaggacatgctggtttttccagcatccttgaatgagcaactgggtttttccctcccaaccatcctctaaattgtgggaaatctctgagtgggacttacatagaattaatgtgtgtcagactgtaaggggatgaatggaaatgctgctattttaagcacagtttttctggccagaacaagctaattctaaagcatgaggaacaattttctgccacaaagagttaatctgtaatactcagcagctcatttccaccttgcagaaagcatcggagtgtagagtcctgctgtttcatcattcacggactcgaaattcgttaccaggaaagcaaagcatttattaccctgtgtctcttgctatccgcagcttgagagacttttgctgacaaagaaaatgtaactaccacatgaatgctagagtggaatatactattgcctgatgagggatgctgggtctatgtatgtttttgcaatttgggaggcttaaaaagaatgtcatctgccctgaacagtgtaagatttccccttgagtgagttctgagttcttgtttttcattcttccttcttgtgaatctggagaagtttttcacattgtgggttattcctaattattgtagctacaacaaacatcctggattgtagtctgtaaggacaaaatcatttgttgctgcataaaacctgaacttaaccatggtcagcgtttgcctaaatcagcagctgctgcttattagaccagcatcaaagagtgagctgcagttgggcgaccaaataagaaacaaagtgattagaagatccttgtggaacaggaagcagagtggggcaagacaagagagagcatatacccaggggaggagacaagctagggtatcatatctgcttgatggggtgtcagccctgagcagagaaggggatccggaaggagtatgtgggctggaagataaaaaggaccagggttcctgcagaacttacagaagcacacacattgtgtccattttgctcattgcaaccaaatgattaactcttcagaaaaaaaaaaatcctgtttacttagtttgtatatggttgctttcttttttttttttttttcccaaaaaggcaagaaacgtttagtctttgatagaggagacagctttccaaacaacgggactcaataaagacagcatgaggtcaactgaacctgatcctgtctcttctctttcccctctcttctctccattttacctgcagtgcactcaaaggcaaaaaaataaaaaataaaaaaataaattaaaatctttcatcatctcaatattacataaaaattgtgttcaaaagagaaaatcaaattttacctttgcattcatgtattattagtgttaagtaccaccgccccatctttttttttattatactttaagttttagggtacatgtgcacaacgtgcaggtttgttacttatgtatacatgtgccatgttggtgtgctgcacccattaactcgtcagttaacattaggtatatctcctaatgctatccctcccctctccccccaccccacaacaggccccggtgtgtgatgttccccttcctgtgtccatgtgttctcattgttcagttcccacctatgagtgctgtctttcattctcacattcctgtactcatttctgttgtttcagtatctgattagagctgaattaatgtagtcggggctaaaaaatagcttctatctctcagtgacacatttttggagactcataagcctcattgttttctcatcagtgacaactttgtctctgagtcagatgactcgagtctccttcacccgtgatcttggggggaaaaaatagaagtgagtaactcacacagccacaggaccaagtgatcacaatcacagcatccactcattagtggaaatgagctctggactcagtccagttgacgaatggtaaaatctatggctcggaaagaagggaaagagcagtgctgaagatgtttgagttcttggggtgatctttgtagctcctcctgagatgtgccttgatgatgttgccttgatgatgttgcatggtactgatttcaaggacacaccacgctatatttttacataatctgcttcagaggagttagcccacattcatggataggagatggcccacattcatggataggagatagcccacattcatggatgggagaagaaaaatggcagagcatgctgcatatgtggcgggactgtcatgaggctgtcagagtcaattgtgccaggttcccaattcccagagcagcatcccggagtcttgtttagtcatgatcttcagcctcttgacagcatttggttagcagacactatagcttggactccttggatgtgttcataggcattttatcttgactctgttctctaaacatggcacactctgtaagtttcattgtaatgtggctattaaacatgtccactgtacattaagatttactgggaaagaaaacctacctagaattcagtaaaattctaactaatgaaagagtaaatacaccagctgttcaggcccaacactgatttttaaaagggcagattgggcctgggctacagctcagaatgttgaagaggctggattggagcagagctgagggaaaaagagaaaaagacaccttacgccatgggctttcacacacgcaggagaaacaaacgctgtctcctaagttacaggaacttgggtgtactttttcagagactgcaagtaaagggtgtgatcaaatgctgccctttaaacactgacatgccccgagttctgttttcactgctttcttctcacgccgcgtgatttctttaggtcccagtgatcccaggcttccgctacctctacaggctgctgccagccaaatgtttatctgaaaatcgggcttctctgctaaaccccagacttagatacccagtatctgctattgaacagatccattcaaatggtctacaggaaattccagtactaaaattactattaaccaggtcttcctcctgtattgcccatcttaagtgaattggtgggtcagccaaagccaaacgcaagaaatggtcttcctcatctcctcttcctacatacacttcacctttctaacccccaacctccaacagtgaagataccgggatgctaccttaatggcacctctagaattgctccgtctttatcaagttgggactcaccagttgtcattaggggtaataaaggcacagcaagggtgaggggatttgggaggttatccctgtaatccccatgcttcctagtattctagatgctctctagaatgggagaggtgggtgtgccagagttgtacatcaccccctacacccacaggcatatgtgaacattgctgcatcttgtatcagaaaaatcagatgtgactgctgagtttgaagggtgagatccacgctctatactgtgcccctacctttttcttcagcttctgggacatttttgctcatgtgctgtgtcccagctgtatgatacgagacacacatttggtgtcttatcctgggaaggtagaggtgaacattgcttcattgtaatttactgtgtcacatggttcaatttatcctgtcacctgctgttcttcattcccctccatggctgaggtctcagctgctcctgttctgagctccaaactccttgagagggaacattgtcagagcccggcttaacacctcacaccatagatagtgctcaacaaatgtttgttgaatagatgaactctgaagaacagcttttattcatagacactctttcaacataaaaaaaattcaagttctggctgggcgcggtggctcacgcctataatcccaggactttgggaggccgaggcgggtggatcacgaggtcaggagacggagaccatcctagctaacacggtgaaaccccatctctactaaaaatacaaaaaattagccagatgaggtggcgggcacctgtagtcccagctaatcgggaggttgaggcaggagaatggcgtgaacccggggggcggagcctgcagtgagccgagatcgcgccactgcactccagcctgggtgacagtgagactccatctcaaaaaaaaaaaaaaaaaaaaaattcaagttctttacaaactggtgggtgggggtgagaggaggcagggagatcttgatcccctcatccccatcgcaatcctttccatcaggtagatccgccctccacagacaacaaacgcagtagagacaggaagccctgcagagttaaaaaggcactttttactctaattataatccttaactgaatgaagaagagggttgacaatccctacgtcactttacattttactgtgtactttcatatatattttcttattcagtcctcacaatgatgcagtgagttttctggtacaatccctgcttcaaacatgagtttaccaagttttaacgaggtcaagcaacttgactcacatacttggaattggcagagtcagcattcaaactcagaccttacgcttctgtgatgttctttccactaacaaaaaacaaacataaagacaaaaacaaaacagacataaagacaaaaaaaacaaagcaaacataaagaggcaagcttcgcaagtccccattaaatgctacatttccacagttgttagaaattatgaaagtagaagctatgtcaccacaggtcaagtgctgtcaataaagagttcttgctttactccttaacataaaatctctcccacatgcttgtctcacatattcctcatctgtgtttacctttgccatttcaatttcagttacgtgcggtatatctgaaggcctaatccttgaattttctctttaaaagattgaacttgaagataagcatatttatagaacaattgaaccttagtcataatttctctaagctctaccaaccagtattttccaaagttggtgaacaatctcacacattagaatagaaggtagaaatcaaaatgagtgaaattaaactcaaactcatgaagactgagcaacgctggaggagagctctttgtttagcaaaataccaagcaaagtcagtgcaactatggaagacgagatgaataaatgtagctgctgaaaacaatatctgatgtcttgctcagatgtttaatggatttgcattttaaacatgggtaataagaaatagcccttaaggcactttgtaaaacttgccatttatttttaggagagaagttttttttggggggtggggggacagccttgtttgtttaaaaggaaaaaaacagatatttaatcatttttgcttaaacgtgagtaagaatggggaattaccctagttatgttttcattcactcagtacaactcccaaaggccatggaggtaaatgaatggaaaaagattgctgagtgaggtgtggtatttatgtgtctgtcgtaaatgaagttgtcattcctaaaccaatgaaatcatacattttttatgagaggttgcaacttgcagagaggtggaaatgttagacactaattaataaacgtggctggcaaagcaactcagacaactcaggactcataaactaagctatgggaggatcattagaatacgaaattcagtagtgcttttccattgatttcatgaaatgcccgtatcctgtcagaaggttcaagataaaatacaatcggcttaaattttccaagttagttttgaaccagagattttaaagatttgcttgttagaggggtattcttgtggtggctttagattgtcttaaagttcaaaggaaactagagattactggataagcatcaataacattaacagagcattgaagctgcctggagtggatggaggatgccttgcgttgtgcaggaaacactcatcaattctgtggtttgtttagagggtagtgttgttttaagtcatcaagtcactgtttaacttgaattgaaactagtaaatactgcagatgaattactggatagctttccaaaccttaaaaaagaaagtctacaaaagtggaacttcttggaccttttaatgagttatctgaaaagaagagaatgtggtttcattcgtatgcaatatataaggttgaaccatatgaaacggtcactattaacccatgtttttaaaaaactacaaaaacggcaatttcacagcaattacccaacctaacttgaagtatagctgtttctgtataataaatgtagaacagttagattggcaaaggaaatacgtgtgtacgtgcatgagaagggtcattgtgccgttgtgtggataaacacacagcagaagttcatggaatagggggttgcctgattccactagaagagagagtgatggaataatgcgaaataggcctgaaaagagagctgagggtcaaagcatggaattccctgaaatacatgccaaggagctggatattaatttggtagataagtcaaagtctttgagtgggggagaaaaatttctagactgagttttagacagattaaaaaggcaatggtgtagaagatggaaggcaatgaccagaactggtgaggaggctgtttcggggatccaggtgagcaggaatgaaaacctcactagggctgtagccgtggaaatagaaaagtctatgagaaggaaaagaaattaggagagagagagagagctaaactgaggatttcaaggggtagaaaattaagcaaatttagagccacgccagagtgttaggtgagaggtctgagaagctggaagagctgcccccatcccggggttgatgtccccataagccgtggtctctgtccagcttctcaagttctctgtggggtacccagattcaggtcatttcctatggggtgaggcaggagtgtggctggaagagtctgagtagtaggtcatcctgggaagcagtgtaagagatcagggtggacagagtcgagccctgcaaagaggctcagaagatccaggtgaggagacttgttcccaatttgaggccagcacatgtaccaggtcgtcaaggggagcccaggtgcaagggctgcttcagccccactagcatctccacactgggtgagggttacaagggaggctgggggtcagccactcactggcttttggggctttgttcatcccagttcccaagatgtcgagaactgagtcacagtgagccccacctgacaacagctggcactggggagggcaccgaaggctgagggagcactgaggccccaggcagcgtcacggccagagacaaatgtcacaaggatgatttgttgttaaaccacaactcgtttctcttaaaatatgagagaatactgtttgtcggtatatgttattgaaagtaatggtaaaaaccacaatcactttcgtacaaacctaatagaatctaggattggaaatgtaaatgagccaccaggtaattaaaccacgcctttagtcgcctttaatggccaggtcaggcattatcatttcagtgtgtattttgcattgctcagttgggcagcttgtctgatttagcgcctgggtaagatctggagaacatctggaagaatgagtattggagcgcccatcattgacttcggaagacagttccacaagtcagaaaggaatcatggctgagaggatgtcagtatacttcccacttagtgataagggaagattattacctttctcttaatttgagctcattaatcagtagtgattgtgatcttccgagtgtcgcacacaattctcgtggtcttttgttgtaattgtagctgtcatagtacagccttagcagcactataatcctataaggcttttcatacgttgaatctttccatttatctccattttcaaaattgttttataccctctagtttcttgctattaaaacatagatctaagcaaaggattccagacaaacctaggtataaacttttaaataaaaactagttttgctttgtatttatttgggagctcaactgactggattcattgcttcttatatcacaaaggtgcattgacataaagggaagaactaaagtattatcaaataaatttcctgttcacaataacattgctaaacacagtgacagtaccttctactgagatgatagctagttgggtgccacatctaatgggaaggttaaaaaacggcatcagtttattcatctttatcactaatatagtaaaaatatttctaagaaaaattgaactaagaaaagattgccatttttttgagtagcagtgcttctgaaagcggcacactcacactttgatcatagctgttatttttcattcatggtccgtgcctcctattttaagcctattcatttttcttctaattttaacattaaataaagcaaaatgaaagcttgtgttattatttagtatgaaaacacagaacctaatcacagctaacgagtgtgataaatgctaggctgtaccttctcttgtttggtgtgtgttttatatacaggaggtaacataggctgaggaactaggatgccaagttacagatggggttgtggaatgctgtctgacagccgattagagtaatctgtcagaaatgatgacttaatcaccataacagactccaaattccctcatagaattccacccagagtaatctagttttcctgcaatattttattttattttattttttgccaggactaaatggctttgttgcttgttttttcccctttggtgtacgacgtgattttaatggaaatgtaaataggtggtatctttacagcacaaaggctgatttggagcctgataagccaaaatcagatatataatcctgggttctgcagtttttctccatcactagattattagcctgtggagttgagcactgctggctgtatatatcccaggtgaccgagaaaggccattctctccaatgtgttctcttagctttcagatgggaccttgtctccttcccctcagggaagctcctatactttgcaaaataataatgaagaggatgatgatgacaactgtagcgggcacttactgtgccatcagtgttttaagtgtgtcacacacatcatggctatcaggaaaaagttgtaatttatttccactgtagtttttttcccctggttgggagaaggggatatgagataaggatcacttctgtttctttgttgttaccaaactcaaatccacttttttttttaaactggcttagatcacttttataaaattatgtcagcaaatggtgattgaaagttttctgacaaggcacagtgggtcgtgcctgtaatctcagcactttgggaggcctaggcaggtggatcatcttaggagtttgagaccaacctggccaacatggtgaaaccccgtctctacaaaaatacaaaaaattagccaggcctggtgcaggcgcctgtaatcccagctattcgggaggctaaggcaggagaatcgcttgaaccgagaggcagaggttgcagtgagctaacgtcatgccattgcattacagcctgggcaacaagagcaaaactccatctcaaaaaaagttttttgtgtgcctactatgttaatcgtgatatgtaaaagaacaacttgaaatagcgctgagacttggaggttaggtaaatgccatatattctgcctccatcatggaattggcatcttcagagggtaacagttttttcccgaatttccaaagcagtgttcagataaatagaccttgcataatccaggcagttaacataaagccacatagtagggccttttgacatgaatgattgttcacccaacaatgagtggtcttcactttgattcgttttatagattccagtgtacttttttgcactatcagtttgtgaatacaccacaaaatgtaagatcaattaacgtcagtgattcacaaccattgtttcctctcacacttctcagcgtctatgtagaacatttcagacagctggccctgtgaaagaaacctcagagtctaatccactgtgtgagttttgaacctctggatccaagcatagatttagctctgtccttgttagtcgaatggcaaattagccggggctacacttccctggcctgactctaaagctattttttttttcattacatgtttttatttctttcctgcccttttcataaaacccaaacagtaatttttgttcttgggctaattgttaaaacattgtatgtgtatatgcaaatacacaggtatactgcacacacatataaagtatgagttcctcattggaaagaagcctgtaggtggaggcaatctttatgtgtagcgtggaagagggaaattatggtaatgttacagattcttagaaaccccaaacttatttacaccacaactgtgtggatgcacatgacaggcggcgtggggtagaggcctcaggcttgtgctcccaccggacagacctggattcgaatccctgctctgccacctgcttgctgtctgactcggccaagttatttagcctctctctgcctgggttcctcataggtaccgatttctggggctcttgtcaaaattcagttaatgaccatgcataaagagcctgtagagtgacggcgaaggggaggcttcctctgtgttgacagcagttgtctaaaggctccattccacttatcaggaatagttatgacctccagatatggctttgtcccagtgataaaaactgcttgttatttattttttgaaacagggtcttgctctgttacccaagctggagtgcaggggcacagtttgggcttactgcaacctcttcctcccaggttcaagcgattctcctgcctcagtctcccaagtagctgggattacaggtgtgcgccaccatgcccagctaatttttgtatttttagtagagacagagtttcaccatgttggctaggctggtctcaacctcctgacctgaagtgatccacccaccttggcctcccaaagtgctgggattacaggtgtgagtgaccgcgctgggccagctgcttgttattgatctgacagattatttttgtcatctgtattcttttagagatgtccttctattaaagatatcttagcaagtttaccgtagtgttagtgttttgtttttatttttttaatttgaaggttcttctttagtgctgattgatgttcctaagtcaccatccctaaagctatttttgattattccccatctctgctatcaggagcataatagaacagtggctggaattagagtcactcatgagggagacaggcaaacctgtgtgggttgggggtgtcttcctatgtaatagaaggtctcgtggtggggcatgctgtctttcatttgaggggatgatgggcctccagttggtggcaaatcttttgaaacttgtttttagcattcccaaatttttttagagaaaaattcagaaagtacaggtgcctttggcgtttcatagtcaatatacaagcgagacacaagtattctccatggatgatttttgtgttgtcatggaatgaaagaaaaataccagtgggtctttactggccataatattttcgttttctcagttggcacatagctctttcgtgaattcacttctttccatcccctctctctacttttaaatattttatgggcagtaagctcacaatatgtgctagcacggctgctctctccaggggtcaggatgggtttaataatgagatgcgtaacagtgactctgtaaaaacccatttcaggttaaaaatggcatgttttattgaatctcatgttaaaggtggttaactcatcaattggtgatggctggggttcaacaagttccaacatgagttctcctgtgtgtgaggagccagctgtgccccctgcccgcagctgcttccttcccccaggactctgtctccagactaggcctgtgttggctcggaaccctcccttcctacagcagagacccaccgaggcagagggcttcagagagccccacgaggttgtgtccatagtggcgactctggagagtatagctgctgggtgcagctgctccgtggccagcttcacggcggcaccaggtggtgacagctgttggcagagctgtgtgcagcgctctgtgcatgcacttacccctcagacttgagaaatggctttgctccaaagtcgtactctcattttcattttcatgagtcacagctggggccttgtgggaagaatcgaaggtcagcttactcaggagtgaggggcatcaggtccagtcacaggccagccagggtgaggaccagggtggaccactcagctctgggaccctgtgtgtgtgtagggagggagaagaggtgggaggaccatgggctgcttatccccaggaggtgggacgaagggggaggcctgatgctgggaggcttgtgtggtccgccaccaacagatggctcctaccagggcgacagggacggaggcgccggtggcaactggtgctgggtcagaaccaaaccactgcgtgctgtcgtgggtgcagaagcttagctttggggtagaagggacagtgggccaggggccttccctcaagaagctccagctcactgaaagcccaagcagacccctgaaggactatatctctgtgtgccgagatgctcccctccatgagctccaccttcattgtgcataggacgctgattcttagtacacagcagcaacagagcttcagcagatgccttcttgggaccgcgcttgactctagttccttctccccgggagggagaaagggaaggagcctttgaaatttcccctttcgctatgtttcactggtttttaaacaaatagggctaaatagagaccaagaagttaaccatgtaccttaacgtgcggctttaggcaaaatgttattcaaaaaaaaaaaaaaaaagcttctaaaaattcatgtaccatcaaggaaatcttcacatgaatgggtttagaagcctttcttgatagcaatgtgaacttgaagaaatgtgtgacatcccgtttactcccatcaacaggatctatttccaaaactcatgctcctgccatttccccacaagcatgctgcggccttgcgtgagaggaccagagatctcctgtcgtcttccaggcttgctgcaagtgcagctgagatgaacataagtaatagactcattaattgtttcatcgtgactcaggaaaaccactctgtaaagtcagaggctggtgtttgtaaaattcttagactcgtcgaacagcatagacagatcatgacagcacagaccactgaagatttttttagatacagcccatactgtgtctgaaaaatactcactcctgaattaaaacttcccattctgtgtggctggagatgcagcctcagtttaattagcacacgtctcttcagagactccttgcaaaaattctggaagatcgtgtactcccttgtcatagacagaggaaggaggtggcccctgggaactagcctcagccctgaccctagccacacagtaggtagattgaattagcgaccaccacatcacctgggccctcccccgtctcctgctgtctactgggacctgcaggcatgtgcagggcacagcatgagatcctgcctccagccccatctagctctggcagcagggagggccagggtccctagtcatggggaagcagttgagaagcaacagttctgaccccactcatttcatcattagctcttgagaagggtgctcagggtgtggccactggctgccgcctgtcctggcacctagggaagatttcattcaggagtgagtagatgggcattgtttctttttacttgaaattgtccagcctatgaacatatccctcactgttagtcttgtgctttaggtgtcttgttttcggtgaatgttctttttaacaacttccattggccgggcgtggtggctcacgcctataatcccagcactttgggaggccgaggtgggtggatcccaaggtcaggagatcgagaccatcgtggctaacatggtgaaaccctgtctctgctaaaaatacaaagaaaattagttgggcgtggtggcgggcgcctgtagtcccagctactcaggaggctgaggcaggagaatggcatgaacccgggaggcagagctttcagtgagccgagatcatgccactgcactccatccagcctaggtgacagagcaagactccgtctcaaaaaaaaaaaaacagcataaaaacaacaacaacttccgttgcttcctctgttggttaggatatcgtatcattgttcttgatcaacagtagggcctattttctcttattctgtgcctccaaataaattgttcttttccctgaaatgtcctttccacatcttccggttaacatgaggattgctttgagaatgaatgcagacatagcttcatctgagacgccttccccagcgtgtccttcctccatctgtgtctggtgtctcttctctgagttcgcaccgtacagctcttaccacgtctcttatcacgctgtgggaaatgcttgctgtatctgtctctcctaccacactgcaagctccatcacaatgagaaccccttctcatcctcctcttcccagcatctaacatatagtgtctggtaaaaacagaaacacgtgaataaacgagcagtcatactgggtcaaatcattgaaaccatttctgttacagggaaagaattctttttccatccttatactttaaaactttgaactagaatgtctactcttttataataacttctcaagaaatctcccaaagttctgggagtcggaagattttgaggaagtgaaacagtattatgacaatgactcctcccacccatttttttgtcttccttgacatttacatcttgtatgtgatcagaaatctgtaactcaaatgaactgttcatggtaatgagccattattaatacagtcctgattgaacacctttctctaagaaggtcacagtgctttgcatacattatctagcttgtcttcagaacatacctgaagtggggtgaccatctattcagaattcaccatggtctgacaatccacggctctgcgaagttgatttttcccctgctgagcccaggaaagagcaaaacaaagttcaggtgtgcagtggcagtagctgagttatcaccatcactgctgcttcgcagagccttctgaagagtcttacggcagcacaagccaattctctgagcagctgcacgaatgctaagggtgcagtcttggtgtcatatgagtcatacagctatagagatcaggtcctacaggagttggggggaagggaagattactttcccctagggatattgcaggtgcctttagacgagtgtgtgtctgccctcttcagtgagtgaagcatgccgttcttaaccgaaggctcatatggccaagtcccacattggacattttatggagaagcagtgtggtttaggggaggcatcaccagattaagagtggagatattagagttgtgtgatcccagctctgtcgttaatcacctgtgtctatgcagtcacttattcccttcatacctgtcagccgagagcactgactgcgtgatttccagggtcctttacagctttagagtataggggctctgtttttgctgctcccgaatttccacctgccatcatccacgcatttcacagatgcatctgaatgctcacagtgctctatttgtgctcttctgtttgtccctgttttttatgtggatgcgtatcgaccgccatgatagactgcacactccctgtgggcaggagccatgttcatttcatttttgtgtcccaggcataatgtaggtgcgctcacctcatctctcccatatcttgaacctgtgaatctcagtggactcttttcagcagatgaacctgtataagtctttcctgtcttgaaaggacagatgggtggcccccatcctccactgagcttcctgttgaactccctttgcaggtgacctcaaaatagaagaagccctcattcaccctatctactgttaccctcctcctttcccctctacttcccatgaccagttgttcactgcccctccacagaacctacttctgataaatcccgtgaagaattttttattgccagatccaaattctttggcctctcacagtgtttgctgtggcctgattctccctcattctggaaactcctctcctctcatggctcccatgggaccagttgctcctgcagctcctcctgcccctcactctgctctccttggactcctctttcctggtattctctgcagttctgtcctcggctctcagctctttgcacccttctttccctcgctgacagcttcgcgcatacctgtggcttcactgtcacgctaaggaacattctctgtggccctggcccgtctctcgagcctgagccccatgattacaacttctgtctgtaccccacagtcacatcaaccttagcatgtccagacctgcgctcgtcagccgcctctgaaactctttgctcatgctttccccattcgggcagtcatcccacagtcacctggttgtacagacctggagttccccttctccaccatccccacaaccagccagtcgccatgaagttcagcctccaccagtgttccctggcctgcggcagcagcctcttaactgtcctccctgcctgtgtctctcgtctgtaatccaccctccacacggcagccaaaatggcttttctagaatttcgatcttgtttcctttgttacttcttctgtacctgaccacatactttcagacaaaatttcagttccttagcttgcaagaccctctgagagctgggtgttgcccaccttcaccgccccttcccgtggtcctccatgctcacactgggagctccctgtgagagggaactgtcacccttccacttcctgggtcactgcggggctgccccgtgagtttcacatgccggccccccttcagtgctcgcacgtccaaggactcggcccagatgcagccttggctttcctcgccaggcaggattaagtcccacacccctggacccctgtgggctctgtcctgcctctccccacatgcttgccagggtgcttaccggctgagggctcagtgtctctcctgcccctgccatcccaccccctccatcctatgcccgccatcccatgcccgccatcccacccctgccacactgagcacctgaagggaggaccttcttcactggcctttgttcccagtttttggcctagagactgacatagggtacctgtttgctccatacctgctggacaaccagacagatgcatgctgggaggatcgcttgctcaaagactctgcccatctcccccaggcatgttgctggtccttctctccatttctataggatagaggtcacattcctcagcccaactcatggctttccacaggtgacttgtcctgcttttgaagaggcagctcacttagcctctttcttctccctcctcctctgttctgaagacccaggccggcattaggtgcacgtgatcctgactgcctgatgataatttcccatgatgaaagtatcagagccaagtgccatttccctttcattgaaattagataaaacccagagctgtggcttgcaagtgatggaagtccactggggaaatgaaaggtgccgagagaatgggacccattataatgaaagcatttgcgcagccagtgattccttccaccccgtggctcctgtgttcctcagggtgcaatgaaatgtgaagcaggaggacctttggaggtggtttgaggaattgattctaattggtaatggtggcagcattgtgtgcttggagcatgctctgcggaccaggcaccgggtgtgatgggcactttaggaagagccatgggtcccccgggtccactgtagctcaggacctcggccccgctgtgtctagtcctttctactcctgtcatgtactggacatgatcagaaggtgtctccctcccttccaccctcctcctctccatccttccttccatccttccttccattcttcagtggctctttgttcgtattctgtatttgtattagcatttaataaaaattatatactgataccaaagtcagtcaactgctagaccttcaaattactcatgaggcctaagaaaaacctatgtgacaaacataggatggccagaaaagtctgcatgatttaattttataataatttttataatgatacaataacaatagctaagttattttcaacgcatcttagcctctacttatgaagcactttacatgcattttctcgtttaattctgacagccttacaattcaggtgttacctccatctcacagatgaggagaccaaagctcagagaagttgagacacttgctcgagattgcatggctgtaataaatggcaggagcagaattgcctgtaacatagaggcagaaatcatatcgagtggcagaaccaggtttcacactgaagtctgactgcagagcccaagcttttaaatatgttctgtgttacagggccccgtgacttcaaagggtttgattcccgaacagaaaatacaggcttactttttaacatagttaatagtacctggagaagtcttgttgtcacttatgtgcccttaaaacagtatcagtaatcgaattgctgcagatttctgagatgatttttacagttgttcaatctgcctttactttctcccttttgtgtttttagatgcatcatcccattcagatgaaacctgcagatagtgaaaagtccaacggtaggtggtaaccaactgtcttgcttaataataatatctgctgctttaaattacaaagtcagttgggggcgggagaagccggcccagctgcttttctctctagaggacagagagcgctgctcctggaatcttctctgtggcctgtgtgtctggagtaatgcactcgccactctcctctctcctgtcctgttgatgatctctggcgtaaagatgtatgaggctgttacaagcagtggctttctgtgtccttctctttgggacttgccctgtatagggaccctgtggcatttggttcctgtctcctccaacaaagcaatacagggacatctcatggggatccagaggacgtctgcaggaaaggaattgcccatgaagaattaggctttctgtgggtgggggaggggcgttggtttttgtttttttaccttttgcatgtgtttcttttggacttggagactaccttattgtactcttctctaaattgctccaatgcatttgcatcagaattcagagttcagtctgctgattaaataagcgtacacttggtgcaaaaatctgcatttgatgaggtccataaacaattgggttttgcctattcgagacatgagagagttgatagccacatttccctcttttaagtttttgttccctttcagcgaaccttctgtcccttttttgtacttttaatttactgaaatgtatgttaaaagaatcttctaccatcctagactggagagctgctctgtcccataagactgacataatcagtactgtttccttccagcaggcagttttgcacctcattaattagtaatcagggcagaagccatgcacttagagatctacgtatctgcaaatgtaaattatgattgggctctaaatctctccacaaggtattttttgctaattgtagtgcattccattttctggcttctccacagaatagaaagttttgaagaaaattccaagtcatagcatggtgctgccagcacccgacttgtcagagctttcttctctcagctttcagcagaaggcagcggcccatacctgtagttgaagctgctcaggaggccaaggcaggaggatcccttgagcccaggagttcaaggccagcctgggcaacatagatatataaataaagaaaataaaaaaatagcttttctctctctaggaggagactttggtgctttaaccactgtcttctcctcagccctgcactttacttagggttaattcgtttttttctctactgctttatcacaaacatgacacttagcaccagaagttgtcaaatccgctgctgctctgtggccctgtgagtgagccacgccactcctgtagtcagcagttgttcatcagttaccgtgtgccacgcatgttgctaggagctggggctgcagcactgaatagaaaaaggaagaagaaaagaccccaagagactgtgtctctgaccttgtagaactgacattcagtctactgatttaagtatccagaagtcacttaaacattgaacttggatttctgcagttgtaaaatggaattgatggtaactgtctcacctaagttgccttcccctgagcccaagactcaaataaggtgtttgtaacagtctctgtaatgatagaatgcctctatgaaatgttgattactgtttgcacccagaggtggtctcctggcctctgcaggctctccatggagcgtgctggcctgggaagaagaccacttcacccaggcgggctcctttcagcccttgtgctccagaggtgcgtgcttgcagtctgatgacttccttggtgggagacacgagagatgactcttgtattttgggatgaatcctgttggtacaagtcatctcagagtgtgtggccaccaagaaatgttccctgcctttggctccatgatactctaaactgtatttagagtattcaggacaaggaccatgaagtgaaagtctatggaaaagggtttgtctcacttctgaacctttggttgtagatatagaaacatgacaaattagccaaattgaaaacatttgacctgaaatatcccagtactgaaacacaaagggatttttttttttttttttttttttttttgcattttctgctgtgcaggtattcatttgcctcagagaaccctttctacaggcagctgccaggagtttgcagagtgttttgttgttctttctgtccagtgtccactgtggtccctgagaatcacatttgctttgggtctagaatcacagcacataataaaactgtcatgggcacacccaatgttgcatgatcacagaagccaaggaggaccgggcaccgttatttctaggataagacggttacctgaaaatgctgtttttcaagcagcagcctggggtagcagttatgaactatttggagaagcctggatttgacccgactccacgcttgttggttttgtccttgggcaagttatttaaccttactcagcatcagtgtctcttcagctgtgagagggggctacagtggtgtcatctgaacacttgttgtaatgcccgtcttacaaggttatttgaggtttacataagttaacgtctataaagagctcagcataatacccggcacgtagcaagtatccagtgtgctaagttctgctaagttaacactgttattccactcaccgaggcagccttttcagtgcactctgagcagcagaggccggcctgtccaggcctgggctgtttataccgaagcatagctctgtatgtacaaatcaaaacccccaagtcttctagttgggccagtgctccttttgctttgcggattgaccttcattttctgaattttcagtaagaaaagtccaaaaatataaatgagcggaaggctgcttttaaatggcttttctttccagaggcccaaatggaacctcaccttgcacagacatgaacagcttcgaggttctctttggacctgatggaggaatcaggaggaatatgtagttttctaaagcgagtgataaaagccacaagccttttctaatttcacatggcatttttgacaggtaagcatagtttcaaaagctcaaagagcacaaagatttctttggctcagttgctctaaatagctcctgtagttttgaaagaagtataacgagctctaattgcacttttattgagtttgctgacatttatggatagcacaaaggactcatcacagttagacagttactgtcttcattatcactgtgttcagatttctaaaactttgtatgtgctgagccagaaagagctgctaatcatggattaattcatgatggacaggtgaactccagaaaagcagtcacccttggcagctttcgtccatcgagcgattctgagagagggaacctctggggtgagccccgaaacgttaggttgcgctcagatcagccctgcactttgggatgtcactgagcagacttcccgagtctccatggcttcctgtaacctgccctttccattggctctgatttaagctgcagcctctggcacaccgatggaagctcgcggcatcgtgttttccatccacgtgctcccacagagccaggttgtccaaaaggaaaataatcccactctggagaagcaaaaactgctggggctgctaagaggagcacactgagtaaaccacccaccttccaacagaatccgccttttttgttatttttccattgcagaaagacaaatggcgggacaggcagggcttttgaggaggtgtggatttcatcctccatcataaacgagcagaaacatacttaaccctctttcatcctctatgccatccagcttttaatcctctattgctgtgcccaacgaggtaccagctgtgcagtactgaaagtcacaagcagttgctgaagttaggctggcagtgagtgatacaaacagaagctgcttcggttctgggtctggtctcagaggctggagctgtgctcactctgatgtctttgcctcttgccgcaagggaagttgcttgttgtttttactctatatacagagcgtaaatccatccatcctgctttaaccctccaacctcacaatttgctgggggtctttaacgcctagaacccagaaatgtcacttaagcctgctgtgtgtgtctctctcaaggcctccaaaacctccagtgtccaggtgtcaagttcagagctagcagcagtcaagataactaaatatcatcagcagagggtgcagacctgcaaagcctccattaaaaataggaatcatggggtggctccatccagtcactttctgattcacgggaagatgaagaaataattttgaaattcaaagtggagagacttacagatttggaggcagtaattaaatgccatatgttagcactaacacattgaaaagttgttaattaattcaggcagccccaaatccaggtgtgactttgacagattgtacacgcgggtgttagcgcagacttacaattagagattttttttttaaatgaagtttctattcccctaacttaaaaaagtcaccccgtgtatttaaagtattaacccattctcatcatatcatggaaggtagacttcaaatggctgctggtgtggaaccccttttgattctgtggtcgtcgttactaatcacgggggaccccatctgtgcagcacttcatgtgtaaaagcatttccctgcccttattcagtgtccgtcatggaaaatgacttttacccttcaagtgtttttttgttttgttttgttttggttttggttttttaattccttaaagcacctagcagaatactgtgaacacagtgcgtttcatttaaactgactttcctgtaggttgaaaaaataagtgagatacttagtgcccgtgaatactcaggaaaaactcaccaagacggtcatcaaaagttgataaaaaagttaagtgaactcaaaataactgtgttcttgtagaatgtttacaaagctgttagggaccctcagaatgggaatttgggggatgaattgtatgactaacttgtcactggaaaaccaaaaaaactcagaagaaagccgggtgtgttcagtattccccatattgcctttaaagcaaacacagcccaactgttgaaaccacggagcaactttggctagtaagagattcccaaagcccagcacttctgtgcacacgcacaggtgcgctcacacgccacacacacagatggaagttaacattttgataacgtggatgatggaggtttccattttttttcttggctaatacttgatatttttaaaagtgcgagttatctttcttcttgttgcctggctgagttgaccttgagtgatggctaggaagtcagcatttcttcatgagtagtttccattttcttcatgttcgtcttaggaaaaaaatcatttttaagcttacccaggagctgcatggttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacacaacaggaattttatttttactctcataaaaatgccagccatagtttgctgggggtaggagtctcggagacgagagggaaggaggagtcctgctgatttttctcccttttctaccccctttccatcccatctctccccttcctgtcccatctctccccttcctattccttttctccccttcccgttcacgggaatgccactttctcacagggcctcccccaccagaatcctcccatgttagtgagcacaggcggtgtagacggcctgcagcaggtggtgtggacggcctgcaggtacactcgttgcccagggtatctggtgtctctctggcttagctgtcgcgcctgtgctgcccatgactgaccaggcttcaccagttcacagcggatccatgctactttgccttctctgaagggaggaaaaagaacttgaattagaagttttccgtcagcgtacaggaggtcaggtcctcagcagtctccctcccaggaattggagcccggggtgcctgttgcccatgtctcctccgagtctgaacacaagcagtggctcaggccagctgatgctttcctcactgagctccttctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagacagacagaagctcccttaggtctcttccttccactctgggatgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgctaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccccgtgggtgtctgtgatgtccttaaaaaaaaaaaaaaaaaaggcacctctcctaaaaaggactccaaacgctgtcctgagatcagttttaacctcgtctttcgggccgaaagtagttcacatttcccgagcacaagcatggagattttgaggaaaatctcccgggccctgtgaagtacaacgtgtcttatcttccccaatgtcaggtgcccaggttagaatttgcgtgtcgtcctcatgatccccaaatgcacttttattccccgagaatcttgcctcccggtggctagtacagtattgtttccttcttgatcatttgtgaagggctggaagctcggggccatccagggtgtttctccagcagcagccgccctgttctcctctctagaatcggcttcctgttgagcggtaactaacctggctgcttagaaccaggtgcgggacctggttagcactgcatcaccagtgtcacgggaaagaggtactttcctagctccccagagacgtaagaatctctctgatctcttattcttgtctagatcagcagggatgaagctatttgaaacagaaaaatgttttcttccctcgaatactctgtgaaaagtttcattcgctgtttcgctccatctgcccccatcgtctttcctctcctgacctttctctgtccctgtcattcaggttaaaagaccatctacaaaaaaaaaaaaaaaaaaaacagaataaaatctgtatccaaaaatatccccagagaatggtagtgttgaacagttatacaagtactttggaattttagtcagcgcattactgttagtttctgaataggagaaaagaacttaacagcattacatgtcatattaaaacattttattagtaagcacaagcacacggggagatgggttcaggaagcaccaggtgggagggagtggcagggtggggcgcatggagggaggaggacagctggacgtctgcagagttggccttgggacacgtgcttggtctcacatggctggggcctggtttgatggggtaatgaagcattgattacaagaaaaaaagatgaaatggcctttgctcattcgttatttttatctcctagctgtggaagacagaaaattgttcataggaatggtatcgaagaaatgtaatgagaacgacatcagggtgatgttctctccatttggccagatagaagaatgccggatcctccggggacctgatgggctgagtcgaggtgagtgtgctgtctggaaagcctctccccttcagtgctaattggagctctgtgtcacagtcgagacagatgtaggcaccgcacacggcaagaggtcaccctgtaatacatcccatgtgataaagttatccaacctgaacttttcaccatagctgaaatcatcaccttttatttctccagttcagaaggccttggtgccaccatattagctcaagttatcactgtcaggtgtgaagccaacaggctgccctactgctaggcatccttttcaatctcatattgaaatggatttggtggggggaggtgcaagaaggagaagtagaaaatgagaaaggatatttgttgttttcatcttagtcctcgggcttcctgcctgtgcctgaaagaaatgttaagagtatgttaagagtacagtgacacaaactgggaaaaaagcgtcaatgttcacatgtagtgcagagcagatagggatgtagggtaactgggcctgtattggggtattagagttttatttcaaagagcaaaactcctggagtcctgagccaggggaactcgttaagtgacagaaaagcgactttaccctgaagaagattgtaggcacttctttgccaccatgatagaagcagaagctgtagctcagagccttgacgataagctggtgtttacagaatagttggaaatcactgttgttttccctgtttgcctctcccttgacaatgccacacacctccttcctggaaccactcataaaggctgacgctggaggttgacactcgtctgactgcacttccctgagtcagtccaaggtggaaatgtatatataaaatgtgtttttcacttctttttgctctgtcgccaggccagagtgcagtggcgcgatctcagctcactgcagcctccacctcccaggttcaagcaattcccctgcctcagcctcccgaggagctgggacgacaggtgcacgctaccacgcctggccaacttttgtattttagtagacatggggtttcaccacgttggccacgatggtctccatctcctgacctcgtgatccacccgcctcagcctcccaaagtgctgggattacaggcgtgagccaccgcacccagcctgtgtttttcacttcttacaggaaatccatattcttagcaacatggagaggttttcattctcttattactgcagttaccagtgcaatttctttggggcaaatgaggaacttggtttccttctcaatctctggctctgggccagcactggcaccccaaaccacatgttgaaagaaaagattggatcatgaggatgaaagcactcgtcttcacccttctcactagtttgacctgacttcagcaccatgtgaggaagaacatttgctcttttgattcttaaacataaagcttaaagatgtcagctgctagaatggaaggccgagagaacaaaagttcccacctacaaccacctccagagccccagcatgaaggtagtctacaggagaactaggaggcggtggaaccacgccaagcttttgattcctgtgttttcttcggaaggtggtttaaaaaaaaaaaaaaaaaggcggcatggaaatcagtttatgcattctctaacaattctgaaattttgttatataacactcacttaaaagatgtaattctctaaaagctgaacaagtcactgtattgagtgtgatcctggaatagcagatccagtatccggggctcctctgcggtttttcacctgtgccatcgtcaggggcaagcaaagccatccatcgctgtggcagactgcaccacctctggctcccaaacagcctcaccagccaagggatactagcatgccttcctaggggctcaaaccagcagaccttctaatcacacctggtggtccaattcttcatcatatatatgtccacttaagcagacaagccaggagggagaataccatgggaaaagacagtgtggctaaattaagaataaaatatgtagaaagatgtgatcatatttttgtgattccttttctggtgccaatttagtagttagaatccctgttatctcctgttgttattctcagtcacacttcagtgttaccgtagtaattttcattctccaaggtatggagaaacggcacaaggagagcccttaaattactcatagcgaaatctataatggcttaggggccagtgaccccaagttccagacccacaacttctactgaaatgaaatagaactttagtcattttattttcttacctctgtcctgagctttccccatttgtaaatgacagccgtaactatatctgccctgcttctcttgcagggagtcattcacggctggtgtgctagcttttcgtctgagcataccctctgcatgtgttagcggagagaccccgggcgggcagtatgtgtgcttgatttctgctccccgtctgctggcctggctgatctaggcagtgactctctggcacattttctctgtctgtccagtggggacagtaatgaacaggattgccgcctgcagcgttcagagctccttgagcatacatcagttatttctgcagatcaggttttaaagcagccagaacctccatgggaaagagcaggacacgcagtacttaacaagagaacttagctaatttgatctgccatttggttgattaaccagcacttgacaccagaagcagcctgttcctgcaacaagtgatggggagcagtctcatcaatattttatgcaaacgctggctcagtggaaagaggagaaaacttttccctccccatctgttttttttttttttaaacagcagaaaagtaatttctggtgaactgatgagaattccctgttgcaaaaaaagaaaaataagaaagaaagaaaatactcatttataaccatttatcctgagaactgaagacagacagtggtacttttttcaattcgcaggacccagggactcctggctacaggggcctgctcctgaatcagtgtatttgttaaaagcacaattctctttcatgctaccattttgctttcattaaagaattgcagttttgaatcaaatattaatgtgtctcccattagtggcactgcagataaagggcattcagcatttctgttctcagcgtctattgctggctcagctgtttaaaaataaataaaaattaagtgaaacaaaagcatggctgctctgcacagtaccttctaacacaaaaccagggtataccctcttccgtgagaaagttttaaaatcaaactcttggattatggtgagggagagggtgcagctgagcggttcacttttctttttctgcttttgcccagttcacctaggaggatgaagacaaaggaggcaactagtctagctggctcctgcggatttctaatgtcatttcttccctgccacatcagtagtttcaggtcctccctaagaggggttacactgaggtttcaccaggctagttgacccagtacccccactgtgtcagagaggtacactgccctgacccacagctgtacccatcaagtcgtgctatactttcagtcggaatcactgccttttttttttttttgtaagtcgtgatctaccttttggcaagaaaagaaagtatttttaaaatcccatcttactcagcggccccagcccatgttccagggcagacaccctcaggaaattgtcacgactctacgtggaaagcacctaacacctgccaagcacctggagcctctcgaagatccaaggactcttcctggcttgaggcagcgtagccatatctcagtatgcgtttctccctttggggaagtaacccattctgccatcttctctaatttggaaaacactgagatgctttcaagcaactttgggatgctcagcaccttctgcagcagctgctcagcctctccaggcctgctgtagaagccttcatggagaaaaggagcaggatgccatgggcccacatgtggcaattcacatgaggtgtttgctctcagaagcagagcctgaagtttctaagccaaatgtgcttgatcgacagcatcaccctagcatgttgatttcctaaaatacacacactctcacttacccacaatcccacagtcagcctgggctatttaggtacagggttttctgcaccgtggcagttgaatatctgtaacccagagacagtaaaggagtttaatttttttccccccacaaactgtaggcaaatcttcactgccatttaaggtaactttctgcttgtttaagaatattccagctgtgtttatggtgttccaacattcccctgccaaaacccttgacaaatgaattggcaatattttcagggatgttggcaagtacagactggatttagctattaaatcctcattggtttttgtcatatctgatcagaatacaggaatgggcttttgactattaaaacatgtacacagtgcttgggaggctgatgcaggaggaccacttgagcctgggagttcaagaccagcctgggcaaacacagcgagatgctgtctcaaaacaacaacaacaagcatgtacacagaaatgaatcagttttcacacatttcagctctgcccacacagtacctaaacattcagatgtgtgggaactttggcgacatgcccccttgactccttactgcatttgccatcttgttccaaatacagacttccaatcttatctcagtgatgagattttgccagctattaagtaggtcctagtctgtacccagcctcgcatgccataaatgagtgatgtgtctgtgccagttttaaataaagtaactcagcatcagggatggcccatcagagtattaattcttatgccccaatattatattgatagcgtatgtttaacgttgctactgcttaaaagatacaaggaagattgactgcattaagatatttctttggctgactaggaacttataaacaagttttccataggttaaaatctcctttgtcctacacaagttatacttctttcacttgaagtatagtgggtactacacctttttcaaagaagtaacaaagaaaagcaagaggccctggcattgttcatgcttttaaaagtggctttactttttttttttttttttttttttttttggtgcagagcaagaattcatctagttctcagttctcttgcagctaagaaaaaaggtggaacacctgagttaagatatcctttcaattgaaatgacaagtgtaataggtgtgttccaaaatcttctctgtgacagggctacgtgctttccttagatcttgtctgtaggaggaaattactttcagaaacctttccccagtcaatcatttatctgttttagcagcaagaaggtaacctcactgaaatgagaggaatgcagctcctttcatttctgttagcaattcgtaacattctgaaagtagggataataaataattgcaaaggtaaattgcaggttggccaaatttacagttggatttttttttgctgctatatatgtggaggttttcagagagtaatatacatgttgtcttaccaaaactccctccccaccaaaaaagaaagaagtatggcttcattattttgatacctgtatattttccccccagccttgtttctccggcatttgggtcagtagccaaattgctgattgctgagacctgacattcaacagtctagaatagttaagggctgaccctacaggatcagagcagttgtcctgtaaagacccagtgaacaccaccgcacccagaagctcatttttagtagaaaggggacagttacaacccaggttatttctgtccaatggaaagccttctggttggcttgagagaaaaagccagcagccagtcttaacggtagggacttacatgatcctgtgttagtataaagccatacattggaggcctaatcctaaagccacccatgtgttttcagtggtgttgaaacaaaaactaaaaatctatccataggacttaccgtgacctcctgttttagagaaattacagtggttaacaagctaccattgcaagaaacagttgactctgaagttgcttgacttcatcccgagtgacacagagagtgacatttttcaacatgcactcccactttataaatgacactgtaatttttttctcaagtaattgaacacagcacacaatgcagaacttgacagaaacccctaaggagacagcttctgtcttactgcaccactgccaatagaattaaaaggttaaagaagtcctcagatgtgtcagatcatttttttgggtggggtaaggattatataattacaagcatcagtcatgtttttaattgcacggttgttagaggaaagggcaatgatttgagtttatagaaacagaattttattgttctattggtaatacttctcttctgaggcctgataattgctgtatctttctcactaagttactttaaaaagttctgcatatatgaaattgtggcaaatgcataaactgtgccttattgatttttgttgacattttacatgtttcttacgcatttttaccctccatttggaaactgtcagcttggcacatggtgctggataataagagcaaatgaagtgaatacagcaatcttcttgactattaaaaacagaattagcccaggctccgcttggtttcaaatctatctccaatagatgatttgccttttcctcccttgtagtttcaagataagaagtggaaaaataaaaatctcttagtgttatttcctctgttaataatgccagggatgatgaaaatgcttctgaagagatgttacttggaaacagatggtaaatttggactggatcacctcagagctcagcatcagtatggaagccagtggaggtcctgtcctctgtcccacacttacatcatctagctgcctcagagaaggccactaaattgctgttattgatgacaaaagctacagtcagtcttagtacaggtagcgtgttcagatagtaagcttcatcagctgccatgctgtcagagaaccacatgagacagctcagcattcaccgtgagctgaacttcattcaggcttcttcaagccagcttagccaggaggcgaatgtgagatgagtttctcatgtactgagagtttttgtgtgttaaaaattatagcatgatgcaaacaaaaaatgcattgacttattttcatgactggatgtcgttgtgctttgagggtaatgggcaggcattgctttctcttattgctgttggattaaaaggtgccgctacagtattgacttgataatctcaccaggtattcgtgcagagcaaaagaagaaaatatattttatggctcacaaattgatttacataaaccaaacaatctgctggttgtttgaatgcagaatattctattttgcttattggccacaggggcaacaatctcacatcgttgatgccagaattctgcttttcatgcattcactctgaaatgacaatagacgtcagcctctcagtgtttagatctgcttcatttggaaatcttttaagtagtaataataatgttttgaggaaattgagtggaacactaaattattctctgatacctaagttcaaactgtgcaaggctaaagaagctgaaaatcaatgcacttttaaagtcattagagatcataagtgaaataagtctgtgttgctttagctaaccttttagtgtgctgtggttttattataatatcagcctgaatctgcattaatttcacagtctttttctctaagaagcccaagggtgcatgatgaataaaatgtaaatttgagaaggcagtgtttttattagtgaaaagggcaatgagccatgtagttggagcagtgacctgcatggtggccaacgctggtgcaggaagcaggagcaggcactacagagtctagttattttacagcacaagaaaaaacaggcacggaaagtttcactggtctcccagcagatattcacagaagtgtacattgtcttgtgtatgttagaactaaggtcaaatctttgatacgtttcagaaattgacaagtctcaaaagtcttgaagattttatgcaaataaatgacaatgcacgttttttacattttatagcagtattgaatattctcggagtaatggagcatttgtttttattaaaattaaaaattgctaaatagtttgcaacagacttggtatatttgtatttgcatagcaacaatttatgtttatacatacatatatattttttaactacctggaagggatttagatacatttgtttgctgacattttgagctcttgaaatttatttgctcatttgcccttggtgtgaggattttcttatttgcccctttaaaaatcaatgataaaatttgaaatacaaagccctgatgtgtgaatgccctcagtaaagatcatcagtcaaggagaaaatggaaaatagcaactttttattttagaaaatgcaaactagatcttgctgatttcaaacccggtggctaaaaacagtacccaacttcctcccctagtttccatttaaaaaataaactaataaataaataaatctttctgctttggtcagattagcaagtcagcactgtgaataaaaagcaaaataagataaaaccagagagagaagttgttttatttttatgtactactgagaacagtgtcgtcttgtggcagttctcgtagactgtgttggtttaacaagcgtccaacccttttgtcttgttgttttttgtctttcctgctccctgtccccttgtttcccacaggctgtgcgtttgtcacattttctacaagggcaatggcacagaatgcaatcaaagccatgcatcagtctcagaccatggaggtactgtatcatctgccctttctttgttttctttgtgcaaatgatggggaatggtaaagcaattctctcctgtgtggattgttcacatgacaatcacagatgtaaactttcaccatctcagttttcattcattcattctcattctctccttctctctctctctctctttctctatgcatttttcccctaatgacttgaaatgcatttaggaaaaccttccacttgctctccagttatttatttgagccttttattgcagtggcacgggtcctgtgatgtaaagtcgtgagcactttaagcaaagtgtcattctggacctaaagaatcaaatacattccccacaccggggtcggtgcggatgaaacagtaacagcctcccaccccaaattactgcttgccctgtgctaagtcccagggttctttcgtttgtacagggtcaagttatcttccatctagtcaaacagcattgtgtttttacatcaagaatgttggagaaagttaatatttctcccactgcatttaacattgaaagtgcaaatttggaaaataggatttgtctccttccttaaaaagatgagcaataacaaagaaacataataaaggctcaaatgtggtctcctaatgagagatcatggctttaggggaaggtaaacaccctggtgtggatgcacacccacgaacctagatagatggctctgtacttttagtctgtgatttgggtcatggcctttcagaattttgcacaaaagcattccaagagtgatatgccgttacttcttctgtattgtctgatagaatcatttgggagtgcatgttctgctgtattatgtatactgtatctttgtgtatgggtgatcttttccggaggtggccttgtggtgttatctgaagctgtgttttcatattttgaaaaaagatattttcaattttatttaatatgcaaaaaacttttttcttgattgagcttctgttttccccccattttgttggggttttatttttttgtttgtttgtttttgtttgttttttgcaatgctgcatctcccaaagcatgctgggagctaagtgatcattatgcgtcatgttttgtgggcaactttttttatagtgaatcaaaaggtgggtgcaaaggggggaaggagtgtgcatggcattgtcattcagtgtttactgtacttttctgacttgtgataccagcattgcaaagcctattgtctttttcgaacattgatcttgactttgatattcctaacatatcttatataatcactgtgttttcctttcagtgcaatgcatttttaagacactcacaaccccctacctgaaggcaagctcaggtgaaaatcgggcatgataggcgataatgagcaggatttggaatgtctaggaagctaatcttgtctgacacgcagttacacgtgtgatggcgttttgcttccctctttctcttactgaggccgctccattcctgtggattagcctgatttccagccacattttaatcttcaattcagtttgaagattaaaatgaaactgctgttaggggcaaaaaaataaaaaagaaaactctttacttgtattatcttccatatacgcgtttcattcttatttttatttcttgtaatttagtgatgtgtacccaaattggtctcacctgagataattttgaacctcaattcttcagtgtttctgttagaaacattacgatccccattccttcccttggagcccccccagtaatgctcagagagccacggacaacccacgggagaccatgttcccctgtgttcctgtagaaggaggactctggatcataaagcagaactgggcatgaaccaggctgagaaacagtaggttcccatcatgtaaagagttggtttgaccactggggcatatttattcctaagcctttgatcctttattattaatatctctgttatttgaaaaccaaatttggtgtttaaaactggacattcatgcttacacagaggggtcctctgacacttaaatttcttgtttggttttttttttaattggcatttaaataggaggttatatattatgcagtcacattataattgtttgactaacgttgtttatttttaactaattatattatttccaggactctggcatacatctttaaccaagatgtattacctaattcacaatgatgtgaatgttgaaagaacaaggtcttaaaaacaattaattttatatcgtgccttctgtttctccacttgccttcactctatccctgccctgtgtttcatggtttaaaaaatcatttttaagctataatcattggcctaattttctgcttttatatcatttttactatttaaggaagaaaaaaatagatgttctgttaggagagatgctataatttgttatggaacaaatttgatggaacaatgacaacccttttccatgcaaaaccccctctctacataatcttcaaagtatgttgctctcttttaagtgaagtactgaaacatggaacagatacagaaaaaaatgaattacagatttttttaaatgatggaaatactatttttgtgcaatttactgacatttaacattctgtaccatgactctgtctaccagagctgaagaccagtaggctggaagtttaacactgaaatattcatctcatttttctcacttttttttattaacagacatgatatcctcatgtattcagaactgcatccccagtaactacccaaggtgataaggaaaaaaatgcgtttgttttccagaaaagagaaacatgacccaaagggaatggaacagagaatcacatttaaataggaatataacatttctgagaggagagagagagaggtctattatcatgctgagtttcaataaaagtttttattttaatcacttgggtagaattacttctttatgcctcagcaaaattgaacagctttaattgtgatgaaacgtgtaggcaagccacacaaaggaggagaagaggctggggaaggagggggagacttctgctgagttacttaccaagtggcaaatgttgcaaaggtgctttggaaaggaggtcttcgtgcttggggtgttaggcccttattatccctgatgattttatctagctcagtagtgaattctgtgacctttagccatttctttctcactacccctactccttgccttttaaaggaaattaaaactgaaagaagctgctagaatggtgagattcattagggaaagaagccaagtggactcctccgtctgctgttcacggtctatcttctttggctagaatgtgcttctgttttttgggtttgcaccagctccagggatggcgggtagcacaggtgtgctgagggaagaggcctctctgaaaacgtgaacggttactttggagaatgcctgtgttctctgaatatcttctgccctcatcctcaaaactaaaatgaagcccttttccctatgattgctgggccgataggattgtcacaatcccaaagttcacagatacataactgaaaacgggaaagagtaaaagataaatgaatgagagacatggccattcccgttacagattctcccctttgtcctctgtccacctgtggacacgggcagacacacaaagccaagtctgtctttaagacgagcagcctgagaagctcaattaaagaaccttggtaaggtctgttgtctgtaaggaggtcctgcaaggttgaaggaagacacaggaagagaaggagaggcagttactaatcagagcaagaaagcaagtgacttcaccgaccaccagatcccccaaagaaaccactggcagtgtctggaattttctgttgatggtactattcagagaagaaggaatatcaaaccgttttaaaccatttcagcccattccatgtgctccaggctagtgcagaaaggtagctccggtgctgagtgtcgtgagcggattccgccagcctgtaaccccctctccactttccaatgtgtctgaccacagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcggtaagtgctgggcaatgccggcgtggtcttcacccgctgaaactctgcaaactgacttttcccctccctacgctgaggcatttgttttcagtacattttcaatctcggggaattattgaaatcagcatttatgcaggatatttttccaagttagattgattctgttaagaacaggactaattgaattcctgcctgatgtaggaggggcaaagtcccacaggttaaacttctaactcgtctttgaaaggcaccccaaggccctgagttagaagacatgcagctgatgatgtaacgagagggaggccgctgggctggctcatccctgtcaggtcagggtctgcgccagcaggacctcaggtgaaatctcccagaacttccattccatgatcctggctcttcgcagtggaaccagattgatgaaatcaagtgtttcttacttcatctatttgaaaccaacaaaattctattctatttcaagccccagcagacccagttctctcagccattccttacatctcttggtgtctgaacttgagctttctggttgtttactcatgctctccatttcactttgtgtctttattgaaacacagtgaccagaatttaagacagtcccccgagcgagatctgaacaggacggagtagtaacctctagtgtggacttgagggcatctgaatggagcttgagagcggcgtttgtagtaaccatggcagatgcgggctggaaggcagccagtactccagagattttatttttactcgaattactgctaaattgtgctcttctaccctatttttccactttggaacataagtgctggacttcacatttattaatataatttcatattgtgagtttgggccttttattccagcctcagagagggtgtctctgtgtgtgtgtgtgtgtgtaccccatgtgtattgggtcttcattctgtcattttacattttaactatccctcttgtgatcctgtcacccattggctttactttgtagcagaagttgtgcttttgtgtcaaatgatcctccctattccaccttggaaggtgagatgatcctgcttttcggacatatgaggaaagggagactcaaagaggttacgtaacgttacccagaatcaaccagccgctagtggttgatgggacttgagccctgcgtgtcccgccggctggccatactgcctctttgaggactccgggtgctgctgcgggtcaccttcatctttttagctgccccacccccagtgcccagtgcccagtggggtctggtatataatagctcttcagtacatatttgatgaatgaatgagaagcatccttttcctgtcttcctctgtgctgctagcaaaagcattggctcaggttcccatcactttctgtccatttctctaccttgtccacgaagataccatgagagattttgtcagctgtcttgctaaaatctatatttgctctgctattattttcttgactaatcagtctaaaaattgctttaaaagagaaatgagtctagcttgactatgatttgtttttcacaaatgtgtgctgttcagatgctcacagtcgattggtttaattctgtgtaccagaatttttgtctgaggctgacatcacgctcaccttcctgtactttctaagagtccggcttcccccatccaccatttctgaaaactgagacacgtgtccactctgtcttctagcacgtctcctgtgcccccacggctcacagaaatctccggcacatgtttctgggaccacatctgcaaattgtttgtgtaggtgaaggagaggaaatctcagcctgatttatagaaacatgtttttagaagttctcactacgtttccctctgccatgggtgattctttcttggccatgtttgtcctactccctttcagctgaaaagccctttctctgaaagagcccttagctgccttgagtgatagattctgaccctggctcaccagaggttggttatccatggcaataatcctgggtggtggtttaatgacactccaggtatttccacttacctcagtaggtgctattaactcctctaaacatcttcaaggctagcttaatttttaaaatttaaaaacattgaatatgaggaggaagttgcagttgataagcgcaagagaatgagaaacccagcaaatcaaaccgaaataaggccttgctattacagtgggcagtccctagctttcccaccccctcttccccgctctcttcctctttctgtgtgcgtgagagtatgtgtgtgggcagggaatggagagggatgactgaacacagacttttcttggttttagtataacctgatagtgtgaagtcccataataccgtcgtacctgaggcttgggtttcagtcagccaagggtccccaacccctgggctgggtaccagtaccggtccatggcttgttaggaaccggaccgcccagcaggagaggagcggcaggcgagagagcgttactgcctgagccccacctcccgtcagatcagcggcagccttggaatctcctaggagcacgaacctggtctaaactgcacatgctgaagggtctaggttgcgtgctccttatgagaatctaattcccgatgaactgaggtggagcagtttcatctcaaaaccttcccctcaacccctggtctggtgggaaaattgtcttccacgaaacttctttccccggtgccaaaaaggttggggactgctggaatcagccactgatagttccacactgcttggcgctgttacctcaattgagatccattttcgagtcatatccatgtgtagggtttatcatatcaaactggaaagacctggacttccccagaggaacggtgttctggattgtttcacgagccccaaataaattctgaaagttttgtttttttgtttttttgttttttttgagacagagtcttgctctgttgcccaggttggagtgctgtggcaccatctctgctcactgcagcctccatctcccaggctcaagcaattctcatgcctcagcctcctaagaagctgagattacaggcatgtgccaccacacccggctaatttttgtaatttaactagagatgggggttttgccatgttggccaggctggtctcgaactcctaacctcaagtgatccccaccccccccccccaccttggcctcccaaagtcctgggattacagatgtgagccactgcacctggctctgaaagctgtttttaaaatagtgaattaatcttgttcctcctgagcacacaatgtgacaatatttcagtaataaaataaatgtggtaaatctgtgtttctggtatccatgtacatttgaatataggagaaaactatctgcttgcccacactgctaactgcatctgtactggtctcccttaccaaaaagaagatccataagttcagcccaacactcagtctttcacctaagttaagctgcggttcagctgagttggacaagtccagcagcaccccaggggctccatgcctttatcttgtggcacccactcattctgcatggcaggaaaaatgcagccctgaaagcactagtggaaaatgcagactttctcataggtatattaatgtttttgaagattgacatttacaacgcgtgacttcgatgtacatagcaccagatagttgtgagttttgacaagctgtatgtttcactctgcagtgaggacttttaaaatggctgcccatttgcttggtcatgtagtggtggctgcagctgtacggctgtgaatagatgcattcatgtttgtagttaccatgatgatctttatgttggcaccagagtcagtgaaccaatgtgcttctgatgaaagatgaagaaagctgaacggtgctggaaagtagaagagagggagggaatggaccctgattgacagagatgagttacggtaactgctagactacagagagagataattagtcacgctatgttggtttcaatagatctaacacctggttgttaaaaagagtaaattgattaattgttttaaggcagcagtgttagtgagtttccccagtgtttatgtttcttaatagagattggacatgaatatggatttacagccccagctctggggaccttcagtccatcagtagggagtagcaaccaaccctggaaatgcagagtaaactgaatttgtccccagtttaatgagggagttactttgctctcaccgtctccactttgcccttgtgtgttcatccgcagctcctgcagcaggccacctcctccagcaacctgggtgcgttcagcggcattcaacaaatggcaggtaagtcaggaagcacgcctctccttttgaccgtgctattgtcagaatttggggttggttccgagggcaaagacaagaagcaggggaagagaaccaagaatgatgatcagacttgttagctttctgtctttggtgttaacgttggaaccgcctgctctgaagtgtctctgttatttcttaggttacctacccaccttcgctgtgcatgaccgctatagaatgaaggggctgagaaatcctgattggcatctatatcaacaaatgattatatcaacgactctctagtcatttgttgtttttataaataagattgattactgggggctttccatccagattcctatatctagggcagccaaatgattgacagccctctaaaattttaataatagacagtcaataaaaatgttctgacctccgtaatgaaagccaggattgcaggcctatctttgatgcagtttgcagccccttgataacgacagacaattaacagggtgcctttttaccgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtgcagaatgaagcgttttttcgttgtcatcatgaaaactcctttttttctacctttctgtttctttttttaaatatgtatccttggggtttgtttattttttttttcttgtttcacttcaaatgaatctggaaaaactttccagggggcttctccctgggtgtggtgtgtgatcggcagccccgccgttgtggcccgaggctcctggaagctcatcagctgatggtcttccttggcctgtagtaaaaatactgctgaattcctcgttgggctttaaatccattggcactgccacctggttccgttgtaacatagcttttggattattagaaataggaataacttgatagttaaatcattcagcagcatctttacgaatatggtttgggaagctggccttggagctaagaatcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgctctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccgaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaagaaagagaaattttagacgactggatcctaagtagttgcatgtataaaattgaatgagacgtcagctatacttcctttcccaaaaaatcttaccattttcccttcaaactaaaaataacttcaagtgtgctttatggtttttatccaagagaacctttatgaaatatggaatttagaagcagaaaatggattaggaacatacctttataaattgacggcttttatatctactttttgtgcctccttggagttggttggtttttattttccctcttaaaacttctaatgaaaacttgtccatttctctctcagcggtgatatttgttcagtgaatttcagaaatctcagaaacttggggtctgagtttgggctgagagctgggatttttcttgaaagagaaagggagtaagagaaagtgtcttctctgcctttaatttgtttataacaactatcaactcagaagatcatataacagaaaaacaaggggtagtgttttaccattttgtttttaacaaagctccttttaaaaatcatgcagctgtcctcatagcaagctaaggacgtgactaccactttgttactacattacggttggaaaaagggaagatgaaaaggttcagtgagtaatgtgagaccacagcactagtcaatgacctaacaaggattagggtatagaattcccaaatatcacaacaacctgatgaagtagggactctaagttagcccaccgcatggccgggcaactgaggcttagagagatgagcagacttgtccaaaggcactaagctagtaggtggcaggaccaagcttcaggtccggctcactgatgcaaacccaggctggcaaaccgtgctctgtgtctcagccccttgaggtgtgtttcacggcccccacactgttaggaagcacttcagaggtggtaacaggaaagctgcctcccttcatcctggaaaacatctcaagtttatcatgagtgagtttttctttttaggggggatttttttctaggataaagaattgttactaaaccagttccagaggttctgaagctgcggcggaagtgtcttttgatgaacgggaggaaactgcttcgtttcaattctgattctgagtaaagcaagtagtaattcccttccagaatatctggtctaagttttgaaggtaacaataacattatggagtgcaaatatttgcttaaaaccatgaagcagctcttcatttatcaacttgagatctgttctcttagaagactgtcttggtgtctagcacgagtggagaggagggagacatttgcaaaaacagtgtatcggaggtctgagaatgtcgaattggaggcgctcccggagtggtgaagtgtgcttggtacatccacaaagactcacgcagaacttggttcctccccaagctgagtctccagcagtccacactgcaggccttatgagaacgttctataaccacccatctgtcactttttaacagacctgattggcaagcacttgtaacaactgacatctgttcatgcttattgatatgcagatttatggtaattgctatgaacaataagacacaaaattacctaaggtgaacattaaattaaattttcatgcccttctccttataaataattttttttaaatcttaagtttcaagtaggcatattgcgcatctgtttggtacataatttcttcgttttgagaaggatatttttccccaagtattgaatgaaagttgaatccctgtattctcaactttctttgccatcttcttagcccatcgttgagttcctaaaacttactgaaatgttttgcatgttcagtcacccagtttattgcccctggttcgagaggtgcccatctgagcagagtgcttcatgaagtcaaatgcagtttttcttctcggaaaggaaccgtttgccaagcacgcgcccttgcctctcggtctggtgccctttcaggatgagcgtgtgggataaagtgtgacttggggtgcagactgaggaggcgcctgggagaggggctgagatggggaaaggacggggcacccacatacctcagaaaagagagagcgacagaggggaaccagaaagaggacttccggatgagcggaagtgaagcccgctgttagttctggggaggaataaggggagttgcaggagaggccccgcgccccatccaggagcaggcctgcgcctgacacctgtgcccgagaagcctagtccggctaagaagggagagggaacctctgtcctcacccagatgccctggctggtgtccgcacatcaggccagtgcctttccccaaaaccgtttctcccccgcataggaggggaaggcaggcaggtgcgatgtccacgttccgggtgatggcgctgtggctgtggatccatctgtggtgggaggagccaagacatcagccaccagggacgtgcatcgttgccagggaagggcccaggaacactggggccaagacagtccccacgctcttctcgccccgggttattactgtggtgtgacagagcatgagatggtcagtagcacctagaagatcggtaggtgcagggatgtccatggggcaggatggacagaggacacatgggccacggcctctgcctggctgagtggacagaggccgctctgggtgggggaaacggtgccctcactgccctccagcctcagtcctggttggagtgagatgcccaagaggcaggggaggtcctagggctctgaagggctgctctctagggcttcctggcgccagcctccactgggtccttccccattgacacctgtgcccaggaaggtagctaagaatggaggagctcgggctcgcctggctgcttctgatgctggcgtgcgtgtgcatgcctgtgtgcgtgtgtgtgtgtgtgtgtgtgtgtgtgtgtgttcagaatgggaggaggcactgtcttcatcctccctcttctccgtgtcctcactcctcagctctcatttcttcctgatggcccaagtcactgccccacccccaggctgtcatgcagtgattttccactaccacttgtatctctttcagattgtcaaaagaggtcagaagttcttcagctttttaggagctgtcaccaaacacattttgcatgcacatcacacacatactttttcataaaatgtcagagtttgtggagaccctgaaccctgtcagggacctctgcctcagaagcaccaagttcaggggactgacgtggggtagatgaagaacacgacgaagagcactgaggcagcggcggacgagggtctgtctggtcactgaagcagctagagccagtggtttgtggtatctgggattctggggatggatgcagaaggaaatcacgttaagaaactaggccaggtgtggcggctcacacttgtagtcccagcactttgggaggcagaagcaggcaaggatcacttgagccccggagttcccgaccagcctgagcaacacagcaaaacccctttcctacaaaagttagctgggtgtggtggcaagcgcctgtagtcccagctactcaggaggctgaggtaggaggatcgcttgagcctgggagatgatggctgcagtgagccataatttcactccagcccggtgacggagcaagaccctgtctcaaaaaatatatatgtatgttaattgccaaattgattgagagagcaaaacgtagtacatagttaagtagttagtggttaactggttaacctagttcttagttacaaatgaagacacgatcacaagttcattcccagacctctggcattcaggcgagttgcacaaaattcgtactggccccaatgttcttggaccctggggcagggagcggcacttcatggtgaagcagcgctagactggaatccgccccagctctcacatctgttcatactgttgtggtggggcgagcaaggccactcccagtggatatggggacctggggggtagagttaacttctgggcccctgtcacattgcctttcgaaaccctatgctggaccagccctttccttcctcttcctcccctccatccgtccctccctatccctccctccctatcccttctaaacttctctcagatgcaaagtttaaggaaggaaatggataccaatgcacaggaggagaaggaagaggtcagaacagctccagatggggaccgagagggcagagggcagcccgtgggtaggccaggctggcagggagaggacaggcacccagggaaggggcggggctctctcagggagtggcccttggagaatggctcatggtgttttcacctcttcatgcccgtttcctctgtaacatgtaggagagtcacaatgcccacaccacgtggatgtgttaggaaccctagtagcagagcacgggtaaggcactgaggagcttgcctggcacgcgctttgttcttgcttctgctgtcattgtcgtttaggacagtattattgcagttattagtctgagagcttcttttttgagcttaactctgcactaggcattgtttgagctttctatgtgttgacccatttaatctcttaatcctcaagaggtgagttctacttcagtcgcactttacacttgaaaaccccaaggtgcaaacaggtaacgagcttgctccaggtaacaggctgccagtaagtgaggcagagccagctttcagcccgggtcatgtgagagcaggacctgagctcttgctgaccagcctgcgctgccttcgggaggtggtggtgattgctgctgttatccctggtgtcaccagtggagcttgtgttccaagaaacgtgaggccctgcctcacctctggtgtacaagcacttaacttcttttctctttaagacatggggtctcactctgttgcccaggctggacttgaactcctgggcccaagcgatcctttagcctcagcctcctgagtagctggaactataggcacacgctaccacacctggcttatgagcacgcacttctgaaaataagagttgggaggaccatgaaagcctcatgggtcagcacacaaggactaggagagggacaggctggaagggatgacatctcttgcagcttctcagctgggctgtgctttgctttcctgtgcttctctaccatccccatcgaatcaaagacttcagggaggatttcattctgaatctgggcctatttcaagaaactgatgaactggtgggatttcttccccactccctgacatctccctgctctgatatccagcaatctgctcgggtacacagactatcatgttttctactttatcctcagtgtgttgcacagggtctagcccatcatggccactcagtaattactggatggttggatggatggatgatgggtagatagatggatgggtgagtagatgatgggtgagtgagtgggtggataatggatggatgggtgataatggatggatgatgaatggatagatgggtggatgatgggtgggtgggtagatggatgggtgactagatgatggatgggggctgaatgatggatgggtgggtgggtggatgcatggttgatggacgatgggtggataatgggtgggtggatgatggatggatggatgggtgggtcaaatatgtcctggagggggactccctggcctgagcctagaatggtggctctgcttgtcattaatcagtgccagatcatagatggatgtggggtagatgatgagtggatgggtggatggtgggtggatgatggatggagtggatgagggatgagtgtgtggtgggtggatgatggatggaggggtgggtggatgatggatgactgtgtggtaggtggatgatggatgagtgtgtggtgggtggatgagggatgagtgtgtggtgggtggatgacggatgagtgtgtggtgagtggatgagggatgagtgtgtggtgggtggatgatggatgagtgtgtggtgagtggatgagggatgagtgtgtggtgggtggatgatggatggaggagtgggtggatgatggatgactgtgtggtaggtggatgatggatgagtgtgtggtgggtggatgagggatgagtgcgtggtgggtggatgagggatgagtgcgtggtgggtgggtgagggatgagtgtgtggtgggtggatgagggatggaggggtgggtggatgatggatgactgtgtggtaggtggatgcatggatgagtgtcgtggtgggtggctgagggatgagtgtgtggtgggtggatgatggatgagtgtgtggtgagtggatgagggatgagtgtgtggtgggtggatgacggaggggtgggtggatgatggatgactgtgtggtaggtggatgatggatgagtgtgtggtgggtggatgagggatgagtgtgtggtgggtggatgagggatgagtgtgtggtgggggatgagggatgagtgtgtggtgggtggatgagggatgagtgggagcatgatggacggaggggtgggtggatgatggatggatggtgggtgaatgatggatagatagatggatgggtgggaggatccataccacaatgagggatggatgggtgtgctgatgaaggatgtgtgagtgtgtggatgatggatgagtggatgatggatggatgggtgagaggataatggatggatgggtgggtggatggatagatagttgggtagatatgtgggtggatggatggatggtggatggatggtgggcggatgatggatggatgggtgggagaataatggatggatgggtggatgataggtgagtggatggatggatagttgggtagatgtgtgggtggatgggtggatggttggatggtggttagatgatggatagatgggtgggagcatctattccacaatgagggatggatgagtgtgtggatgagagatggatgtgtggatgacggatgggtgggaggatagtggatctgtggatggataattaagtggatggatggatagttgggtggttacgcggaatgatggatggatggatgggtgggtgggtggatgggcggatgatggatatatggatggatggttggatggatggatgggcagatagatggacgagcaaatatggatccgcctccttgattggttctgactaactcttcttctctccttttgtcctcacatccctcagatgctggggatcacagtgtcctctcctttccactcttcatctcagcttccttgactcatagtttttcctttccttgcagtctggctgttgagcagtgttagctatgcccccgtgtggtgcctcagagactcagccactccccctggactttccaggcggcagcagggaaaggcttaggagaatgtcagaaactgttggatggtaaagtgtgtggaggagaaatgaagaggaggacacccaggcccttagccctggatcctaaaggagcgggcagtggagagaacctgagtgctgtcagctcagttccaggacctttagtgaatgtcagtgggtgagagaaggactaaacatgggccctagtaagtatctgtacagtggattagttaatgattgagaggaaacagccaatatttgatgctgttgtaaataccaaagaactaataaataatggggaaaactaaaaccttggctagctctgtacagacaatactcttcagagcaatttatgtaaatgtcaaacttgtctgttaccctgtttgtttgtcttacatagatttgctcatcacctactatatatattggtgtgtgtgtgtgtgtgtgtgtgtgtgtgtgtgtgtgtgtgtgtgtgtgtgtttttacatggacttgaaaatgagtaagacataatttttgtcctaaaggaacttggtatctggttgggagggcaagaaatacatataaataatgtcaacatagggtatgatgagagccacgaaagagttataaacaaacagataaagaaatttgcagctaacagagaaagcgtgtgcattaaatgtaaaccctgtctccttaggaggaggctatgggatggggcagaaggctctgccaaggcccaggagggtctcctccatggctgtgaggccttggccagggacctcatgtctctgacccaagtgggccagctgagccaggccatcaacacagctccatcactgaggctcctacctgggagggtcatatatgtcctggagggggacccgctggcctaagcctagaatggtggctctgcctgtcattaatcggtgccatatgcatattgtaggctttgattttggtgctaagccctgttcttgtgtgctcagccatatgttggtggtgtggtctggtcatggttcacgttagaggaagcacacatcatgagagagcccagagggcatggacagacctgcgtgaatgtacctcattccttgcaagacctcgcacagccttggtgctccctcacactcaagtcaaacatgcattcatgtgtttgtaggaaacagccccttgctggggccatgttggtctgcagtagggccaggcaatttgcatatttcctccattttcctaaagtaaaactgaaaaatgagaccagggcctctcaacacccacgttctcatgaatatggcactgtgtgacccttgacgagagaaaaccagagagtgctttcttttgattatgttcacttgatgaagcaaggttgccagaagtctgcccttttcttgcagaaattcacaggattacacaatacttctgtcccactttcaagcatccctgtgaaataagtaggttttgaaaagcaggtgcttggctttcaacctaagccaaaaggtctggatgtctcctggaagaagacagagtatcactttggacaaaatgcaaatccatttagcaaccaagacaggaggaacttttttctaagtggaaatgcaccctggttgaggaggccagggcagaagagtgctgtctagagcactcagcagccaggcactgagctgcgcccgtggctgggggcttacacatgtatgttgctagaacattctctcatccctccaccagcgcccctacacacacattacggaagcagctctcagggcactctccctaaagaagactgaatttgctccgtagatattgattaagtatctggacttaagaccagagaagaaggtaaaatgaagctgaagtccaccatctttctatcttcagttcctctgtgtagggagagaaccattgtttcatgcttctcacatgtgcagtcttctggtaaagtgaatcatagaaacataatttgaccattcagagaacctttggactgagagatggaagcgggctacagggagaaaagatagttaaactaactatccggtgtagacaccagggctgagcccacccctagattgttgccccaaatctctcagctaatcccactcttatcttcatgctaattttcatttctatttttttcataattttcatgagtcacacatttattctagttaaagtccctcttttaaaatataaatcgctttaaaaggtaaatacaaatattttacaaataaaactattaaggtgcagccatttctattcagtcattcttgtgttcatcaaatatgaaatttgaactccctatggacacattttagggttcacacttgaatccagagagagaagttcaatggcaatagcaataacaaaaataaaaggtgacattcattgagctcttaacgttgtgccaaagtaatttgctttcatcatcttatttaatctgcacaacaacccttcaaggtggggttcagttaatgctgccattcactgtcaagaaatagattaacaggcttagaacccataccagttcagcttccagtaaaatgtagtttcttctgaaatacctcgttttgagggactgagtttaccttgaagcccttcctccagctgctgccacatctcaccatgtcttggcagctatgtcatagaagctgccagtccacaaggccctactgtggccagtcagcactgaaatctctcctcttttccacttatctctacagcatggcaggaaggccttgggctgagaatactggttagcgagggagaagcgcaggctctgccagggagaactacggggtgggattcaggctcctttctgggtatgtggtctctaggaagagcaattgcatcagagagaactgaaggagaggtggccttggaggagagggctggagagcccagctcccacccaggcaggtgaccttgcacagggtcgtctgctctcatcatgtgtcctgacgatttgatgagcctgctcttgtttggaaactgtagaagtgtgaggcctgttgctgaaagtaactttctcttccctccacaggcatgaatgctttacagttgcagaacctggcgacgctggctgctgctgcagctgcggcccagacctcagccaccagcaccaatgcaaaccctctctctaccacgagcagcgccctgggagccctcacgagtcccggtgagtgtggggggtgctcttcccttgcaggtgatgcagcaggagtggcaggtaggtttccgtgcctccaggtgcgagggtgaggctagacgtgtccaggatggagccgggatactatactgggctgctttatgtcattgggttattttatttttaaaaatggtcaaagttcgaatttgtcttttattttccatggataatatgcaaaaaagttttcagtgagaatccactgtgcaagccgttctcacacattcactctgttttaaacactagtccattcaacactagttaagttgttaccactgtgaagagcctccgtctcttagtctttctttgtcctgcccttttccaaaaaataagacaatgtaagaattctgtttcaaaattcctagtcattcccatgtcacatttcacagcaactccatccatcacatttgattttaaaatccacggtccagtaaggaacatgtttgctcatttctggtcaggctctggggtgtgtcatttaaagtctttttttcttcacaaattttgttgccttgttgttcaaaagcagatgccagttgtcttttcatacaagccagatagaatgtggttgcttagataccgtgatttgaggttttgttttgtttttttttaatttaaaaaagtcgaacgtttcactggctttccatctctgagttttccagacctcaatagatggtctcacctccttttctgttacatgaaggagatggcctggacagtttccaagcttccttctaactttcaaaatcccatgaccccctatcagctgcgccccaaggattagctaagtgttggaaaaacgttaatgaaaaaatagcttcaggaaacacacatcgaaaactacagcccactccacgctggctgttttagggcttttgacttgagggaggaatgaggcaggttcctagagctggcagttctcaaaagagcagttgccctttgtctctgcataaaacattgtgtatctaagacatttcacctgggggattgtttcgagggagaagtctgagagatgtttaggagaagctggtggatttccctgtaatgtgctgagatcgcatggcaggtgtattgacttcactgtgtacagtgtcttcaaaaacataccgttactgtatgagggccttatctaatataataaacactattcctgaaaaatcaactttgtcacccttaatttcaggaagttaagtgatagcttcagtgcaacacatcaacttacttaagtaaatcctgtaacgatcccttttgagaaataaacatttttaacatgatagatttccccttcataaaaataagtcatttttttaaaaacatgaaaattagaccctcccaacttagatttcacaaatcagattaaaatgtattttcttaagagggattttttttctcccctgtgagcactttgattaccccaaaatagcactgagtattgtgaatgcattttggagcatcttcagtccaaaggaggcttgacagtttaagaagccaaatgcagaagcagctgtcggctgattggtgtagctaagataactcaaaaatcatatcccaaaagcgctttgtggtgtgagcaggacagatgtgctgcctaccttcgggagtccttcagtccttcagggacttggacaagaagcaaagcaatgagtgtcagatctgtgacagaatcccactgaacaaggggaaaggggactggaggaggtgacccctctctcaaaaggtgacctttgagcagagacctgagttccgtgacggaagccatggcgcgtgttgaggcagaggacagagccagtgggtgggggagagcggagtgggggctctgtggtggaccgcgtccgttccagcccacgttgggaggagtgtgagcttgttgcaaccttcttaaaatgtgggctactggagatcatgccactgcactccagcctgggcgacgagcgagactccgtctaaaaaaaaaaaaaaaatgtgggccactcagacggtctagggcgacggcctaggtgttagtcggaaaggaattttaaatgtatgtgactattttcaatttcttcctgagactgcagtggaggaaaatgtgttgtgggatgagccttcctccctgctggagtcaaaaccacaccagcgcagcgtccttgccttgactgctctgtaagaggcttcttgcccttcagaacacgccgctcgcttaggtgtcactgagagcgatttttctcttctctactgaggaatgctttgcataataactgaaagtattttattagaatcctaaagtgtagcagcagcaatgattgaaatctacatttcaattatttttcttaagtgtaactaaaaaatctgatgtttaagtgaaagtaaattatttgtctaatttccatcagggactttttgaaagtcacagaaaatgtggttagtagaattcatgaatctccacttcatcaaggcagtttcctagaagataaaaggggttgaaagccattcccaaggccattgccattatttactttttaaataataataaactgggcatactatttggaccatgagccagttcacttgccctgtgagttgaagggaagcctcatcccatctctcctccacaggcctggggtttaccctgtttttaagcgtgtctcttaagcttcagacaaattcatctggaaagcaaagggacaattcaatcccccaaactgttaatttttttaataattgtaaatttatcatttcaattttgcatacccaggaaaagtctccctacagcattattataaatgattttaaacagtcttggctttaaaacatgaaagattaagtcttaatttttgttaaaaaaaaatcccctcaggcaataaataggttcctttgtctcatggccttgaaataaaaattaaaatagtttaaattgcccatggttaaaataagtgtttcgtgcaattatcagatggtagtgaataaaattagaaattaaatcatgaaagaataaaatccaggtaagtgcatattatgccttttatgagtttctcacgggtcttttgaagcctaatttaatcatgtttcttgtcttttattttgatatgatcattttacctgtgtttaccccagtctcctatttagttaattaattcttgggtcatttattgttacccagtttttaacctgtttttgacgactgtgtctctgtttatgcaagaggcaaattgtctagaaggggtgtagctaggtattaaagaagataatgtttgtcttccattcagcttgcaaatgagttagttttgtctggtaattttgagcgcttgaagagactgttactgttaccacacatgaatattttttggtattttttggtctaaaatgtattgcattcacgtaccatgttattccactgaacttcttctgtcttcttctttaaagaaaaggatgctttaaaattctccaaatgcttctgtaagtgcagacttgaccaagtacacatccaggatcatagactggttcttcccatggtacaaggcattctaaaatgctaggaagcattttttcattcccaccattgacccttcaaagagttatcactttgaattctgggtggtattttccccatcttcaaggtatccccagcttccttgaaggctgtgacaaacaccaagcttcaaggaaatggtgacacttcctctttgactatctgagggtaacagagattggagtgtttggacgttgttcaggcattccctgctcgcctcacatagtcatgactgatagacggtgactgttgttcttgcacacctgtgtcaccaaagcagctgaatgagcagtgggaaatgagaattcacccttgaagttatcctgtggcctttccattgacagggggctttgtcgccaccttcaatagatgtctgcatttgcatcagaggagaacttgcattaggcaaagaggtgtgatgcataagctggtttaacccacatttctgagccttctagttcatgcagggcaaatacataaaaatgagttggggcctgcactgccccctccaagtggtgacatgcacgaggcagtatcaccagatgggaaagagtggggcaggagagagggacagacaggtggacaaagaggctgtctccccaagactactgcagtggtcccacatcctcagagtcgagaattaaacttgccccacagacctgcccttcccgctgcctgccccaccctgctaaatggattgtcccaatggctggtgtgacttggtcgctgatctttgcagctggcccctggctcagctgcgtgcctcatcagcccctcagttctccctgtgaagcatcatttccctcccaggcaacaggagcctggaagagacccttgtcttctctctccttgtactactggaacagcctccaacttggccccttccctctgtctgtcttacacactgttggcaactgcggtctagactggagtgaaacaaactcctgagtgtggcattcagggtccacctggaccacctccgcccttccatccagaatccagccagcacacactcgcccagatcaggccaccccccgtagcccagccacgccgtcggcctttacgccattattcttgcaagcttctctacctagaacatctcccccatttcctcccacaaaaatctaatacatcactaatacttgttgcagtgctcattcttgagaatagtgtgggtgggtataaaagcgtttctaatgcacattataaaaagtatagtttatgctgcttctgtaatttacactataagaagatttttggcggtaattagtaaaaactgttttcagtaacctactacttatatgaatcaatgcaaatgccacctctaccatgaagccttctagttaggattgatcacttccacatcgtattgctgagtaagttcctagctcattctagacctggggcagtgcagaggttcctgaggagctgtcgggctgcttgaggccaggggcagagagggctggagtgtcagtgctggccaggcgttctgcagacgtcacccctctcctgtgctcccagggcacactcggcctcccttcactaacactgaccctgttgtctgcaggacggtgatgtgggcactcactttgtgtcttgccctctagccagtgagttattttaaagtagggaaggtgtgttatttactcataattcccccttgcatctggagcagcacatcagacacaggccctcaagtgttgtttgtttttttttaaattcagtggaatagcgaagcaaaaattgtcaaagacaaatgtttaagggccatctgttcagtctagtttagcgcacacgtctctaaggaggcagctaaatccctcacagtgacgttggcagggtcagcgtacccacccagttcacctgtaaggcgtgcctctgcctggatccctcaagaaccaaacctgcaatttggtttcaccttacaggtgaatactcaggtccaacaggtttctgaagaataaatcagtactaacttacaccaaaacaatcatatgaagcagtctttttattacaggggcagcttattttacaaatagtggctttcaaaatgttctgatgtcacgatatagaataagtacgagtctggtatcagagaagggcatttcaccttcagaagaaccacctactctaatgtgtgcttttgaaacataacatcatggcagatcatccccagaaagtgcccattagctctgtgtgcactgctaagtccacgtagtcttccggtgcctgcccacactgcttacataagcaaggtcccattttgctttttagagtattttttacttataccacacttataaaacacagggcattttataagtgcaggggaccagttattcctgggaagatgggcttagcctttaccgtcctctttttcttcttacacccatcttttgtcattgtttattcttaagagaaagaaggaaatctcaaggtagaccattcttccctccactagcggctaagtgtctcagtcaggcagagtcaagccagttggtaaaatgggctgttcatgtgtgggtttcaatctgtcacacggccaggcgcagtggctcacgcctgtaatcccaacactttgggaggccgaggcgggtggatcacgaggtcaggagttcaagaccagcctgggcaagatggtgaaacccagtctcgactaaaactacagaaattagccaggcgcagtggcaggtgccagtaatcccagctactcgggaggctgaggcaggagaatcacttgaatccaggcggcagaggctgcagtgaccaagatcacaccactgcactccagcctgggcaacagagtgaggctctttctcaacaacaacaacaacaaatctgtcaaacgtcttttcattttttattttagctttcctatggtgctgacagtcaaacttgtttacactcttattgctgcagtagaaagagcactgacctcccggtctttgctcatttcctgcaagtttcaacattttacactgcttttctgaaaattgtcttctttgctcgtgacattatggggctcactttattttcattaatgttaatggagtcacacattacataacatgttctgtaaataaaatgactctgtagtgactgtcacctcttgatagattttttttttcattcattcaacaaatatgtatcaagcatctgtgtgcctggaactgttccagcactggagacacatcagtagacaaagctgatgaagattcctacctgcatgtcctttctcttctagcatcagcttttaagaaaagcgtcattttactgaattcacaccatggtaaaaacaatttgaatagcctttaagtataaattgtaacttctacactcttaaaacgtcataaccaatattttgtatatcttacgttaaattttgtgaatgagaccaagagtgggagagggaagctctcttctctcctttcttcctctcctttgagctgtaccatctttctgtgtgtttggtgcagcagagagctgggagtagggccccccttaaggtagaactgcaagtggccaaaccagaaagcgagagggtttagcccttggccctgctgctcgggctgctctgtggcttctccacagaagcatgacacacaaaccaggtggtttgaaagttcttcggcatgtaagactgatactgttggggagaacagtagttggaaacagtgtgtctgcctagtaaatgtcctttatttggcattgatcatcctgcttctaaaggaggagagagcatgcaaacccctcccacccagaggggttttgagggccccttgtgtggagggagtttgggtgtgcaatgaacttctgcctagtgagtggatggatactccaggcagttggtgcaatgccccaacctggagcaggctggagtctcttaatagtctgtaaccaatttaaagcttaataaagctgcgcagctttgggggtagagatatttacggttcaccacagagcccacgctgggatttatgcaagtagattccacctgtgccctgagctctccttggcgggtgccttcatccccgggatggacagatcctcgcgtgcatcttagggctgccactcaccaagcgcattgttccttgttttgagtgggctttttaacatgtgcagacattgactctaattcttcacgtatttgctttttgctgttggtggcgctggactctgtgctaagtgtgatttgtttttaaatattgctttgcacactcttctgtattgtggcaaatccacatcagatccccttgtgatgtttatatgagctcaggctgtgttttctgtccagccacttaatgagattttttattctcactaaatcacagaaatttttatttctgtgatcttgtatgatacaaacatgttatcaccactagcactggtgaaaagcatgtgttgcttaattgtgttatattaggtgggaaaatcagcaaagctttattctagtcacaacttcccagaagcgtatactgtaagttccatttcttcagacttgaaagcaataaaatggaaatttttagttcagatgtggtttaatcccgagaacccgtcaccatcaactagatgcattggccacctacaaacacaagcaaaatgtaccgacctgtacagcacagacagcaggaaggcaggtaaggtacaggggtcagtgacaggagagattctgccccaaggaagtaagggaaattttagtagaagagttgacatttgagccaaaatgttcagggtgggtaggatgtttaaaagtagaagcagaatggaagatacatcaaatgtgggaaaatgcagaaatagcatttaatcagcaaatggaagttcatctcacttttcacaagcatggacatatggaaaaggatgcccaccggggaccctgagagccggggctcaggagctgggacttttcctgtcagcagtgaagagctattcaggactttaggcccaagaatgatagacttcctgtgtgactggactgaggcacccatttgatgtgagggagaacaaaaggaaaggaggaaaaatgatatggtgtgttgggcctgggtggccagtggagcattgctctcagttgtgaggggagttgaggaggaagctgtcatataaaatgatcggacgtggcacatggagagctcaagtgcacatgaacggacattccgtgaaatgtgtccagcagcagttggatgtgtgaccatcaggctgaccagagccgggagctgcagagtggattgagactgacctgcagaggccaggcgggctgccctaagcccggggaggggtgaggtcatcaggccaaaatcaccagcaaggcaaggcggggaccaggtgcagaaagccttggggtctgtgcttgtggaacagagggaccaggggatggaaagggagctttctgggtagcacagtgtcaggggagccaagcaggatggggctggaggaggaaaaggcagaaagagctgactgaagtttgagttggggagtgggttctccccagactggctgcttcactgcagtggttgacagttttgcaggcagtgagagaggacacaattctatatgacatgttcatgaaatgtgaatatttttaaaaatctgtaatggggccagtcatggcagttcacacctgtaatcccagcactttgggaggctgaggcaggagttccttgaggaactccctgaggccaggagtttgagaccagcctggccaacatggtgaaaccctgtctatactaaaaatacaaaaattagccgggtatggtggtgcacacctgtggttcccagctactcgggaggctgaggcaggaaaatgacttgaacccaggaggcagaggttgcagtgagccgagatcacgtcactgcactccagcccaggtgacaagagcaaggctctatcttaaaaaacaaaagaacatgaaaaatctgtaaaagtactggggtcactaggggaagaagtttttatgtttttgttttaagatggagaaacaaaacatatctgtagaccaaagagaagagccagaacaaagggaaacaggaataggccaatgagagctgaaagctggactagagttggagggctggctggagggatgagctcagcctccagcgtgtccctctcctgtggcgagggggatgctgccttctgagggtcgggtcacatgtcatctccccctgggaggagcccccacagcagcaccctggccttgtggtgccatctcgacctggtactagcacacaagccaacaggcacaaatctgaatcagggctgagtcagcaggtggtgcagcctgagggagggaacactgacctctgtcaggattggggaggatgccaagaatttaggacagaagggtacttatatcacatatgggccaagaattgatatatctggggctagaaacaaaaactcatgccggggcagaggtttaagaaaaagtcaacctacagaatgtaacagaggatttctaattatatttgtctttctagagtatgtagacatcttgatcaagagtcattggagcaagtaatgtaatcttaattattttctcagttgtgaaatagaattaattgctaatactcacttttcttgtggaaacattgaggtttatatatacacacatatttatatttatgtaaatgtatactggtgcttttttaaaaaaacgatgtttaagtatcatatatgggaaagatcgaatcattattttggagtgatacgaaataccacagctctggagaacagaagactaggttaaaactagaatgagggctgatgatgtttaggttaaaactagaataaggtccgatgatgtttaactgggttaaaactagaataaggtccaatgatatttttctctgaatctcttgcctttggaaaacaagtatctccccacctttcctttaaaaattaggatgtaaatacagggagaagacagtttcctcactcctttctgcttttgtgttctgctgttcaagggaacggggaactttctacctaccacaaatgccacttgagctcctagaaccaatatcccctccttaccaaatacaaaatggtaagactgggttaaacagagcaagactgctgtgtccaggcaggatttctgcactaagggtcaggcctgaggcccctggggagttgttggtttgtatctcgggccacacggcgggtggtgcgtgctctgcaccgggcccttgcaggggcagcagtcctactgagtccacgcggcgccccagcgagcctgcagccctgctgtgacgtccctgggctgcgccaggtgacctcttgccccctgctaccattggggtcatgttgcccagaggaaaatctgcctcccagaaatgatgttctctccatctggacaagctgccccccaaccccccccaggaaggccagacttcagacaggctgtcagtgacatggtgacatgggcctgctttcctgagaagcccctgtccttgccctttctcttcagaggcccgagcccggtcccatcattaaatgctacagctgctgttatgtatccaactgcctcttttgtgatccacgtgaggaaaacagaggcctgcaagggtcagtggtttgcccgggatgttagtgacaggtgaaatgacagcgccaccgcaccacgagacagtccatattctaagcaggaactcctgggatcccagaaccgtatttctgggtttcgccaattacacattgtcccccttgtaaggagatcatcaacattttttttttcggtccttctccgggccatctgtaaaaacaaacatctggggccagctaaaggggaagtatatacttttgtttcagtaaatcataagcaaaatatcattggcagggaaaagaggtttgatttttccctctcatttgccccgctcgtaggagatccctgtgtactgcctgtatgaatggactcttccaaactcatggccccacactgcctttatgagtgcccgtcttcacgggactggggaagatgctaaaaattaggccgggtagggaggcaccctggtttattgacaacccatgaagtagatttcttagatccactagacagagcttccacaagcctttgggaatgaacattaaaggagtggaaacaggacagctgctttggacgtgaggagcaggtgctggcccctcacttccccgccttccacatgtgtgccaccgtacaataaagcctcagcagtcgttctgagtccagacccggccctctagactgaattttcctcttcccagtcttcctgagaaccagtagtgatgactcttgcccagcactgcaccaagccaggtggcatcagcttccttgggaagcagaactggcagcagaagagaggggcaccaatgtctctggggaaggtaccctcttccaggctgggagtgtgaggtcacacctcaccactgcagcgcccagtgtcactttccaaccctacctcctcttcctcagtcaccccgcccctccctgcccaaactatcttcgagggactaaattaaaatgaaaggtgtggttattgtggaataattaggcctcacggggggagaggcgtagtatattaatgccccagggttgtgattggctagtaatgctagtgcctgtgtcatggcttaattatcctacttcctcacaatcttttcctgcgcagttggaattccgcatccaagctcgtttgaggcaaaacggcgaccgcgggctccagtgtcctgagtatgtttggtcaatgcaggcgattttctccgtgtttacaatgattttatttcctaaaccacaaagccactgtgttttcactatctaattgttctgtggaaagtgtttaacgagggcaccgaaggcaaattcttgctgtcttctgttaatgttgttttgttgcagctttaaaaaaaagtattttgctatccaggaagagtggggagtagggttaatatgagaacattaatgcatttgttcctagaaagcaagccagtttctgggacagacttaacgctagacatgccctgcagatacactgagaccaagacaagggcgaaggggaaaattcatatgggaattatattttaaataaagaactggcaaatgtgagagatggataagcccctcattgctgtttttctccctttcgtcgtggatctggaatctttagaaggatggaggaatacccaagttcctccgcaggcagcctcaccccaaatcaagagtcttgttcaccatcccaccttctacacagaataagaagcccactggagcccctatgcgggccctgctcccgctccccaccccgcttcccccccacttcccccctccccccgcttccccccctcccgcaccccaccctgctcccaccgcccccccgccactcccgctccccccaccacttcacccccctcgcttccccccctaccgcacccccccaccccgctcccacagcaccccccaccccgctcccgctgcccccggccccgactcccgttccagtgaggggaggtgggcttctccaggacgggcttggactgggcctcagctcccacctgtgcagagtggcggcctgggagctgagcgtggccctcggcagccctgcttctgagctgcatcagaggaacggaggggttctctggccctggcccggtggcaccacggcagcaactggctttacccactctgtttctgaagctcttcctattttctctggcacataagcagaagggaatggtttgatgagggtcctgggtggggccacaggctcacccatgtcgtgaggagccccagttaggccgcgggaggtggagtgcgaggcccttgtccagcgcactagggcctgcacgtgggcctcatgtggagagagccagacagggcgcccaggtcagccgcctccgccttcgctggaaccgcctgcccctcctccgctcagcagatgccagctcagtgcccgctgcaccagtgattctcatagtttctagggaaacggacaagcaaatccctgctcttcaaccggctgtcttctggtggggtttcttttcctctggaagaacagaaccgtaacttaccactctcacctagtttttgactctgggttccttggtgcccagtgactgttgccctttcctgtcacaaaccaaaccttcccactccctgcagcctctcaccttctcatgcctcagaatcaagttttcacccagtcgtgatggaatttgacagcaccgcatcggatagtcctgacacacgtggttctctaatgtttgcatgcaaaagcagcgccgagggctggttcaactcagatgcccaagccccacaaccagagcgtctgactcagcgggagtgaggggagccccaggtggtgccgatgcgggcgaggctgtaactttacagtaacgatcttctccattaaatgtgtctgtggctgcagtgcccccaaaggacaggattgggcccgcctcccccagacaagaactctgaccaaatggcctgcagagcatccgcagcccagggccctgggccaaagggacttgacaccacacaactgtggtctttttcttggtgactttctctgtgatctggtcatttaggatcgagttgggtgtacttggtgtggcagctgctgtgtataggtttccccgggagagaaagtaaaagctgtttccattttaagcttaatggggcttgtatttatgtcgatcctttgttctcgggtctctaaattgacatgagattttcacattgttccgctgtgctgcggacagtggaagttggagccttcaccagagttctgcctggaagcattagaatcctgccttcccggagtcctctctttctctgccaggagatgaagccagcgtgtgtttggcacaacaataagagcttttcaatagttggctttttggaccttgtggccatcaagcctagcctcagggtctacagaaacccccttgatacatgtcggaggcatctgctttctcaccccacaaacagggactcgagtgcctcagaggtggcccagcggaaacttcttccctagccggctctcctctgtatcgaactaaaatctgcctctgaacagcttccacccactgatcctaattttgatctcttgagctgcaaagaatatctttctcacgtcaagacctaagactgtttcttgccttagtcccttgcctctctaggctcaattttactcttatcagctcactctctttcaactcaactttcatgtctggtcacccttctcgggacgctctcaaaactatacacacagactgaccttcccaatgactggactaatgagaaaggctgcaaaattagtcatccatccagtcgccactctggggaagaagatgttgaatcttcattgcaagtgctgtaaaatgaagtgtaaagatgcagttcctcttttgaggacagaatacccagattctcctccttcagatacagactgaacacacgtttattgatcacccgctgtgcatcagacatcagtgccgccttcttggattgccacgcccatccgcagaggcagtgtgtgttactcccgtttcgtgaataaacactaagcctcagctgaatggagcagatggcctaaggtcttacagactggaaggaacagagccaaaaaattaaaggcaaatctgagtgagtgcaagtttactgcttccataagtaaatctctgcagtagccactagatagacataagaggggaaatagaatcttgacttccacatcaacataatgctgactttgcagccagacccctgggtttaaattctggctctgccactgagagttgtgtgaccttccgcacgcgacttcacttcacaggataactgtaaaggacttaataggctaaggcatgtgacgtgcttttggcaatgagcagcacgtggcaagcactcacaccttagctgtgctcactgttagctttattcccagtacggtggagctgcagaatgttagtttcctgttgctgagatgacaagttaccaccaacctcatggcttaaaacaacacatttattatgttgcagttctgtagatgaggaacccagcagactcactgggctagggtcaaggtgtcagcagggtgtgttccttctggaggctctcggggtaaatccatttcctttcccggcttctgcaggccaccagctttacttggctcatggccccttcctccatcttcagagccagcaagtcctcatgctgccatctctgattttttctcttttgattccttcttccatttacaaaaacccacccagaccatccacaataacctcccccatctcaagttctgctgatcagcaactttcctagtccattttctgtggcttataacagagtacctgaaagtaatttattttaaagaggaattatttcttacagctctggagactgagaagtccaaggtcaaggcagtgcatctggtgagggccttcttgctggtggggactctgcagtcctgaggcagtgcggggcatcacatggccggggctgagtgtgctaacatgcttgctcaggacgctcttcctctacgtataaagccctacttccactcctgttacataacccatgaattccttaacccactaattcatgaacggattaatccattaatgagggcagagccttcatgatccaatcacctcttaaaggccctgccacattggggataaagtttccaacatatggaatttggggaacacacattgaaaccatagcacattccatctacaattttctctttgccatgtaacctaacatatttacaggttccaggacttaggacatggatgtctcgggttggctggggggtgaacagagaacataatagtaatttttagttccctctccaaacatagcccttaggccccaaataagcttcatttacctatccaggaatggcgctgtttgaacagagagagaagagagaacgggaatgcctttgtcaaacacgcatcggcatcttctggttcaactcggtgcccctcctccagccctggcccagtggatacaggtccttcccagttctaccagtctgatagtcacccctcctcccacaggaaatccaaggctggtgaggggctagggggaggtggtccaggttatccacatagcagagaaaagaacttttttctggaaagtggagctcaggtccttgcctctctggaaatttatttgagttggtttgagagagcttccaaacagcccttcctccacaactgctgtatccctaagtggcaaaggccattggcctccttgtggagtcctcatgcccacacctgggtgccggcgcccatcctgcatccctcacgggtacaccggggccagtcccttcaacactctgggcctctgcttcctcatctttcaagcgcaggaaagactccagtctagttcacagtttgcctgggaggatcccacctgcagtaaaatatccgtctgaaagatgtcctattacctgttattgtcagtgggattaggaagagaaggaaggttggggggttcagctctcagctctgttggagatattatacgggagttattccaggtgatgatctagcacctaatgacctaggcactcggtctctgacctacagtgttaacctaagacaagaatctcttctgggtgtagtgttcatcccagacctagcacagctctaaggagaaggaacccatcccgtcccctcagttgggattagtgtttgggattactcaatttgtagttttccaacagtgagcttatctgggcaaacaagcaaagaacttctgtggccaggccaaggtgggcatatcctcaccatcagggtctctggaccacctcgcttttcctgttctccacaccccaccctgccccacaaacagttttcacaaaaggccacagactttgtctgcacatgagctgataaaaccatggccatccttgcctgctcaaccattctctttcctggcacgccagctggcctgaacgtccgtcgcctgattgataggttttaaccagtggtacaacaggcttaaaatgtgacgtatccaagttattgcagccactgtgcgagcaaggtgaggtgcactttgcagcctccgtctgggatcctcttggctttgttctgcctcctcctgcttggatggtgcagcctctgcttgaagaggtgttctgggagattatgaaccaacatttatagaccgcacctctcctgagatgctcctttggcattttgtaaaacttttaagtgagaaagcgtagggtacagttctcagcacagactgaaggaatctgaggtgggaagaatgcagatggttgtccgaggcagcatcttgccagcctgccagcacagaaatggagagtctgggtgttggtggcaccgcatgtgtctctgtctaagacctctttctcaattgtgcatctgctgaacggtcagtctttaggtacttgatcaaggttggctgtgtgacaaattggagtttttcttatgctttaaattatttgttaacattcagaaggttcttaaaggtggctaaatgtacaataaaactaccctcttacaactgagatgccagttggggtgaattttcaaagtattgtctgatgatgtagagtgcacagggagtctttccactttaaggcaagtcatctagttaatttttcttagtctcatgcttgattcttctccctccttttcttcaccgtctccccaactttctactgggaccgtctaagaacagcgtagtaagaagtgagaaattatgtccagttcactatagccagcctcccagtttttaaataggaagccagggtgtaaagagacctaatttgcatattgattcattgtcatcaataacaaaaggggcccagggagtttctaggccgcctccacctctcctatggccccctgagctaggctgccccatgctcataggctgtgcgtgtatctgtgcctaaggagttctctgtccaactcactgtttgccatcaccattgggagtcagccacatgagagcagtgtgtggcatcaacacacctgtttgcagacccaccttggagacttggaggatttgagaagtcttccctaagcacaagatcagccaggcctggtgtcctccagcgcctcttctcccttgccccagggcgaagcactctctagaagcgcgctctgacgggcactactctggaggcacctggatgggggcgcagcaggcagcatctctgggccagcagttcacagtgtggacatcataggaagagaaaggttacagcctggcatacagggccctcctgtgatttcctgcaaggtgggagaaggtcctccagcagaagccagatcagtggctgtgcagtcatcaacagttggagatgtttagatgaaagtggggaaaagtgttacctgctttcattgtttcataaaatagatcctatatcattttgtctgttctgttcagcctctacctaataactgatgatgatctaaaaatggtgccaaatacagtgccaaattcattacatagattatttaatctttacaataacccggtgaattcagtgcccttcttcttcctccgtttaaatacaatgaaacagaaggttggggagatgagggaacaaggcaggcttaatgaaaccccattttgcctccagttgttttgtgttttgtttttaagattccactgaaaagagctgatgaaactatagagttgtgttctttattaagagctatagtttcatttttcagtagcaatggggctgggccaggaccctttttcctgcctttctcagtgatgccccatgccagccaacctccatgatccttcccctgctcaccacagaggcaggcaggtgaccatccccacttacagtgcaaaaaggtggggagactggtgaggtctgtgctgtaagatgacgttctgcacagtgcaagctgcagagactaagagcaacagcctgtcttgtgttttgtgtcttgtgttttgctagatataagattctgagttaataggttttttctttttagcactttgaatatgtcatcttactaacttctcatccattgtttctgctgagaagtcagctgttaatcttactgggatccatgatgaatcatttttctcttgctccattcaagattttctcttaaactttcaacatatttctgtcatgtgccagggtatagatttctttccatttatcctacttggagtttgtttattttcttgcatgtgtggattattgtctttcatcagatttgggaaattatcagccattatctcttgaaattttttttctggtctttagtgcatgcattacacactttacatgtgtgtgagtgtgcttaatggtgtaccatatttctgtgaggctctgttcatttctccattcttttttctttccatcctttagattgtaaaatctctatcagtatatcttcaagttcactcattcttctgccaactcaaaccaactgtggagccctatggtgaatttttcattttggtttttacttttcagccccagaatttccatttttttaaatcaggacacaagtaaattacatatagcctattaaaacttgtcagttcaattcaggtcacatttatttattaattaaagttgtgtaggtattttgcagattatttcactggacttaccctcatttaaaattgtttttgtatggtgaactgtctaggctaatttttatttccatcactttcctactgaaagttaaattttaaaatgctgccgtttgccatttgcctggtagatgtctatcacatgctaggcagtatgattttcttagaattgcaagtgtcctctgtcctacttacttgcatgtactgtgttgatttatgaatgttgaaagaaatagatttactttgtaaaatgcaaaaaagaatttccaattttttctttttataatttcagcctttttattggcattctttatttgatgaaacattgtaattacacttataatcctttaggcatgattttttagattgttatcatatttataatagctgctttcatgtctttgtccaccaagtctaacatctgggccctcttacgcacagtttctgttgtctgctgtctgctttttcctgtgtacggattgcatgttcttgttcccttgcatatatcatagctttctattaacaacaggacattgtagatgttacagcacttctgggtgctaatcctccttacccactgcacatcaccccttccccactggcttctcatttgtgtttatttccttactgatttagcaagaataattcagtgaagtctattcccctgcactgtgcctctgctgtcactcctcagaggccacagccttgagctatgagtgacattcctatttttcctttgttaaattacaaaattcttccagacagctccctttcactgcctctttgcctgatctctgttaagtttctggctgctgtatctctgttgttttcacttccagctgttagcctccactaatcttcagttgtttgcgctattatttttggcccaggagcataaattgtccccacagtctgctctgattgtccccacagtctgctctgactgtggctgggccctttcgtaggggtgctctttcggccagtccttgaggcctgctctgatcccaggaggactctttctggctgtccctttccctgccctctctgctaagctttcagctggtctactttgccatcatggagctactgcctactcttaattgctcaccaacaaaatttatcttgtttctgacagtgcctgaggtttgaactttcctatactctgttccaaataattagttatccttaggggaagttacagagccctttgttcttgtgacctgtctctccctgctctggaggtggtgcaggggcagtggcctgcttttctgtgaatgacacctctggtctacaggaagggtactgtgtgagcataggagcaactggtcttctctccttgcctctcccagcataagacctccacccagtgagtgagatggagtgaatgggacccagtactcagaatgctatgcctagcgtagagcttcccctccatgagtaaaggctggactgaggtagggacccctctgcttcttggtctagaatagagcttctgccacagagttggcaggggtgggagctgtgaattgtcaatgttggtagtctccccctccctgggagaaaccataaccctgtgtatttggagctgtgggaagaggtagccccatcttcttggccatacctgcccagggtagagcttcctttatgctgagcttcagaggaggggatttgtaccagggaagggagcaggttgtgggttgtgggtcacatgccacagattcttgctgctcttactgagatttgataaatcttcttgagaaaaatatttcttcatctatacacttaggacaatttccagagactttaagtggttggtttttattatttttatctgttgtagttgtttcactggaaggagggcccaaggatatccttattttagaagtacttccctggtgtaccctaaaattgtgtgaaaatgttcaggccttttttgctggtttagaattcaaacatgtgcgagggatagtttttaacacgctacttactagcgcagcaatctggcaaggactattacatgtagactggcatcggatgcagtccctagaaaataccccaaataggagagacttctatttctggcagttaggcagactagattactggaaagaccctcccaccgggaaaaaccctaaaatgtatagtaagattttttaaaatatttttaatgacatcaataactactcaattagcaaagaatactcataaatcaatgattaagtgaaagaggaaactcagagaaggggtagcatattgaaggtggctttccccttaaggatatttggtgaaccgaataaattctaataactgttcgcacagctttcccaaccataaggaatacaaggaagtccaaggctcctgtgcagtatctaataggagaccctccccatacgagcctgaaacctcaaaaggctaaactctcagtgtaaagatgaacaaaaaatactccccactagaaaactacaaggaaaactgactatctcaaaacatagtgctgggtagggccaggggaatttccctctgagaattcataacaataaaccatccctcacgtgagtttacaacccagtttgattgtatctgagtggccaaaaatcctaagccatgaagttaaagtatccccagcttgtagtttcctccagcaccttgtagaatcaaatgtaagtcatcttgaaagaacccatcttcaacccaggcctcaaattattcctagaaataaagttccaagatatttaagctcacaaccaaaaaaaaccccacaaaatatacaagtaaaccaagcaccaagagtgagaaatagcagggacattattagacaccaccattattagacctcagatattagcattattagcatacaacagaaaggaaatacagctaatatgtttacatattaaaagaatttgaaaagcgaaaaagccactgattatgaaaaatgaccaatcatgttgataacattctagaaatgaaaaaatataatcaaattgtaaaatttggagatgtaagtttagcggaacattacatacaattgaaagagaatgtggtgagctggaacacagattttggagatgatgcccaaccgagaaacagaatatgagaggtgaagtgacatggaatagatctaacttaggtctagctaaattcctagtggaaaggagaaagagaatgggggaaagtcaatataagagcagctaataaccaagaacttttcagaactgataaaaggtagaaacaaaaatccacatattcagggatccagatgaattccaagcagtgaaaataaaaatcaatctaaacttggaagcaccatagtgataaatgcagaacaccaaagacaaggagaagatctttaaaacagagagaaaaaccactgtccaagaaacacaaacatctcagtacctgacctctcaacagtaataatggaaatcagaaggccataaaatgtgcttggaaaaacctctcagtctcgaatacccaggaaagaaatatttcatgaactaggataaagatgtaattttcatacaaaccaaagctaaaagactttttcaccaatagaccctcacaaaataaagctgtattggatataacttcaaactaaaggataaataacccaggtgaaagaagaatgaataataagcaaaggaagtggtaaatatgtgggcaaatcaaaatacgtggtatgaagaataataatgaagtgctgaataaaaactgaaaaccaagctacaagtaaaatacatgactacatgaatatcccacatctgggttcagagggggctcttctgccttaaagtattctcagatccttgaattgttctggcaaagagcaaagataagtaactttgattttcataagttaaagatgacttaaagtttttatgaccatatatgaaagagtaggaatactatgcatgacttccaaagtagtagagaggggaaatggaattgaaagacaaacctggctggcttggaggctcacacctgtaatcccagcactttgggaggccgaggcgggcggatcacgaggtcaacagattgaggccatcctggccaacatggtgaaaccccgtctctaataaaaatacaaaaattagccagtcatggtggcaggcgcctgtagtgccagttactcaggaggctgaggcaggagaatcacttgaacctgggaggcaggggttgcagtgggccaagatcatgccactgcactccagtctgggcgacagagcgagcctctgtctcaaaggacagcaagaaaggagagaaaaaaatgtaatattagcagaacaaataggacaaaatctaaatacccctagtaaaagacttaaattatcaggctgtgttgtttttaaacctgtctgtgtattagagatgtagccaaaatacaaacagataagtaaaaagatggcaaaagatatccaatgcaaaaacccaaaacagccggctttcttacaccaaacatcatacaaaacagacttcaaggaaaaattagaaacaaaaaggttgccccaaaaaggtttatttcaccagaagataggataatttccaaatctatgcaagtagtaacctcttgcatagaaatataccttcaagatacatttccaaaaataagcatgtttacatggagttggaatgacagacgttcacatgcttcttccagtaactgacagatcaggcaggccaagaaatgtcttacatttaaatgttttccattttagaagtttattgaagatattatgaataactttataccaatatagagttgaaaacaaaatacagcaatttctagaaagcagcaacttagtaaaacggattcaagaacaaaaagaaaagttcagtcatcctatttatcagggaaatgtaatcactatttcagaatcttcccatgaagaaatacaaagtccagaacattttactggcaagtgctaccacacacttaaatgacaattaattttaatctgacacagtctattccagagaacagaaaaataggaacactctcccagtcactgtatgaggttagcaaaaccttggtagcaaaactaaagacagtacaagaaggaaaaataaaggcccatcttactcatgcccataggcttaaaaaaaaaaaaaaagaactaagcaagatattatccaataatgaagccaaagaatgattgtcaacttcattatgtctaaacctggcagggcaggcctcccattcgcagatttccccaccatccagcagtgagtgtgtttgcagtattggtaaaacagtgctgtgaagatttttttaatcaccaaatctgtcaaaattgccacaagtacaatcccacatgtccttcacccaaagccacaagcacagctcctcagctccgtccactgagatgatgacagaaggatttccagtctcggctctcactcacctcgtgtcttctctccccttgtctctgttttccttttttcagtggctgcttcaacccccaactccactgctggtgcagccatgaactccttgacctctctcgggactctgcaaggactggctggagccactgttggactgaataatattaatgcactagcaggtaccatcaacagtgagtatttgctgctctggtggacagccttcccccaaattctccacagaaagtggtcagccagaaatgacccgaaaaaggatatgccacggggagaactaaaacttgggatggaggagcacatgctttgataggcaaaagctgtctacactcgttttgcctcagaaaatccccaaccactctccacccccagattctcttcagtgtgtagcacagcgcgtgtgctcatccatggggttctgtggctggcagctcttttcaggtttccaggagtttggtttggtttggtttcggtcggttctgtcctgcgaggcagggtgttacggtgggaaaagttaatggactggaaggctggaagcctgaacccagctctgctgccaggcagctgtgggaagtcaggcagatgctgctccctctctgggcttgggagtctccatttgagaatggaaagttctgggtcagatgattcttaaaggtagcctccagctccaaagtctaaagattcatgacaattaaataggggagaaaattaggccttggaaagaaggaaatgaaactgaggggagaggagccactgctggcagtgacatgatcagaatctttattaagcacccacaggtatgggtcactctacatcagtgaccatccagagggacatcatttagctgtggcaggttgaaataggctggaggcaaatcacttagaaaattgtacttggttccgaaacatatggatggactcaccagagaactgcaggttctgtcctccacagcccacccgctcctgtcattctcggttgatgggggagcagtgtgccggccagaggataagtcgtgttttagattcatgctcggtgtgggttcctgtactgaggaaactgatcctcagcccacagcggggacatgtaatttccctgtccctccgtttcagatcccctggttgcctgagagtagccaagcccagcagatccacgacagctaacagagctgctgatacgggagcccagttagctaccatgcagcccaggcaccccggcacctgcccattctcatttttaataaaggagtccgtgacagttgttgccctattttaagccatggttcaataagtggactgtttttaaagggtgaccaggcagtatacttttttaaagcaaaataatcccagtaatttcatactgtaaaggctcggaataccttgcactggacttggtagaaaatgaacctaaaatttatccaaataaaaattaacttgtataatcctgataaatcattttcagaattaggacatttttcaggttttagtacatctttgtatttagtacatcttttggggaaaagcgaaaacgtggaccgagctttagctgaccatacctcccaaatgggacggctcgtgattagcgtggagcccgtgaagtggtagctgtgccgcggcctcattgttttattccagttagaaccgcctccagctttgacttttccagcagccaagtaggagcctcactgccttgacccccatttccggtacagctcctcgctctgaccttgtccttcacctaggtcgaggacgcgtgtgctcgcacacatcccctcatgctgcttctcttgccccaggacctagttcccctaaaacaaggactttgatttgaccgcctgcctgtccttggtctgcagagtaacaggccagtgggaatggttgtcctcctcagcacgtgctcatgactggtgtgtgtgtgtcctctcgtctgcgtcccgccctgtccacgctgctctgctctgcattgctgagattttcccatcgttctcgtcagggactggagaggggctgtgttgaatggcagagaaaccatgagtagttcttgtgtggggtcttgtgtgatacacattttgcttctggcaaggacaacaggcttaaattgttttgctttttaaaattctttgccaatgggttaatataagtctgtatagttcatagaaaacgaagaaagaatgtttgtcatttcaaataacccctgctagatagtatgaaccaagaaaatatttaattaaacccaaaaccagacaccaatgaaaatacattccttgtgattggaaagtgttactaatgcagagccgttttacaatctccagcattgacctcgagctaatatttgctgcttgtctctaaatatcaacagaaaaccttccaagatagagtatcttctttcagaccattccttctcaacagagatgattatgctaccagttccactggataattcctaaagaaattcgtcaagcagtggttacctggacagagtcagcttctcaaatagttgacggcagcttccatagcactgctatgaatcccaccccactgcagcagccattatctgtttccatatggagagtattcaggttttctgaatagagccaactcttacccaccgacacagcggtcagcaagaaagcaggtagatgactcaccagagccaacattttaccctctttcctgcccaagagcccagcacctctcccaaaaaacgaagtttttggtcagtagacaagtagctcaattaaactgtttgagtttgatatcctttttattccctgatacattaatgagtcaaagggctaaaaaacagtacagcgccctaaaaatgtaagaatcatccagatcagaagaaggaacacatgtgattgaccatcagagtgttcacctctggattttttcagggttccctgagcatgttttatatgttaacatctgaactaagttgaagaacatactttttccacccaagagtctgtatctgattttatgtgtttcagtgtatgtcaagtggcatcttatttttccttgttttaatgcataattcgaatggcttccaaatggcttaccatatagtgcttaaaattatgattgtttaaaaaaaaaaaaacagctgcagatgcctggtgaaaagtgtctatggaaatattttctgtgaagtagagaaaagagaagatgctccaggcatattttcgtggcttggcactacttgcattgtgaaattactgttttaatctgtattcctaatatctatagtttacacagccccacacaacctttgtgcccttaataacacaggcagatatataagtgacacccagtgcacatatagacatcttcatctaccttagttctagatattttatacttagcttctcatttatcagcttgcagcttagaaggataatccgtcatctatacaaaggaaaacttaccccagtgaagtggttacaaatctgtgagaatattaagacattctccctttttctttgatttgggataaagcctagcagggcagcttgcagggaatgtggtctgcttatggcacttggcttgtgattctccttttcagtgtcatctccttagtcccccaacaaaagacattcacgctcatgtttatgggttagtccttctgtgtcatgttaacagattcagtcatctcccagctcctgggtctctattgtaagttgagggcctctggagaggaatgaggcagaagaaactcagtagtcaggctgcgtgccggccctactgacgggccaggtgcagaggccttgctgcgcactgccgcacctgtcacttgcttccagccttccttgtctaaatagcatgcatgggaatggagatgataataataataaatgagaggaaatggtcgatccagtggaccatttcaaggaaaagccctattcttttaagtggaagcattttattcaacttgactttcttcacagctctgcttctgttatccagagcttttagaggaaatcaagtgcctgcagctgggttgaccaacactgtctttgatagaattaatctagaacaacatcaggtgactcacaggaactgttctcagaagtggaaggccgcctctgattgttcttcaaaccctaccaggttttcagctacttttccaccctggacctaggaaccaccctcccagattttccacgatagttgtggtttaaaatattctcagtgtgctggtacttgttagaacttttttgttcacatggatgtttataccatggaggtggcgagcccctggctggagaggccaaaccctccccgtgtcccctgactggtcccccttgagcatctgcatcccttgctcatggtaccgcctctgccacctccccagggaaacagggctggccacagctgtctcctacatgcacagcaccagcagaagtaaacacgacccttccagaaagcagattagctctgaggtgtagtccagagacacagccagcctctgtgaagtggagccaggagagaaggatgtggctggaatgtcactggctggagctccaagcctcacaataccctctgaaacatccatccagtatttcaagagcaggagctgtgttctgcttctgcattgtaagagagaaacatttttggcaaaaaggagaaagagttcaaagtaggaagataatttttctgacctggaaattaaaaaaacagctgtgtacagagaagggagttgggtcccagtgaccactgccataaaatgccacctgtgtatctggcactctggagaagccgagtcgtggaggctgcacatcgcaggaaggatcccccgtgggtctcacatgacagggcctgaaaactcccacccgcagcagacaaggcatcatggtggtgcgatgctgcccacccctccatgggaacttggaggcgtccactggagacgagctgctgtcttcagcccgtcctcgtctggcagcaaggccccacatggctctgcaggctgcgaggcacacccagaacctcatgccttgagatccaagcagagcggcgagtcgccgctcctctcccgccagaatttcctccacacgggcatctgcatttccagaggactgtgcccagagtgcgatcatctgtaatccacagcacccgttaacagcctggccaaagtgagaccaacagaatttatcagcagcgtccagcccttcccgagttattgtacatacccctctcacctatctcaaaaaacacggaagttcctttgcatcacacaaatagtgggaggtgaggatgaagtaagatcactggaggaatagagaaatgactctccagccctctggtggccatagtaacagggacagaggggaagcacagcggcagggaggtggccgcgatttgctggtgtccgagggatcatttagggtaattaggacagtctgcatccaagctctttggacagcacttacttgcatgacccaaagaaaacattaatgaaaatctcaatgattttcattaatagatagaccccttcataatgagaaacaaaagcagacacagcagggcctcagctggcaacacctctgaactgagcctgcactcaggaggctgccactccattctcacgccattcacactcgtctcgccacccctgcttggtgtctgttctgagaagcacaggaatacccgaggtgaggcacaatgacagtcctccactgttaagctatagcctaattcatatcttacatgtgtccttttaattgaagaggcgaagttggccaaatagaagcacaagtggagtaaacagaacattccccacctgctctgttagggcagtagcgttgctgggcgtgtggaggtcactctgctgccggattctctggtgtttccaggcagccttaccttagctgtcctccattctcattagacttcttacctattttttcagttagccatccttgctgttttcatatctccaatcaatagccctactttcattgagattttcattaatgttttcaataagctcttctcagaaacatcttttcttaaagaactgtgatcataaagggacccagaggcaattgtgatgtcacctcttccgtttcctgagttgatatgaaagttagcactctataaagtgttgcttgctttgactccgtattcagggaaaatgtgacagtcagccaccccagtagagccaaagagcagtcaggatacaaggggagaaatcgagtctactggccaccatcccgttcccatcaggtgatagccaaggtccagcccatagacacacctctgtctccggctgactgaaaaacatgacctggagctctttcagtggccgaaaccccagttgccacttgggcatgtgtgcatgcgtgcacgcacagaataactatttgctgctgaaaactgcaccactttgataccgaacgagtagcttcagctctctgcgactgtgggaagggtccacatggcttctgtgcctcaattcttcatcagccaggctatttattcctaaggtcctagtccctgacatcatcattcagctgtttagaaagtccgttttcccacactgtaactcctcaaactgcaggtccactggttccgagagtacagaacttgtcctctccaccatttcctcatcacacggcctaagggaaaaaagttttatttcatcctttcctcctcagccctgcaagctatcccatagttcctcaaagagcccagtaaatggatttcagtgtacagatgttacaggcctctgctactaaggtttttttttttttttttacatgctcctaagctcccagaagcaaaaggcttttacttccaaaagataacaacggtacttgccagtagcacgctgcatggcattgagctgtctcgtctaactcgtgccacagtgcatttgaatcactggcctagggagtgagggttctcatggcttaggtcattttcccccattatcacgatttatttcttcatggtttcatttttagtttcctgtcagtgtaattgtgtgctagctgcatgtacttgctgttgtactgtgtttaaatgattctctaacttcctttggaaagcactaatgaataagtgctgtttctcttctctattgttgggttttttgtaaagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtaggtgccgcccttggccccaggcagggcccagcccaacaggcagcactggcctctagagcacggttagaaggtatcaaattgaactgaacccatgtcataacagaaagcagttgttttgttattcatgtttaaaaaaaaaaaaaactgaaagctgggcatggtggcatacacctgtagtcgcagttacttggcaggttgagatgggaggatcgcttgagcccaggagctgaggctgcagtgagccatggtcatgcctgtgactagccactgcactccattcggggaacacagacatacccctctctctcaaacaaaagcaaaaacctatttatttcagtctttctcacttggtcttatagttaccttctaatttaatttttcatcgatctcttcagatgaagttcttgtccattgtatatttatataccactctggctttgttgataaataaatggttttaattatttcccccagctacatcttctgaagggttatggcatctctgcagatctaagtccaggaaagttgatcacctttcttgcaatccccaaatatcctctcactgctcaccccctgccataattaagttctataaactattaatttcccataaactacttcatagctgctgactgtaaataattcccagggacctccctctcccaagtcagcacagaccatcaccttttccccttacacagaaactacttgttgggggaaggggatggatggccacaggcttctgtgggtgaaacgctctctgtcctgtgtttgccagggttttggagtccacacatcctatgagtgtgtggccggctctcagtaggtgatggttttcaggtgaatgatgaaatccatggttaggattgccttggtctttgtttaattgggggtcttcagggaaagcaagtaagtgatcgattgccttgcttctctgccagtaaagcaaaataaactccaggaagttaatgctaagaataaatgaaagctaattatgaaatggttcatgagtaagaccaaataaggatcactggtcattcttccttacttgaagctcctttagagcaaaatctgctgaatgatatttttttctgacttgtttaaatatgggataaaaagctagaatagagaagcactaagggagattttttgaagtttctttcccttctcttttaccctcaccccatagctccaaactgctttgtctgaagtgggttttaagagaacacagcttaaaagatactcatggttttttttttttttttaaaggaaggaaaaggttttttctttgtataaataacatggatatcacttttaaaatgaaaaatatatgaaagtctaagttacttttcattatttcaactttctctttgactattatggtaggcttttgaaacatgcacaggtgttcagacaactggttccccaggcttgtgaaagagaccctacatcataaacatcacttgtcttcccaaagaaaggcctgtgtgtgttccttttctctgtggtctgagtaccatggtgacaaatgagggcagagagcagggccctgtaggacaatgatatcatcacacagaggccagaaggccagttccccacatggtggtcacctctccactacagagcagggccttccagtaaactctagagcagtttagggatgaagtctgggccctgaaacaacatgtttcgaaacaacatgtttctgaggtttcatctgagcccactgccctcaacttactcgcctggagttttaggggttactgcttagtgcagtaattccccttctgagattaagataaaattgcccaaaataaccattgcccactcctgatttaagagtgcgggttttcagtagcatgcttttgggtttttgatttgttcagtttttctttggaatcatctcccaccttgtcataactctcttctgatccctttctcacccagttaatatgtgctcaagaaatttaaaccatcttcttattagtttaagtaaaacataattttaaaagcaaatgatgccaggcagagcaaaaataataataataataataataataataataataataatgaattccagattttctactccacagttcagtccgaggttgcgagacctggtgtgttttttccccagacaggaagtgagcctctgatggcccgcctctgtccattacctgcaggaggcgagtcccatgaggaatggggacgctggtggactcttacagctttgttcctacaaacgtccccagttctttatgccagatcaagtgccctgtgagagagataaaacatgaacaccccaacagccaggaccagtagtgagtgtaacagagaatctaacaagtgacagtaacgtgcactgggagaaatctgatgaaagggtgacttgtgaacaggtgtttcccatttctagaggaagagagatgacacacaggtagaatcccatttttaaaaaaggtattttgttttttcctcttcatctcagccaccttagttgcatacaagggaggttttccatatgaaatctttttttttttttcattttaatattaaaaactcgggggatatacaaaaccaaactgtttcttggtgatggaaaaattgggggatctatgtcaagagatggtgctgacatttttttcttgggaatatcaggagcaaaaggacaaaacctacttgtgtgcgtttactggtctctctgtttccttggtctctgttgggcatagacaaattcagcatgagcaacattctagaaagctaggattactcaggcatacccagtcatctgtcatgtgcattgaaactgtattttctccccggcttcaggaggtgagatgtacttcacagttcaaactggggcccaataactctcatttgtgcatttggatcttttgtgcagtagcaacatgaaagctggtagcaccaaatctgaccatcagacataccacccaggatgtgcacacacagcagtgctcagaacatccctttccagtgtttcaggttttgcatcttttcatgttaaattttgattcccttaaaaccagaaaacatctggggaccaaaggcccccctgcaattgtgtccctttaaaatagactccttcccatgccctagaatacggatatatcccaggaaattggcagcaatatggaaagttacagtagtcattaagacacacttttaaatgagaaaggaagagttcactctgtggcttccatagtttgcctcaagaagttttctttgtgaaaagtcccaatcattaggatactttcttgtgatgtattttgtggaggcaggggaagaagcttggtttgacatttttacaaagttctttttatccccattttacttttcttcatgccacacagacacccttcccacatctagggaccccagtgcagctatcccctggggttgcctagttgggcaggcaggcctgttcctctcctgtgaaggccagttgaggattcctgacccgctgcagaagtcgcctcaccagttctgtgagcgcccctcctcggaagactccatgcctggaacgcccaagaaacagccagccctcatctccctcagctcatatttatgcccttttgtgccgcttttaactttcacatggtgctcatatgggtgggggagagtcaggagaggaaaagcgagggcagcttaggagcacgcacctctccagccagcagggccaagatctccatcctgcccttgctgcctgtgtttactgggaaaggataggtggacgggcagagcttggcttcctcggtctttgcccagcttctacatccactgcattcatctccaaggctaacgcccaggagagtcattcctctcaaagtcatgagactcaggctaccttctttccttgccttgactcactgccagtcatttctaataaagatgattattagactgtgtgttaagagatttggcaaatcaaaactggctggaaaactaggcaaatgatagagaaatcggagcagcattactgctacatccattattgtcaattgttacaattttttagaatgcacagagcacccttttttccttctcacagcctgtccgtacctgagaaaatacggccacccaagaaaaacccatgccaagattatctgtccccattctgcccactgtcaccttcagccccatgaaaaggtgactgaaatgcatatgccaaggggcagtggcacctgtgactcacagaagactgtcagtggaaaggaagccattcgtaaccagcatctttggaaatcaggaaaatctgaaggatgattgctttcctgaaaggcactccagcacttgacatttatccatctgtttgtttgttcaactaaatgcttagcctacctgttgttaaagtattcctaagaagggactttggaaactaagactcaagggataccttactctgactttttttttcctccttaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggtatgcaaaagaaactaagctagtatattgcagtaggttcccaagtgaagagtcgtgggaaggaaaatgtgagacagtttcagccaggatagggccttccccacattgtgttgggctctgattttctggatccttgtaagcagatttgggcaaagaaaggaaggctctgggaaattaaagtcaacgcccatacattaggtaatcttctatactacactattaaggaatctaaccacaatttagctcatcttccccactaattccttagccctccaggtttagtacaattcagacaccgtggttgtgggcaacaccatattgggggcttattggccttgacatacacgcacacaaagacactttcacagacagacacccattcatcagcaccaacacatccatgtgttcaggctgcttgcgtgatcgcagctccacgtgcccgggatgagcagttgacagatctcacggttacatagcacgctgcatgatgagatctgaagggccaccatcggggagtgggaatgaatgcggagtccaggggcgtgcagctgttatcagagactcagctgccatgccccctttcctcaagcagcctggactctgcctcttgtgggtgtttttcgctcccttagggaggaagggatgctcacagaatggactgatgttttacaccaggacaatagcattcattaaatatattccttgtttcatttttcaaaccctattggcccccaaagcagtttacaggccaggatgttcagagtatatattacttggcaagctcagggcccagtttgagttagagtatttgctttaatcactcctgcaatttaataattcatgctggtgggaaatagtaacagcataaaacccaggtagttaggtaagggctggaggaaacacacagaattctgtgctgtaaaggaaagtagcaaagggagggtggttctcaaacttaactctggctggtaatgagtaatcaggccaaagagaatgttttggcttctaaaactctaatcctaaggtctaatttgtgctatcacccaggaaggtctgaaggcatggttaaaggactccgcatgtcagccacttacagtcaccacgttaccctagcagcaaggctgtcagtcgggacccattcggcggctgctgtggcaactgtataaacccgtgtgacagttcagtagagagggatatgcaaattaaatcattatggggggcgggggggtgtgtctgagcaggagcctactttagggaggcttccctacatgatttacaaggctttgaggctgacttttgtgtttttcgtagctaaacaatattctagatttggaagggaattctgcttcatgatttgatttgagaaaatacttccttgaaaacagattgtttatcagcctacagcctccttaaccatgtgctcatactgatgtaaaccatagctgttagtgtcagcagacaattcttgagcatgatggactggtttccatttttgtggaacgctatagcacccagtttgcttggtgagccagccgcatttcttagggctgccagtcataaggtagtgccccgttccttcctagttcttagccaggttttgttatccatctcacctttgtccatttccattctgtaactatcttgctgttccttgataaagacccagagggaaaggaaagtcagagcaaaaatcttggatcccagatcacatttattgggaatgagacttaataaaaatgtaaacagccacttctttgcaatccagcctacctctgaaaagctgcccagcgttatgccgcatgcccatttttatcagccgagaactgggcagaaaagtcatgtcctcttcttcctcctctagtttgtaaaggaattttctctttagctttaatagcagatggatagaggtgcttagtatagaaccttccgaacagctgacgtttagacctaaatgtaaatcaggaccatagcttcctgtcaccactcggatcagcaccctttacagccttgctatacctctgctgctgcctcccccagtgctggaacagactctgggaccaagatcctcttgtcactgggtctttgcagttctttttcaaaagcttgccttccctgctgtttatggtggaggtcgttgctacagagtaagagatggggaattctcttcagatgattaagttctaagccgttgactatgtatcccccagactttgggagatgccagggagcaatttcctttctgctgaatttactggagctttggaaatggaaagtgagataaggagaaaggcccagcacttccctagtctccttggtattaactccaaatgggtaaaaatcaagtatgagtgagttattctagagtttattcgctaattgacccatcctccagctaaacaggtgtaggctctgtgtgacagacgatggagagctcgagtgacaggctggggcttggcagtatctgctgttctccagcccttcccttcccgagcctgcctgttggcctcacctggctgggacacgtgagcccctaggggcccccacagccctgaaatatttacaccactgcttgtatgagtagcatgtatggacctggggttcttttggagagatactaaaggacttgaaacacaatgatttgagcgagttcagtaagtggaactgaattcagccaaacaattgagtctgaggtttcagtgttgtggggaggggtgtgtgctccatgatgccacatttccagtccagccagctgctccacagctgctcagtgggcacgccccatcatccactcacggtggactcacgatcagttccgcagagctgtgctgggcccgtggggctggcacctcatgctggctcttcagccttccccagagctccagcccccttttctgttttctgctgggcttcctctccaggctgactccctctctcggtattttccaggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccgtttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcc

SEQ ID NO: 36099 - DNA, 316426 bp, Homo sapiens; identical to SEQ ID NO: 36098

SEQ ID NO: 36100 - DNA, 11237 bp, Homo sapiens
gagcacactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtgagccgggcccgtgatgccggaccgccttgcccttgcacctacagtccccttgccacgggcgctctacgtccaagccaaattccctcaggcctagtttggggtagctgtatatgtgtccactccgggatgtgcgggcgggaagtgggacgagtgagggcccagacgcacggatgttcctcatgcaataaacgtttattgaggcacggtcagcgtgggtagagggtacgatgatggacgaggaagtcgcggttgctgccctcacgcaggttgcgacgtaataggaaggtgcttcaagaaccagagtgatgggggaaaacaggggacccagctgtgacagctgacccagccttgggggtcagggagagcggcctggtgcaggtgacggctgagtctgttctctgttgaggaaagtgatagcactttagagatcagtggccgggatcttgggggatggcaggcggcaagggagaccagcatagctgtaattgcaaagcctcttaggtctttacctcatgagggaactgggaagcgatagcaggagctagagccggtcagatgagtgtgctatccacatcacctttgggaagaattggcatggacaggactggaggtgaagggatgaaagaagaagctggcacttccccaagctggagggcatgatgtctggctatgggaaggaagcttgggggaggtggggaaggcgtgggattcaggacaaggcagggggcgcacagatgaagtccagccttctgacttgggcaagtggacagtgacagagtcacaggcgtaggatgctgaggggcccgtgggccacccagaaggctagatccatggggccaggatctgggctgtttatccgtagagctcatgttctgtgccccactttggtctcagcttgtttgtccaatccattccataatcctggctgatggccatgttattcccattttgcagatgtgacaactgatggtcagtaacataatcagtgtgaatagaagaggccgatgagcccagatttgaaattaggcactcaggctgcagagcccatagtcctcaatgcagaggagagatggcagctgtgttgtgtggggtgacagtgccttgaccaatatgatctgacatttgtatacgtcacagagggttaaataatataaggaggtgaggttcaatctaatgacagtaatagccataaaaataattatagtaattagaatttatgccgggtgcagtggtcacacctgtaatcccagcactttgggagaccaaggcgggtggatcacgaggtcaggagttcaagaccagcctggccaagatgatgaaaccctgtctctactaaaaatacaaaaaaaaattagccaggcgtgttggtgggcacccgtaatcccagctacttgggaggctgaggcagagaattgtttgaatcgggaggtggaggttgcagtgagccgagatcgcactccagcctgggcgacagagcgagactccgtctcaaaaaaaaaaaaaaaaaaaatttatgcagtgtttgtcacgtggtaggcactatatattctttctgagtattaatttagctactccttaaaatcatctgaggtagaacccatcacacctttctcttatggatgagaagagtcactgagaggttaagcaactttcctgaggtcacacagtaagtgaagggcagagttgggattagaatgaagtgggagccaggccctgtgcactctacttacccttgttgtccttgtcttcatgactctggacctggaacctcagtttttgtttgtaatgtggacctccagggcccgtctctgacattctgggcactgacatgtgaacatttaaacatggagacaggctgggtatggtggctcatgcccattatgccagcactttgggaggctgaggaaggagaatcacttgaggccaggagtttgagaccagcctggacaacataacaacaccctgtctttaaaaagtaatttaaagggccgggcacggcggctcacgcctgtaatcctagcactttgggaggcggagtcggccgattacgaggtcaggagtttgagaccagcctggccaacatggtgaaaccccatctctactaaaaatacaaaaattagctgggggtggtggtgggcacctgtaatccgagctactcgggaggctgaggcaggagaatcatttgaacccgggaggcagaggttgcagtgaaccgagatcgcaccattgcactctagcctgagcgacagtgcaagactccgtctcaaaaaaaaaaagtaatttaaaaattaaccaggtgtggcggcacatgcctgtagtcccagctactcgggactggcggaaggatcgcttgagcccaggaggtctaggctgcagtgagctatgatcacaccactgcacccagcctagtgacagggtgagaccccctttcaaagaaaacaaaaacaaacaaaaaaatgtggagacatatcagttcacctaatttttcacattaaaatctgtcacaggttcaaaaccgacagaatttgtcttctgccaggtaacatctttagtggtgtactttaccctgggaggtgtaaactatcattattactacccctgtgttacataagggaaatggagacacagcaaggggaagtctttcccttgagaccacttggctgtaaagttgtatagctgggatgtgaacctagctttaagggctgtgctttcaacctgggacccagcgctgcagaaagggggtgcctggctctgagcctcacccctgcctggacaccctccccacatttccctctaggtcatcgaggctgaacttcggtccaccaagcactgggagcttactgcggagggcgaggagattgcccgggagggcagccatgaggcccgtgtgtttcgaagcattcccccagagggcctggcccagagcgagcttatggtaggagctgcggggtgaatggggagtgagtgatgggatgaaggtggccctcgtgccccactcactgcagcctctcttttccagcgactgcccagtggcaaagtgggcttcagcaaggccatgtccaacaagtggattcgggtggacaagagtgcggctgacgggccccgggtgttccgagtggtgcgttcctgcgggctggtcagggggcaggtggacgggcacatgggcccctggccctcatacccctcacactccttatcctggcaggtggacagcatggaggatgaggtgcagcggcggctccagctggtccgggggggacaggctgagaagctgggggagaaggagaggagcgagctgaggaagaggaagctgttggctgaagtgtgagtgggtgccccctgcaggctcaggcccccaccacctgcgaagcatggtggaggcatggtgggagggagacatcttgcccacaccaagcacaggtgtggccagtttcctcccagctcgcttaatgccatagttgtcaagcctacgtgccttggggtctttgcccatgaggacccttctgctgagaactgttttccctctgatcttcaagataggctcctcatcaagtctctctcctgtgtccccttaaagaggccaccctgacagccctcctctccccttgagttccatgaagcccatcgcccctagtcttcatctttggtgcttgttcatttctttcactgtccttagtgtggtccaaagtttaatgaacacacaccagacaggcctctggaacctagatgggctaggggccgtcctctcacaggacaaatgtcccctttgagcagacacagagtggcagagagaagagactagagctgggatgcctaactgaagttcgggctctgtcacttaactagttttatgaccttggccaagtcacctggcctttgctggtctccgtttccttatctataaaatagcctgggccaagtgtgtggctcacgtgtgtaatcccagctactcaggaggctgaagtgttaggatcacttgaatccatgaattcaaggccagcctgggcaacatagagagacccccatctcaaagaaaaaggggccaggcacgatggctcatgcctgtaatcccagcactttgggaggccgaggcgggcaaatcacctgaggtcaggagttcgagaccagcctggccaacatggtgaaacctcgtctttactgaaaatacaaaacttagccgggtgtggtggcgggtgcctgtaatcccagctactctggaggctgaggcaggagaatcgcttgaatctgggaggtggaggatgcagtgagctgagaccgtgccattgcactctagcctaggcaacaagagcaaaactctgtctcaaaaaaggaaaacaaacaaacaaataaaaaaaactgccctctttccggggcttgtggggagacttttgcagaacagagcctggcacagaataaatctgctagactttccctagtatcatcactcagtcgtgtacttagcaccttgaacagaccctggcacacattaggttctcagtaagtgttgaatgaatcagtgagtgaatacagggagatacagcatggtcacataggaggatttcaggtagtgataaatgtcaggatggaaataaagcagagtgacttggtaggtagcatggggatcctcatcagacgggagatcaaggaagtcctctaggaggagatggcagtggcgtccccttccttcccctggccacaggactctgaagacctactgggtgagcaaaggcagtgcctttagtaccagcatctccaagcaagagacagagctgagcccagagatgatctccaggtagcaggcaaccccagggtcagggcaggtgggagctggggcagggggcaggggcgggcagcccttaccaggcccttgcatcctcccccagtggctcttggcgggaccggcccttcaagccctacaacttcttggcccacggtgtcctccccgacagcggccaccttcacccgctgctcaaggtccgctcccagttccgacagatcttcctggagatggggtgagcacagggctgggggcggtgcctggtgcttctgctgggtacaggcagggcagtcaggctgtgtctcccaccaggttcaccgagatgccgactgataacttcattgagagctccttctggaactttgacgccctcttccagccccagcagcacccagcccgtgaccagcacgacaccttcttccttcgaggtgggtcagcccctagggcctccctgagacatgagagacaccaggccacggcggagcctttacaggatgggcatcccatttgatcaaattaggtctagaactgggcatggtggtgtgcacctgtagtccggctatttgggaggccaaggcaggaggattgcatgagcccaggagttcaaatccagctcaggcaacatagggaagaatctacctctaaaaaaattaattgagttaaattaaagtccatccttgttggatgtgtcaagctctgttctcattatgccacctgcagtcttttttttttttttttttttttttgagacagggtctcactctgtcgcccaagctggagtgtgcagtggcatgatcttggctcgctgcaaactttgcctcccaggttcaagcgattctcctgcctcagcctcccgagtagctgggattacaggtgcataccaccatgcccagctaatttttgtatttttagtagagatggagttttgccatgttggccagggtggtctcaaactccagtctgcctcggcctcccaaagtgctgggattacaggcgtgagccaccgcacctggcttttttttttttttttttttttttttgagacagtctcattctgtcgcccaagctagagtgcagtggcacgatctcagctcactgcaatttccacctcctgggttcaagcgattctcctgcctcagcctcctgagtagctgggattacaggcacccgccaccacgctcggctaatttttgtgtttttaatagagatggggtttgccatgttggccaggctggtctggaactcctgacctcaagtgatactcccgcctcagcctcccaaagtgctaggattacaggcgtgagcaccacgcctagcccaaaattaatgaatttttgttttgttttgttctcactatgttgcccaggctggtctcaaactcctgatctcaaacagttttgcctcagcctcccaaagtgctgggattacaggcatgagcccccacaccctgcctgcccccatgtcttctttgggcattccaggccgtgcacacctcagggcctttgcttatgttccgtctttagccaagagctgttttctcccagatcttcaaggcaggctgcagcctcaaatctctgctcacgtgtcaccagagacaggccagcctaacactcccgggctcaccccgagttctacagaagcccttctcccctagtgttcattcttctgtcccatttctttctttcattgcccttagcactgtctgaaatggaatgacttcccacaatggggtggccttcctgaccaagagggcagttgaggtcattgggtgccggcttacctggccagaggagcaacatcattcttgtcattattgtcatagcacccaaaacttactaagcactcatcacatactagccactattctaatcttcctgccaactactggaagcagtactgttacccctttttacaaagaaggaaacttggccagcctcagtgggtataatcccactgtttgggagggcaagggaggaggatcgcttgagcccaggagtttgagaacagcctaagcaacatagaaagacccatctgtacaaataaaattagctgggcatagtagtgcacgcctgtagttgcagctactcgggaggctgaggtgaaggattgcttgagcctgggagtttgaggctgcagtgagctatgattgcatcactgcactgcaggccaagcaacagagcaagactttgtctctttaggccgggcgcggtggctcacgcctgtaatcccagcactttgggaggctgagacgggcggatcgcgaggtcaggagatcaagaccatcctggataacacagtgaaaccccgtctctaccaaaaatacaaaaacaattagccaggcatagtggcgggcgcctgtagtcccagctactcgggaggctgaggcaggagaatggtgtgaaccctggaggcggagctggcagttagccgagatcatgccactgcactccagcctgggtgactgagcgagactccgtctaaaaaaaaaaaaaattttgtccctttaaaaaaaaaaaataggccgggcgcggtggctcacgcctgtaattccagcactttgggaggccacggtgggtggatcgagaccatcctggccaacatggtgaaatcccatctctactaaaaatacaaaaattagctgggcatggtggcgtgtgcctgtagtcccatctattcaggaggctgaggcaggagaatcactcgaacctgggaggcagaggttgcagtgagccgagatcgcgccactgcactccagcctgggcgacagagcgagactccgtctcaaaaaaaaagaaaaaataaaaaggtcgggcgcggtggcatgatcccagcactttgggaggcccaggcaggcggatcacttgaagtcaggagttcgagaccagcctggccaacatggtgaaaccccacgtctaccaaatataaaaaattagctgtgtgtggtggtgcacttctgtaatcccagctacttgggaggctgaggcaggagaattgcttgaacctgggaggaggaggttgcagtgagccaagatcatgccactgcactccagcctgggcaacagagcaagactccatctcaaaatacatacatacatacgtacatacataaataaagcccaggtgcagtggctcatgcctgtaatcccaacactgggaggccgaggtgggtggatcacctgagatcaggagttcgagaccaccctgaccaacatggcgaaaccccatctctactaaaaatacaaaaatttcccgggtgtggtggcaggcacctgtaatcccagctacttgggaggctgaatcaggagaattgcttgaacttgggaggtggaggttgcagtgagccaagattgagccattgtacttcagctgggccaactgaacaagactctgtctcaaaaaaaaagaacccaaaaaagccacacacaaatgagaaaactgaggcacgagaatcacttgaacctgggaggcagaggttgcagtaagcccagattgcaccaccgcactccagcctggacaacagtgagaccctgtctgaaaaaaaaaaaggggtgggaaatgctcgttgactgacctgatgttgctctgtcctgcccagatccagcggaggccctgcagctcccaatggactatgtccagcgggtcaagcggacccactctcagggcggctacggctcacaggggtgaggcaggacttacctggtatggaagggaaggaggctggggacccctgggccattgcatggacttcccaccttccctcctgaaggtacaagtataactggaagctggacgaggcccggaaaaacctactgcgaacccacaccacatcagccagcgcccgtgcgctctaccgccttgcccagaaggtgcggttggcccaggcgggggccccagtggggagagggtgctgtcaaagggaccttctgacccatacctgggcctggctcggttgtcacccctagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtgagcaggggggcaggggtgggccatggtggtgaggcagcgggcaggtgtgttgatcaccagcattatcctccaaacccctgctctcctgcccgccccccacttcctgcaggtatcacgcaactccgcttcaagccagcctacaacccatacacagagcccagcatggaggtgttcagctaccaccaaggtcagggtaggccctggtactggggtgggagggaggtctcaggctactatggtttggcctgggtccccccattgccatgcctgtaccccacctcccaagctcaccacctagacccagaacctgtaccagcagtgcccagaaactcaacacgcactgcccgtcttttctgtcctgcctctgcaggcctgaagaagtgggtggaggtcggaaactcgggggtcttccgtccagagatgctgctgcccatggggcttcccgagaacgtgtcggtcattgcctggggcctctccctggagcggtaagtgcccaagtggaaactcggggtgtccagctgcctcaaataactctccaggtataggggcctgcgtggtttcagcaccacccattcattcatccaatggacaaaactttcatcgtgagtacaaactgaatgctcagccccgtgctgtgaacatgacagcttatgtccctccctctgaatctggggtcccagtggagcgagaaggatgataactagcaagaccaacaagtacatcaggccaggcgtggtagctcatgcctgtcatcccagtgctgtgggaggccaaggcaggaggatcgcctgagccaggagtttgagatcagcctgggcaatagagcaagtctccgcctctacaaagaataaaaacaggccaggcgtggtggcacatgcctgtaatccaagcactgtgggtggctgaagcaggtgcatcacctgaggacaggagttcgaggccagcctggccaacatggcgaaacctcatctctactaaaaatataaaaattagcctggcgtggtagcaggtgcctgtaatcccagctacttaggaggctgaggcaggagaatcgtttgaacccaggaggcagaggttgcagtgagccaagatcatgccactgcactctattctagtctagacaacagagtgtgactctgtctcccgtctctactaaaactacaaaaattagccaggcactgttgcgtgcgtctgtagtcctagtcctaggtactcaggaggctgaggtatgagaatcacttgaacctgggaggcggaggttgcagtgagctgagattacgccactgcactccaccctaggttacagagtgagactctgtttcaaaaaaacaaatgcactcagcaaaagaagacagaagtgtgtaccagggcagtaagtggtatagggagggctaaggcaactacgtggtcagtgaaggcatcatggaggaagaagtgccacctaagcaaaatctagaggtagataaagaggtaaaccatgagagtatctggggaagggtgtcccaggtagtggtcacagtcagttcaaaggcccagaggtgggaatgtgctttttgtattaggagaagagtgaggaggctggtgtggctgaaggcggagggtgagaggtgatagagcagttggcgcagggccctgtgggtcatggggagaacttgaacttttcctctgaagaagatgggagccatggaaatctgagcagaagggtgcacgtgctgacctcatgataaactctgttccctcccccacaagcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgccccca

SEQ ID NO: 36101 - DNA, 38513 bp, Homo sapiens
acgcggcggcctggccaggcgaggcgggagccgagcaggccggagcgggccgcgcgccggggagggtcgcgccgcgcccgccccctccccgccacgcccggggcgcacgcgcgctcctctggccgcccctccctccgcgcggggacccctggcgggcggcaggaggacatggccagcgacgccgtgcaggtaggcgcacctgcgtctggagtcccggggcgaccggacggcgccggcggaccccgcccgcgcgctgccgggggagcccccccagcccccggaacgggactcgggtgacgatggcaagggcgggggcctccggagcgcccggcgccccctccctgggccgggactgtggagccagcgaggcccccttctcggcaggtggcgatgtggactgggctggtttgggggcgatcccggaggcaacccctgctacaccctcaaactcggcctctcctggagaactagaaggggcgcggcggaggctctacttcgggtgtctgtggctggctgggcgtcccagtgcctctcgtccgcccccaaactcatccccctccccagggttgggtacccggcaggtgccgctccacctggggcacgtgcctggcgcagtgccctgggaggggaggaggctgctgggcccggcccgtgcccttcccccgcataacaaagctccagccacccccgcctctagacagctttatgatgttccagacgccacccagattggcacctgttggcggaagtacccgagtcactgcattaggtcgggggaatggggacccccactcccacccttgggctgtcaggtggaaccttctcctgggtggggagtgtctcagtcaacaggccagggatgctcccatatatagaatcctacttttttgcatggtggctgggcatggctgggtcacccccaccctgctaacacacacacgtgactggcaccagcctcccgcccagccagattccccttgtgccacctggtggggatcactgacctggactcatcttccccgtctgtgacaagcacggccagggtgactgccaaccttctttggttcaagtgacccaaatctgagaaatgtctgtgcctcagtgtccccattagcacctcaccatccagttcattgtcctgtggttgttgtgtaactgggttctcgtctccttctgcacctgcccccggcccctttgtgtctccccggtaacccccggtccctcccgccttcccagtcctgctgatggcctgccggccttgccgaggagctgggcgtatctggtgttgccgatcacacaaggtcagacctcaaggccgggatgggccggggtccctgcctctacccccggcccagggagggctgtgtaggaatccccgggtgcatgcatgcgcttggcgcatcccacacatgacccagacaggctgtgattcctgcaacgaggctggacccacgccctggtccccccttcccatctcctccccagtctcttccccgctcctggtcatccctctctcatggttgcttgggcctgctgccctgtccctctgtctgtcccaacgtgtgcctgtctgttctgtgtcctgcaaacggatgtcctgtccagattccggaaacgcccaaggcattgaaatctccggatgtgggagtctaggtccctggctgctctggcaagatggggattatgggaggcaggtcctctgggtctgaggtctccgctccatggtgggcagcggaggagcaggggttctccataggacaggccaggccagggccctgagtcctgggtttgccttgctggccctcaggtgacccctgtgccttgggtagaagtgagtcactcaggggaggagaacccaggagcccagcctccctccctctgtgcattacagacctcagctgctggaggtggggctgagggaggccacctctcctctctgcctggacttccccagttgagctggccccgctcttggctgtgtcctccctctgcctgctggggatggggtggggccttctgagcgagggtggtatttggtgagcctgggcttaaattccagcgctgacacttcctcgctgtgtgtcctgggcccagtgccttcgcctctctgagcctcggttctgacctaggaaaaatgggactaagagggtgttcatgggagagagagagaccgagaccttgccagcacttggcaggcagggctgctgtgaagtcgttactggtaagcgtcctggtcagcagctcagggtgtgaatctgtgtccttattgattgatttactgatttatatttatttattttagaggagagagtcttgctctgtcacccaggctggagtacagtggtgcgatcctatgtcaccgcagcctcgatttccaatttccggggctcaagtgatcttcctgcctcagcctcccaagtagctgggacaaaaggcacagaccaacatgcctggctaatttccttttacttttgtagagacagggtctcgctctgttacccaggctggaatgcagtgacgagattcttgttcactgcagcctcaaacacctgatctacaggactacaggcatgcaccaccacacctggctaatttttttttctttatttttttaaattgagactggggtctcactctgtcacccaggctggagtgcagcggcatgatctctgcctcctagactcaagccgttctcccaccccagcctcctgagtagctgggactacaggtgcacaccaccacgcctggctaatttttgtatttttagtagagtcagggtttcgccatgttgcccaggctggtcttgaaatcttgagctcaaagtaacctgcccgcctaggcctcccaaagtgctgggattacaggtgtgagccactgcccccagcctttctttttttcttttccttttttttttgtgatggagtctcgctctgtcgcctaggctagagtgcagtggcttgatctcggcttactgcaaattctgcctcctgggttcacgccattctcctgcctcagcctcccaagtagctgggactacaaacgcccgccaccatgcccggctgatttttttgtgtttttagtagagacagggtttcaccttgttagccaggatggtctagatctcctgacctcgtgatctgcctgcctcggcctcccaaagtggtgggattataggcatgagccaccgcgcctggcctctttttttcttttttgagacaaagcctggctctgttggccaggctggagtgtgatggtgtgatctcggctcactggaacctctgcctcctgggctcaagccagcttcccacctcaggctcccaagtagttgagactgcaggcacatgccatcacacctggctaattcttacattttttgtagagatggggtctcaccgttattgcccaggctggtctcgaactcctgagctcaagcagtcctccggccttggcctcctaaagtgctaggatcacaggcagagagagccaccacacctggccaatacttttttattttttgtagagatttttgtaggtcttgctgtgttgcccagacttatctccaattcctgacctcaagcactgctcctgcctcagcctcccaaagcgctgggattacagacgtgaaccaccacacctggccaaatctatgacccttaaccgtaggcttctcagccttagcactactgacattcagggctgggtcattctttgcagtagaggctgtcctgtgcactgcagggcgttgagtggcatccctggcctcaccctgatagaagtcacctccttacccacagtcaggacaaccaaaaatgtctccggatgttgccgcatgtccccgggtatggggagaaaatctcccctcaatggaaaactgttactggccaggcacagtgcctcacacttgtaatcccagaactttgggaggccgaggctggctgattgcttgaagtcaggagtttgagaccagcctggccaacatgtgaaaccccgtctctactaaaaatacaaaacattagctaggcgcagtggcacgtgcctgtagtcccaactactcaggaggctgaggcaggggaattgcttgaacccggaaggtggagattgcagtgagccgagattgcaccactgcactccagcctaggcgaaagagcaagactctgtctcaaaccaacgaacaaaacatactactgtgacttccttgagcctcagtttcctcacctgtgaagtggggagttcttggcagctgctcaagatttgtagtgagggttgggaagatggtgggagtgatacacttggtctgtggcattcctccctgggggcagctgcgcttgagatcagtcacgagccaaggataacattccttgtctgtgaaatggatgctcccagctgaaggagataaccccagggggccatttcctagccagcatttggaatctgggtgctcttgttttaaatcaaggccctggccacggggcagtgactcacacctgtaatcccagcacttttggaggccgaggcaggaggattacttgaggccaagagttcgagatcagcctgggcaacatagtgagaccccatgtctatgaaaaatacaaaaattagccaggtgtggtggcgtatgcctgtagtcccagctgctcgggaggctgagctgggaggactgtttgagcccaggaggtagacactgcagggagccatgatcacaccactgcactccagcctgggcaacagagtaagaccctgtctcaaaaaaaagaaaaaaagttacatgagatattcaactttactgtaaaatagctttgtgttagacgtttttgcccaactataggcttgggtaagtgttctgagcacatttaaggtaggccagggtgagctatgatgtttggtaggtaagatatattaaatgcatttttgacttatgatatttgcaacttatgatgagcttatcaggaagtaatgccatcataagttgttcttgaatgttactgtgtgcttagcaagtggttttgtaggctgctgatttggggcattctttttttttttttttttttttgagatagagtctcactctgtcgcccaggctggagtgcagtggtgtgatctcgactcactgcaatctccacctcctgggttcaagcgattctcatgcttagcctcccaagcagctgggattacaagcacgtgccaccatgcctggctaattttcatatttttagtagagacggggtttcatcatgttggccaggctggtcttgaactcctgacctcacgtgatctgcctcgctcatcctcccaaagtgctgggattacagatgtgagccaccacgcccggcgtgattttggaaattggaaattctttttttttttgagacggagtttcgctctggcgtgcaatggcacgatcttggctcacctcgacctctgcctcctgggttcaagtgattctgcttcagcctcccaagtagctgggattataggcatgcaccaccaaacccgactaattttgtatttttttttttttttcagtagagacggggtttctccatgttggtcaggctggtctcgacctcccgacctcaggtgatccacccacctcggcctcccaaaatgctgggattataggcgtgaggcaccgtgcccggcctggttttggaaattcttatcccagtcccccagtgctgtcccctaattgtgttggcctgagggaggtgccactgggctggctgggaccccgggcctctcagctatggtcaataacagttggcgactggactgagaggaagcaggaagttgggagggcccgtctgcaggaaaggggcctcacctctgaagaagtggctgttctgaccctgaaggggaagccggggacaaggggtggctgggagagtctggagggacatatgcaggtagtcgcagggctggaggtctgtgggagcatggatgtgctgcaggggcctcggggagcgtgcatatgtgtgtgagcatgtgcacacgcatgagcatgtgggccatgccctctcgggcaggtgggagtgtgtcttgtatgggttctagagggaagctcataagcacttgtatgtgtttgcaaataagtgcatatgtggtaggcatgggaatgggtacactgtgagcccattttccaggcacacacctgcaggtgtagaagtgtgcacctgtgtgtggatctttgtttcatccacacacacaggcatgggagtgtgcacacatgtgagcctgtgttgcaggcacacacctgcagccataactgtgcaaacacaggccaggcgcggtagctcacgtccagtaatcccagcactttgggaggctgaggggggcggatcacctgaggtcaggagttcgagaccagcctggccaacatggtgaaaccctgtctctactaaaaatacaaaaattagctgggcgtggcggcacatgcctgtaatcccagctacttgggaggctgaggcaagagaattgcttgaacctgggaggcggaggttgcagtgagccaagatcacaccagtgcactccagcctgggcaacacaaagggagactctgtctcaaaaaaaaaaaaaaaaaaaaaaaaaggaaagaaaaagaaagcgtgcaaacatttgtgagcctgtgttctgtgcatatccacatatgtatttgaaagttagtgcacactcaagtcagccctcggagcctgcgtcccctcatggatacaccatgagtgtgtgaatgtacaaactgcctgcaccttggacattctctagggacagggagcaaggactgtccctgggtttcatctagaggaacaggaggtcccttagatgccctggagttggccccgcgcgaggggtgctgggagttgacaggaaagaggaagtggcagccgagaggccctggtggggctgaggttcaggaagagggcggggccctcagcccggacccaggatggcggaggccaataacccctcggagcaggagctggaggtggggtccagggtccctgtgggggcaggcagaagggggccccaagtggcacaggccagtagtccttccccgggtacttctcagtttgggaacaaggagaggagatggggcactggcctcagagttctctctctggaggatgagagtatccagtgcccttcggggctcccagattggggagagacagaaggaaggagaccgggctctgttctttagggtcccagttgttgaacataggagaagagcagatgagggtcttcaagaccccatagtttgggggtacagcagagagaagacttggcctgcccttgggataccctagttttgggggtgtagccaaggaaagatgaggcctgccctcgggatgccatagtttcagggtacaagtgagggaagatggggcctgtcctcaggaccctgtagttttaggggtacagcagagagaagacagggcctgcccttgggccctcttagtttcggggagcagcagagaaaagaaggaatcttcccttgggaccctctagtttgggggaggcagcagaagggagacagatcttattcttgagacccccttaatgtgggggacgctgtggtggtgggggtgacaaggccctgctcttgagacctcccagtttggggaggtcaggaagcagtggcaaggcctcgtcaccttccagttttgggagtcagaggaggtagagcaggccctgtcttgggagccccagtccagggcagaggctgggccaggctggctgcatgtggtctgcacctggagttctcctagctccactgaccctgttctgtcctccgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacggtgagctgggatgcctctggggatgcgggactccagggattccactgctcactggctcacccatggtctccagagccaggttaacccatctccacggacccccagggagatgcatgccatgacccccgtagccaccaacacccagagaggtgcatacagccacaccagcacccggtaacactcaagaccgtgcatgctgtcacatgaatacctctagacacagccacgccaacacccaggcaacattcaaggatgtgcatgcagtcacacaaacacctaaaaaaacagccacaccaacacccaggcaacacccaagggtgcacatactgtcacacgaatacctccagacacagccacgccaacaccccaggcaacactcaaggatgtgcacactgtcacacgaatacccagaaactcccacagttacatggatgataaccaaagactgtttatttttgtttttgtttggagacaggatcttgccttgtcacccaggctggagtacagtggtgtgatcaaagctcactatagcctcaatttcctgggctcaaacaatcctcccacctcagccttccaagtagctgggactaaaggcatacaccaccatgcctggctaatttaatttttttttttttttttttttttgtagagaaagggtcttggtatgccgccagggcttggctagaactcctggcttcaagtgatcctcctgctttggcctcccaaatgctgggaatacaggcgtgagccattgcacccagcctgttttttaatttaaaacatttttattggttttaacattttttttctttttgagatggagtcttgctccatcacccaggctggagagcagtggtgcaatctcagctcactgcaacctccacctcccaggttcaagtgattctcctgcctcagcctcctgagtagctgggactataggcttgcaccaccacgcccggctaatgtttgtatttttagtagagatgggatttcaccatgttggccaggctggtctcaaactcctgacctcaactgatccacccacctcaggtgatgtgcctcccagaatgctgggattacaggtgtgagccacctcactcagcagcttgaattttttttggtggggaaggacagagttttgctcttgtcacccaggctgaagtgcaatagcacgatctcggctcactgcaacctccacctcccaggttcaagtgattttcctgctccagcctcccaagtagctgggattataggcatgagccaccacgcctggctaatttttgcatttttagtagagacgggattttgccatgttggccagggtggtatttaactcctgacttcaagcaatccgcctgcctcggcctcccaaagtgctgggattataggtgtgagccactgcgcccggcctcagtcatttctgcacccagggtcccctcaagcatcacaccactctccagagactcatgcagacacatgcatccggatgtgccaacacccggagactcagtcataccaacctggagatctgaactcacagttgtagcaacagtcagagatgtacgcagagcatctcccaacacccacaatctcagacagtcattctaacacatggcgtctcacagagttacactaacacctagggaaacacacactcagccatgccaacaccctgcagctcacagatggcaccactcccacacccataggctcacacaagccatgtacgtagttactcatgggcctctcaaatgcagtggacccagcaccaaggacacactaacacacctgggtgctcgcctgcactcattcatcctgggttctgccccagccccgaggggtttccctgggagggtgggtgggtagactgctgggccctggtgtccccctgcctgcctgtctgctggcccccagctccccctcctccatgccccaggggcaatgcccaggctgggctgaggatgaagcctcccaggcaggccgaggtgaggatgcgtggtgactctctcccacctgtcgcctccagatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggtgaggcagcacgtgcacacacactgtgtacacacaccacacctgtgtgcgtacagtccacccacatgtgcacacctacctgcatgtgtacacatgtgtccctgtgtgcacacgcccactcaaatgtgcacccacacctgcgcatgcacaccccacacgtgcacacccatccgcatgtgtacacacctgtccacgtgtacacacacccactcaagtgtgcacccacacctgtatgtgcacacactcactggcatgtactcccacatctgtacatgcacacacctacctgcgtgcatacacgctcacccacatgtgtacacacccctgcaaatgtgtacacacatatgcatacacccaccacacgtgcacacacctgcatgtgtacacacccttgaacgtgcacacacagctgcacgtgcatgcatacttgcacacacccacatgtgtgtataccagcatgtgtacatacaccccccatgtgcacacacacctgcacatgcacacacacctgcctgtgcacctgcacctgcatacacatttgcaatgcacatgcacatgtacacacccacacgtacacacccacccgtgtatctgcacacacaccgcacatgtatgcacatgcctgtgagcagatcacaggctgggggcatagggtgcagcctacagctgcccccatgggaggctgggagcctttggattggggacatactggctgatgggtgtaacttggtgtcaggactaaggcacaggcagctcatgggggcatatgggaagcatgactatgggtgatgtcagacagacgtggcaaattgtctcccctcctcccacagtcccctgcagagcctcaggcccatccacagtcagggcaacatgccgcctctcactgctgacggtgtgtcctgttacaagcacacacagtcatgtcataccttgacacacacacaccatcataacatctagacacacacacacacatgctgtcataacatctagagacacacagtggtaacaacatctagcaacacatggagaatcccaccacagccacatctggacacacacacacactcttacattcatacccagagactggtgcacagacacacacacatcccccgtcctgccaatcagtcccaggaacacacaggtctctatcaacacccagaaattctgacaccacaagcacaggccaacctacagctagaggattaatgtccagacccacaggctggtgtgcgcatgtccttccacgtgaatgtcacatgggaggacagactgcatggatttttttaatgacactattttatttattttttgagacagagtctcactctgtcgcccaggatggagtgcagtggcgtgatctcggctcactacaacctccgcctcctgggttcaagcgattctcgtgcctcagcatcccaagtacctgggattacaggcgcatgccaccacgtcccgctaatttttgtatttttagtagagatggagtttcaccatattggccaggcgagtctcgaactcctgacctcaggtgatctgcccaccttggcctcccaaagtgctgggattacagatgtgagccaccttgcctggcctaacattattttatttatttaatttatttttatttttattgagacaggggtctgtgttgcccaggctggactcgaactcctgggctcaagcattcctcctgccttggcctcccaaagtgctgggattacggatgtgagccactgcgccccatttatcaattggtggacatttggttgtttccacctttttagcgattgtgagtagttttgctatgaacacctgtgtacaagtatttgaacaccattctatgaaaatttaaaacctagatcaattgtatatcttttacatgtatctgagcgttatacaaaaaaagaataagagtttctcaccccctaagaatttctgccccccgccctgggggtaatactgacccagtgaaaatgaatagagtaggccaggcgcggatcccagcactttgggaggctgaggcaggcggatcacttgaagtcaggagttcaagaccagcatggccaacatggtgaaacccgagctctactaaaaaaatacaaaaattagccgggcgtggtggcacatgcctgtaatcccagctactcgggaggctgaggcaggagaatcgcttgaacctgggaggcagaggttgcagtgagctgagatcacaccactgcactccagcctgggtgacagagcgagattatgtctcaaaaaaaaaaaaaaaaaagctgggcatggtggtgggcgcctgtaatcccagctactcaggaggctgaggactccatggactacatcatgccactgtatccaggaatgcatggaagtacatttatttacttatttatttattttgagacagggtcttgctctgtttcccaggctggagggcagtgatgcaatctcagttcaatgcagcctccaactcctgggcttgagtgatcttcccacctcagccccctgagtagctaggaccacaggtgcacaccaccacgcccagctaatttttgcatttttttgtggagacaaggtcttgccatgttgcccaggctggtctttaactcctgagctcagcagtccacccgcctcagcctcccaaagtgcggggattacaggcatgagccaccgtgcctggcctgcaaatgcatgttgttacatccacatgtgaacactctgccacagtcacctaggacctgcatggtgtggctagaccccaaccacctagccttcctctctcagactgtctctgcctccaggaccggaagctgctgctgacagcccagcagatgttgcaggacagtaagaccaagattgacatcatccgcatgcaactccgccgggcgctgcaggccggccagctggagaaccaggcagccccggatgacacccaaggtgagtcccttgcttccaggcagcttagcctgcatctcgccttgcagggctcagcctccagctccataatgagtccctttctggggcagggaggtgggtcctgtgacccactgtgagacttcaacacattcctgaccctctctgggccagagcttcccattttgtcccatgcaaagtttggattacatcaggggttggtaaattaccaccttcagaccaaatctatccattgtcttttttttgtcaataaagttttattggtacccagccacgcccattcatttactatgtttttgactgcctgactattctgaataatgaccctggcacttggtcacagagagtcagacactcacagtcacactgtgtccacatgtgtcactcacctggacaccaataacacagacacagttccaaggaagttgatagtcacaggtatgttgccttataaacacagtctcggctgggtgcagtggctgacgcctgtaatcccagcactttggaaaccgaggcgggcggatcattcgaggtcaggatttcgagatcagcctggccaacatgatgaaaccctgtctctactaaaaatgcaaaaatcagctgggcgtggtggcacgcagctgtagtcccagctactcaggaggctgaggcaggagaatcacttgaatccgggaggcggaggttgcagtaacccaaggtcgccccactgcactccagcctgggcaacagagtgagactctgtctcaaaaaaacacacacaaaaaaacacacagtctcactgtcacccctagacctgctgccacatggcgctttatcagtcactgggacttttaggaataaagtcatccagtcacccatccttgcgacaacacccagagacaaaggaatgtgtgatcctaccatcacacatagtcactgtgaagtccatgtggatatccacagtacaggcacacaatcacgtgcaccgtcgcactgacacacactgcagggacacactttttttttttgtttttttttttagatggagtctcgctctgttgcccaggctggaatgcagtggcacaatctctgctcactgcaacctctgcctcccgggttcacgccattctcctgcctcagcctcctgagtagctgggactataggcgcccaccaccacacccggctaaattttgtatttttttttgagacggagtcctgctctgtcgcccaggctggagtgcagtggtgtgatctcggctcactgaaagctccgcctcctgggttcatgccattctcctgcctcagcctcccaagtagctgggactacgggcacctgccaccacgcctggctaatttttttgtatttttagtagagacggggtttcaccatgttagccaggatggtctcgatctcctgatctcatgatccgcctgccttggcctcctgaagcgctgggattacagacttgagccaccacgccctaccaattttttgtatttttagtagagacggggtttcaccatgttagccaggatggtctcgatctcctgacctcgtgatccgcctgccttggcctcccaaagtgctgggattacaggcatgagccaccgtgcctggctgacacactttttttgtttagacagggtcttgctctgttgcccaggctggaatgcaatggcgcgatcataactcactgcaggcttgaccttctgggctcaagcaatcctgctgagtagctgggaccataggcgtgtgccaccacacccagcttattaaaagaaattttttttttgtagagactaggtcttgcccaggctggtctcaaactcctgacctcaagtgatcctcctgccttaccctcccaaagtgttgagattataggcgtgagccactatgcctggcctgtgccccttttcttgaccctgtgcttgggcataaatgcatttgtgtctgtgactgtgtttctctgcccctataatggtgtccctgtgcccaagatgacagggccgtgtctgtgtaacagagtctgactcatgacagtgtctctatgtggcagggtgactacatctttgtgacagagtatgtgttcctctggtgatagtgtgcctacgctggtgacaaagtggtaatgccatgtgtccctgtgggcgacagtgtgacagtgtcagtgcgacagtgcctgccttactctccttgggccgccataacaaagtcccataggctgagtggcttaaacaacagacatttatgtttttcacagttccagagactggcagtcccagatcagggtaccagcatggtcggttcctggtgagggcgctcttcctggcttacagatggcttccttcttactgctccctcacagggagaaagagccttagtgtctcttcctcttcttatttttcattattagttttttgagacagggtcttggtctgtcacccaggctggagtgcagtggcgtgatcacagctcactgcagcctcgactttctgggctcaagtgatcctcctcgttcagccttctaatagctgggactacaggcacacgccaccatgcctcgctaatttattttttatttttagtagagacaaggtctctctatggtgcccaggctggtctcaaactcctggcctcaggtgatcctcctgcctcagcctcctaaagtgctgggattacaggcgtggaccactgcacccagcttcttcctcctccaataagcgcgctaatcgcatcatgatggccctccctccatgacctcctctaaccctaattacctcccaaaggcacttggagaagtccaagtgccatcccactggggattaggggttcaacataggaatttggtaggagacaaacattgagtctcttaacagtgtctttgtgactgacaccgtctgtgtaaatgtagtatgctgtggttgtccagatgtccatgagtgtcaccatgcctggttgactgtgtaacctggtgactgttcattggggaatgaggtgtgtcaacacgggtatgacagtattattatttttttttaatgacttagagtctcactctgtcacccaggctggagagcaatggcgcaatcttggcttactgcaaccaccgcctccggggttcaagtgattctcctgcctcagcctcctcagtagctgggattacaggcatgcgtcactgtgcccagctaatttttgtatttttagtagagagggtttcaccatgttggtcaggctggtctcaaactcctgacctcaggtaatccacccgccttggcctccgaaagtgctgagattacaggcctgagccgccatgcttggcctatgatttagatgttcctgtctgtttgggtgacagcccctgggtgacagtgtctgaatctagataatgtggctgtccctgggggccacaatgtgcctgcgtctgtccctgtgcaaatcactggaggtgaagagggaccgtgacaatgtgtgtgtcggtaagcgtggggtgacagtgtgcctgtgtgtcattgctcagactgtcccctgtaacagggtaactttttccctaggactggccctgtgagtgatggtgtttggataaaagagtctgggtggaagtgtggctgcctgcaggtgacagtgcgacagtgtcactgtgcctgccccttggatgaagcgtgatgcatcttcatgatggtttgtctgtggcccgtgcctgttcctgcgaatggctgtgtctgcgactaggttggtggggcgctgcaggctagcctcactgccctgtattccacgctcacagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggtgaggggcggagctttcattagaggcggggcttcagcaaggggcggtgcttcagcaagcggcggggagttcaccaggaacacccacggtgaggggtggagcctcaaagggggtgggaccttcataaggggtggggcctcagccagggtagactactgtgaggggcagggcatcaggcaggaacagtgcaactgtgaggggcggggcctcagcgagggggcatggtttcaggcaggaatggccctcggtgaggggaggggcctctccaaggggcggggcctggttttcccagaggtgggaccaagttggtttgaggtttagccctctagggaggagctcagtgtgagactcagcctgggggtggggcctaggcctgcacttgggaaggggcaagcctggtcccgcccccagcccccacacttcccaccacaggcccaggagaaattaacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacaggtgggtctgagaccctaccccacccctgcagccctgggcctccgactcctctcatttccccattcctgtgacccccgacttcaatctccgctctccccaaccctggactcccattccaccactgtctcctcccctcctttgccctctgattctgggctcttgcccaccccccccacacctcagtttctccatctctcttcacctggcccagtatttttctcccagcccttgttccccagccccacctcggcctcacaacgctcagccatgagcctcctacccgcctgctgcagaccagccagccccaccttccacagacccctcagccatctacccctccagaccagccccaccgtagacccctagcccatcttagacctcagattgtccaccgagtcctcccctagaacccctagtcctaccctgttcctgcttgcctgggcctacggcctgtaccctgagcctacggcctgtaccctgagcctctcttctgcccctaaactcccgcatctgagcccctcctggaaggactgcttctctcatattctcctatcccagcacggacatcccggcctcatgccccatgctccattctggttgtccctcactggctcccacttgtaccatggctgcgtctggatgtgtcccctccccgctgtggtcccctccgctcagcctgccccagaagtggccccctgctgagctttcccctcctgcagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgagtgggcatcgtgggccctgagaaacgaggtggcattggggacctggaatgccccatatttgtaaacctttaaaaaataagccaggggtcgggtgtggtggctcacacatgtaatcccagcactttgggaagccaaggtggacggatcacttgaggtcaggaatttgagaccagcctggccaacatggtgaaacactgtctctacttaaaaatacaacttagctgggcatggtggtgcacacctgtaatcccagctgtttgggaggcttaggcaggagaattacttgaacccgggaggtggaaattgcagtgagccatgatcacgccattgccctccagcctgggtgacagagtgagactttgcctcaaaagagaacgaaaacaacaacaaaaacaaaaaaacaggccaggtgcagcagctcatgcctgtaatcccagcactttgggaggctgagacaggaggatcacttgaggccaggagtttgagaccagcctgggcaacatagcaagaccctgtctctacaaaaaataaaatgtaaaaattagccagatgtggtggcccacacctgtagtcctagctgttctagaggtgggaggatcacttgagcccagtgagctatcattgagccatttcactctagcctagatgacagagagaccctgtctctaaattaaaaaaaaagaaaaaaaacttcaagtttatttagattaaaaaaaaggctgggcgtggtggctcacgcctgtaatcccagcacttggggaggccgaggcgggtggatcacgaggtcaggagttcaagaccagcctggccagcatggtgaaaccccatctctacaaaaaatacaaaaaaattagccaggcgtggcggcgcgtgcctgtaatcccagctactcgggaggctgaggcagagaattgcttgaacccaggaggcggaggttgcagtgagccgcgattgtgccaccgtactccagcctgtgcaacagagcaagactccatctcaaaataataataataataataaataaataaaacaaatttaaaaagaaaggaaaaccaaacaagaaaccaatatatcatattcattaggatgactaatactattttaaaaacccaacaaaacaaacagaaaataagtgttggtgaggatgtggagagaaatcagaacctttgtgcactgttggtgggaatgtaaaatggtgcagccctatggaaaatatattggcatggccgggtgcagtggctcacacctgtaatcccagcactttgggaggctgagggggccagatcacctgaggtcaggagttcgagaccagcctggctatcatggcaaaaccccgtctctactaaaaatacaaaaattagctgggcatggtggtgtgtgtctgtaatcccagctactcagaaggctgaggcaggagaatcgcttgaacccaggaggcagaagttgcagtgagcttagatcgagccactgcactccagcctgggcaacagagcgagactctgtctgaaagaaagagagagagagggagggagggagggaggaaggaatattggcagttcctgaaacaagtaaaaacagagtaagcagtccaggcgcaatggctcacacctgtaattccaccactttgggaggtcaaggtaggtggatcacctgaggtcagaagttcaagaccagcctggccatcatggtgaaaccccatttctactaaaaatacaaaagttaaccgggcttggtggtggtgcacgcctgtagtcccagctactctggaggctgaggcaggagaattgcttgaatccgggaggcagaggttggagtgagcagagatcatgctactgcactccagcctgggtgacagaatgagactccatctcaaaacaaacaaacaaacaaaaaaacaagagtaaccatatgatccaaagctacttctgggcatatccccaaaagaattaaaaacagggcctcggacattccataatgcatacatatttcaaaacaacatgttgtgcatgataaatatatataatttttatttgtcagttttaaaaatagtgatagaaaaatatttaaaaaaaaaaaaaagggtctcagagatatgtatacctgtgttcatagcagcattatgaaagccaaaaatggaagcaacccagatccaccaatagatgaatgggtaaacaaaacgtgggccagccatgcaatggaacattgctcagatttaaaaaggaaagaaatcctgccaggcgcagtggctcatgcctgtaatcccagcactttgggaggccgaggcaggtggatcacttgaggtcaggggttcgagaccagcctggccaacatggtgaaaccccatctctattaaaaatacaaaaattagccgggtgtggtggcacatgcctgtaatcccagctactcaggaggctgaggtaggaaaaccgcttgagcccaggaggcaggcgttgcagtcagccaagatcatgccaccgcactcctgcctgggtgacagagtgaaacactgtctcaaaaaaaaaaaaaaaaaaaaggaaaggaatcctgtcttatcctgcaacacggatgaatcttgaggacattagtctaagtgaaataagccagtccccaaaagacaaatattgtatgattccagttatatgaggttcctagagtagttagattcatagagacagaaagtagaatgatggatgccagggagtagagggagggggaatggggagtttattatttaatgtggacagagtttcagttttgtaaggtgaaagttctggagatggatggtggtaatggttgcacagcaatgtgaatgtacttaatgccactgaactggatggacactttaaagtgattatgatggtaaattttatgttacatgtattttaccataattttttttttcttgagacagattctcctctgctgcccaggctggagtgcagtggcaccgtctcagctcactgcaacctctgcctcctcggtttgagcgattctcttgcctcagccaacccaaatagctggtgggattacaggcgtgcgccaccacacccggctaatttttgtatttttatggagatggggtttcaccatgttggccataatttttttaaaagaaaatttgattcgtaatctcatggcaaaaaaggaaaaagaaagaaaattaatacgtatgtacaaaaaaaaaagggagtgtggagaagagtaacaggagagcagacacccatattaccaccacctgcgttaggaaatagaatatggcagccaggtgccacggctcatgcctggaatcccagcattttggtatttgtaggaggatcacttgaacccaggagttcaagaccagcctgggcaacatagcaagaccttgtctttacaaataatttaaaaattggggcatatggccaggtgtggtggctcacgcctgtaatcccagcactttgggaggccgaagcgggtggatcacaaggtcaggagatcgagaccatcctggctaacacagtgaaaccccaactctactaaaaatacaaacaattagccaggcgtggtggtgggcgcctgtagtcccagctactcgggaggctgaggcaggagagtggcatgaacctgggaggcagagcttgcagtgagccgagatcgcgccactgcactccagcctgggtgacagagcaagactctgtctcaaaaaaaaaaaaaattgggggtacatgtcatcaggccctcctgaatctgtgtcacagaaaaaaaaactaaagggaaaaaaagagaagacaagccaaccaaaaattaaccaggcgtgggcatggtggcttgtgcctgcggtcccagctacttgggaggctgaagtgggaggattgcttgagcgcaggaggtcaaggctacagtgagctgtgattgcaccactgcattccagcctgggcaactgagcgagaccccatcttaaaaaaaaaaaaaaaggaaaagaaatagaatatttccagctctccagaagccccctcttgtctcctccacaattccatctccttcctctgccatagaggtggctactctcccgacttttatcatttccttgctataatttgtagttgtagaaccccatgtttgcatccccaaaaacttttgtttaattttgcctggtattagaactttatattgacaggctcatacagactattctatcacatggcttctttcattcaacattgtttaggggctaggcatagtggctcatgcctgtaatcccagcactttgagaggccgaggtggagggattgcttgagccaaggaatttgaacccagcctgggcaacatggtgaaaccccaccctacaaaaaaatgcaaaaaacaaaaccaaactaaaaaaagcattgttttggtagactcatccattttgttgtgacaagctatagttaattcatatttattcctgtttagtaatccattatgttagactgagccatatcgaattgcctctttctgaaagcaaaaaaatagttaaatatcagcaatttcgtacttcagctactaagatggtatagcagttttaaaatattaattctcctgttaatggactgtgggatgcctctattttggactgttacatacactttatataaatgcatctcctgatgtatacccacatgcatttggctagggtaaatcctcaggagtgcctgggcgcggtggctcacgcctgtaatcccagcactttgagaagccaagaccagtgatcacttgaggtcaggagttcaagaccatcctggccaacgtggcaaaaccccatctctactaaaaacacaaaaattagctgggcatggtggtgtgcgcctgtagtctgagctactttggaagctgaggcacgagaattgtttgaacccagaaggtggaagttgcagtgagccgagattgtgccactgcactccatcctgggtgacagagagagactctggctcaaaaaataaatgaataaataaatccttaggagtatgtggctgggacttccatgtagaataaaattgaatttggatccctgcctcacatcacaccatgtaaaaaaatcaactggattaaaggcttcaatgtcaaatgcaaaactttacagtgggagaaaagttatggaggggaggattcattttaaaaagatagcagacagctaggcctggtggctcatgcctgtaatcccagatacttgggaggctgaggcaggagaatatcacttgaggccaggagtttgagaccagcctgggcaacataacaagactcatctctactgaaaaaaaaaaaaaaaaagaaaaagataatagacatgcccctttctgccaggattttctttctttttcttttttttttttctttttttttttttttgagatggagcttcactcttgttgcccaggctggagtgcagtggcgtgatctcggctcactgcaacctctgcctcctgggttcaagggattctcctgcctcagcctcccgagtaactgggattacaggcatgtgcaaccacgcctgggtaattttttatttttagtagacatggggtttcaccatgttggtcaggctggtctcaaacttctgacctcaggtgatccacctgcctcagcctccgaaagtgttgagattacaggcatgagccactgtgcctggccgtttttattttctcttctcttctcttctctcttttcgaccgagtcttgctgtgtcacgcaggctggagcgcagtagcacgatcttggctcactacaacctctgcctcctgggttcaagtgattctccttcctcagcctcccgagtagctggcattacaggcgcgtgccaccacgcccagctaattttttgtatttttagtagagacggggtttcgctatgatggccaggctggtcttgaactcctggcctcaagtgatcgcctgcctcaacctcctaaagtgccgggattacaggcatgagcaaccttgtctggctactgccagcattttctgactgggccctctctcccatttcaggtgaagtcagcactgtgcttaagctggataacacagtggtggggcagacgtcttggaagccatgtggccccaatgcctgggaccagagcttcactctggagctggaaagggtgagctgcgttggaggacagcagggcctagaggaggaggggttccatgcctctggcaccctgagtgatggccctcttcctctccctccaggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtatagcccacacctgaccctgagaaaatgcttcttctccctcactgccccattcccagtttcctagaaggggaaaatatgttttaggtctggctcttccagaaggggaagataagttttaagtcaggcttttctagaagaggaaaatagattttagatccagctcttctagaaacggaagatatgttttaactctgccttttctagaaggagaagatacgttttaggtcaggctcttccagaaggggaagagacgttttaggtctgcttttttctagaagggaaagatatgttttagatcaggctcttctagaaagggaagataggcttttgatctgcctgttctaggctgggcgtggtggctcatgcctgtaatcccagcacttcggaaggctgaggcaggaggatcacctgaggtcagggagaccagcctgggcaacatggtaaaaccgcgtctcaactaaaagtacaaaattagctgggcgtcgtggcacatgcctttagtcccagctacttgggaggctgagacaggagaatcgcttgaacccaggaggcggaggctgcagtgagctgagatcccaccactgcactccagcctgggcgacagagtgagactctgtcgcccaggagtctcacaaaaaaaaaaaagatctgcttgttctagaaggggaagatacattttagatcaggctcttttagaagcataagatatgttttagatatggtttctcttaatacagaaagatagttttagatcaggctctttcagaagtggcaggtatgttttagacccgtgtattctagaaggggaagatacattttagatctgtctctgaaccttgatagaaaagtacaccttggccaggtgtggtggctcacgcctgtaatcccagcactttgggaggctgaggcaggtggatcacttgaggccaggagttccagactagcctggccaacatggtgaaaccccatctctattaaaaatacaaaaattagctgggcatgatagtgggtacctgtaatcccagctacttgggaggctgaggcaggagaattgcttgaacccaggagacagaggttgcagtgagctgagatcacgccattgcactccagcctgggcaacagagtgagactcttgtctcaaaaaaaaaaaaaaaagaagaagaagaagaagaaaagcacttctaattagccacatcagtgataggaccttagctgggattggttttgttctgaggcaagatacttaaaaaaaaaaaaaaagaagaagaagaagctgatttccaaatttagaaatgtttaaagaaaaaaggaaataaattataaaatttcttccaaccaggaaagagatacaaaacctggcaacatatcgtggtgattgctaccagagccacagtcaagagaaagtgattccttccacagctgtgtgagggtgaaggtctgaattgaggtggcctacccttggcactgttgacatctggggccacatcatcctctgtggtggggctgtcctgcatactagaggatgtagcacctctccccactgcttacaggatgtcagtagcaccacctccccctgagttttgacagcccagaggtctccagacactgtcaagtgctccctggccgggaacccctggtctaaatgacatttctagctgagttctcatagtataagccaggctctgtagcgagtactttggcgacgtgaactcattaattctcacaaccaaccaacaaaagagggactgttattactcaaatttgacagaggaggaaactggggcacagagaaggggcacttgacccctcatttagccaaattatcctaaaaaactcttttaatcttccgctaacctatatgtgtaccccattttacatatatatatgatagattacctatatatgtatacacacacatattatctattatttacccacctacgtgtccatccatccattttgtctgtctatgcattcatccatccatcttttttttttttttttttttttgagatggagtctcgctgtctcccaggctggagtgcagtggtgcgatcttggctcactgcaacctctgcttcccgggttcatgccattctcctgcctcagcctcccgagtagctgggactacaggcacccgctaccacgcccggataattttttgtatttttagtagagacggggtttcacccaccgtgttagccaggatggtctccatctcctgacctcgtgatctgcccgccttggcctcccaaagtgctgggattaccggcgtgagccaccgcgcccggcccagccatcttatcaatgcatcctctatccattgatagatacacctatattatctgtcttatctatgtatccatctatattaggtatctatatcatctatttatctaatccatctatccatttatctatctctatctatatattatctatcaaccaatctatttttccatgcatccgtctctattatctgtcagtcatcttatccatcaatcttatgtatgcatcatccatccatctatccatccctgtatatttctctgtatatatatctacccattcctctctctatctctatctatccctctctatatctatctgtgcctctgtttttctctatatagctatatctatctatccatccatctatattatctatcaactaatctatctttccgtctacccatctgtctatattatctatccatctatattatctatctatcatcttatccatccatccatttatcttatctatgctcatccctccatccatccatctctgtatattcctctatctctatttatatccacccattcctgtctctgtctctatctatccctctctgtatctatctgtgtctctctctctttttctctcgatagctgtatctatctatccatccatctatccatgcatccttctctttctatgaatccctttctctatcagtccctctctctttctctatctgtaactacccttccgtccatgcccctctctatctacctgcgtctatatctgtctctttctgtgtctatttatccatctctctatatccatatccctaagcagaggttctcccctggtctgaccatcaagcaccagtgaaagaaaggggcggggccaggcacagtggctcacacctgtaatcccagcactttgggaggctgaggcgggcagatcactaagtcaggagttcgagactagcctggtcaacatggtgaaaccccgtctctactgaaaatagaaaaattagccgggtgtggtagcaggcgcctgtaatcccagctacgcgggaggctgaggcaggagaatcagttgaacctgggagatgaaggttgcagtgagccgagatcgcatcattgcactccagcctgggcaacaacagcgaaactctgtctcaaaaaaaaaaaaaagaaagaaagaaaggggcgtggagaagagctgactccagatggcagaggtttaaaattgttctcccattcagaacacagcccaaaccaaatggaaagtgatggtgggtggcctgggggacacattctaaagcgtttctccttgccttcaaggtctctctgtggcattctattttgtttttatgcctatacagaagcattcttccatagaacttttctgcagctctggccgggcgctgtggctcacgcctgtaatcccaatacttcgggaggctgaggcggatggatcatttgaggtcaggagtttgagaccagcctggccaacatggtgaaaccctgtctttactaaaaatacaaaaattcggctgggtgcggtggctcacgcctgtcatcccagcactttgggagggtaggcaggcagatcacctgaggtcaggagttcaagaccagcctggccaacgtggaaaaacctagtctctactaaaaatacaaaaatcagccaggtgtggtggcgcacgcctgtaatcccagttacttgggaggctgaggcaggagaatcacttgaacctgggaggcggaggttgtagtgagccaagatcgcaccactgtactccagcctgggcaacagagtgagactgtgtctcaaaaaaaaaaaaaaagaaattagccgggcttggtggtgggtgcctgtaatcccagctgctcgggagactgaggcaggagaatctctagagcctgggaggtggaggttgtggtgagcccagattgcgccactgcactccagcctgggcaacagagtctcaaagaaaaaaggaactttctgcagctctgttgtcgatgcacccacagtagctgagttctgttgtagatggaaatgttctctatctgaagtgtgaccagtgtgaccagggaaccaaagttttaatttcgctgacattttcactaatttaaatcgccacatgtgacaaccataccagacactgcagttctgtgacttcagcaccttctagaagttgtattggagttgggagaattcaacttgacaggtggcttccatagatgggtgggcaccagcattgcctgggggcttgttgaaatactgagtgctttagggccgggcacggtggctcgcgcctgtaatcccagcactttgggaggccaaagtgggcagatcgcttgagcccaggagttcaggaccagcctggccaacatggtgaaactccgtctctacaaaaatacaacaatttgccaggcatgggggtgcgtgcctgtagtcccagctactcaggaggctgaggtgggaggatctcttgagcccgggaggtggaggctgcagtgagccgagatcggactactcatatgtgcatatatatatgtgtgtatatatatatatgtgtgtgtgtatatatatatatatatagagagagagagagagcatgcgcgcgcttcctccactccatgtttctggctcagtaggtcaaacctgcgtttctagaaagttcccaggtgttgctgctactgcaggtctggggtctgggagcacatgtggggaatggggtgtgggatggcgtggcgtccgtttgcagtcgctgtctgtcagtcttgttgggtcagatgctctccccacctctagaaagggacccggttgtttgcttcttgcttttccaagacgtcccttcaggaggggagccatgggttgcaccgatgacctcttcattgtcacctggtactcgggttgaatctgatgccacgtgaccagaaccccacttgggcgcgcacacctgtgctcccaggggcttccttaccaagctgtctgcctgcaggtgggcagagggtcctcacattttggtcccttcccccaggtcaccttccgcaaccctgtcattgagaggattcctcggctccgacggcagaagaaaattttctccaagcagcaaggtgagagggtgctccaggcttcctgggggagaggccaggggtcctgggagtgtcatggagggtgacgcctgccccgtccccccagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacggggtaaggaaggagggccccatggtcccggctgccccttgaagcctgcgagggtcctgggtcccagacacaccctcctctcgtctgctgcagtgacatatcggtggagaagctgaacctcggcactgactcggacagctcacctcagaagagctcgcgggatcctccttccagcccatcgagcctggtgagggtccccccttctatccccgtaggcctggcctgggcagcgtcaggggtcctgctccaggctcagagaccactaggaacttccctggagccacgcagcatgtctgtggcagaaccagggcccagatctctatgctggttaaaacgtgtgcccagatccccatcctggttaaaaaactgctcatgcctataatctcagcacttctgggaggctgacatgggaggattgctggagcccaggagtttgagaccagcctgggcaacacagtgagccactgtgagccatgatcctgccactgcactccagcctgggcaacatagcgaaatactatctcaaaaaacaaaacaggctgggcacagtggctcacacctggaatcccagcactttgggaggctgaggcgggtggatcacttgaggccaggagttcaagaccagcctggccaacacaatgaaaccccgtctctaataaaaatacaagaattagccgggtacggtggtgggcacctgtaatcccagctacccgggcaactggggcaggaggatcagttgaacctgagaggcggaggttgcagtaagccaagatcataccaattgcgctccagcctgggcgacagagcgactccatctcaaaaaataaaaataaataaaactgtgagctcagcggctggaccccctgggttcccacccctgccgtgccacctcttggctctgcgcttcacctctgtgcctcagtgtaccactttgcaaaacgagcatatttaaaactcatgtcaatgatagaatgatcgagagagtgctgttctctaggcagaggttaccgcaagctgggagccacaaggggacctgccgggtgatggaaatgttccttatcttgatctcggtcagaggtcagcacgcgttttccagaaagggccagagagtcaatatttttggctttgtgggctagacagtccctgtctgctttgtagtttgaaagcagccacagacgatatatgtacactgtaagcgtgtctctattccagtaaaaccttattggtagtacacgcggaagtttgaacattgtagaactttcatgggcaatgaaatattattcctttttttgtttttttttattcccccaacgatttaaaaatgtaaaaatcagtttacctgtggtcccagctacttgggaggccgaggcaggaggatgacttgagcccaggagttggagtctggcctgaacaacatggcaaaactccatctcttttttttttttttttgagatggagtctcactctgttgcccaggctggagtgcagtggcgtgatctaggctcactgcaacctctgcctcccaggttcaagggattctcctgcctcaaccacccgagtagctgggactacaggtgtgtgcccaccacacccagctaatttttgtatttttaatagagacggggtttcacctcgttggccaggctggtcttgaactcctgacctcagatgatctgcccacctcagcctcccaaagtgctgggattataggtgtgagtcaccatgcccggccactgcatctcttaaaaaaaaaaaaaatagtgaaagccattcttagctcttacaaactataaaaacaggctggcccaccagccagcatttgccaactcctaggctggctgatggtttcctgggtggatgcatatgtaacctgttcctcttgcccacctcactgaatgcattttatttatttatttattttgagacagagtctcactctgtcgcccagaatgggcgttggaatgcagtggcgtgatctcagctcactccaatctccgcctctcaggttcaaagatgcccatgcctcagcctccctaatagctgggactacaggcatgtgccatcatgcccaactaatttttggttttagtagagatggggtttcaccatgttggccaggctggtcttgaactcctgacctcaagtgttctcccctctgcagcctcccaaattgctgagatacaggtatgagctactgcacccagcctgaatgcattttatcttttatcttttttttttgaaacggggtctcgctctgccatccagggtggagtgcagtggcgcagtcatggctcgctgcagcctcgacctcctgagctcaggtgatcctctcacttcagcctcccaagtaactgggactacaggcgtgcaccaccacacctggctaattttttatagatctaattttttagaaagtagaagtaatgggttgggcatggtggctcacgcctgtaatcccagcactttggagtcaagagatcaagactatcctggctaacatggtgaaatcccatctctactaaaaatacaaaaattagccgggcgtggtggcgcacgcctgtaatcccagctacttgggaggctgaggcaggagaattgctggaatctgggaggcggaggttgcagtgagctgagatcacaccactgtaccccagcctgggcgacagagtgagactcagtctcaaaaataaaaaaaataataataaaaaatggacattgtcaagccaggcatgatggcttgcacttgtagtcccagctactcaggaagctgaacgaagaagatcgcttgaggccagaagtttgagaccagcctgaggaacagaacaagaccccatctctacaaaaattaggccgggcgcggtggctgacgcctgtaatcccagcactttgggaggctgaggcaggtggatcacctcaggtcgggagttgaagaccaccctgaccaacatggagaaaccccatctctactaaaaatataaaaaattagccgggcgtagtggtgcatgcctgtaatcccagctgtttgggaggctgaggtaggagaatcacttgaatccgggaggcggaggttgcagtgagcgaagatcacaccattgtactccagcctgggcaacaagagtgaaactccatctcaaaaaaaaaaaaaatgagctggacgtggtggtgcatgcctttagtcccagctactcaggaggcggaggtagagttggaggctgcactgagctatgactgcgcccctgcactccatcctggaagacagagcaagaccctgtctctaaaaaaaaaaattcaggttgggcatggtggctcacgcctgtaatcctggcactttgggaggccgaggcgggtggatcacctgagatcaggagttccagaccagcctggccaacatggtgaaaccccgtctctactaaaaatacaaaaattagccagccatggtggtgcaggcgtgtggctggaggagagtgagtgaggggctgcgtgggaggagaggtgaggacagagaggtcgggggcagatcttgcagggcctcggaggctgctgtggttatgagggcatctctgactccccttactctggcctcctctctccgccacagagctcccccatccaggaatccactgctcccgagctgccttcggagacccaggagaccccaggccccgccctgtgcaggtgacaccactccctggccccctgtccaccacccctgcccgctgtccttgttctcaccagtggcctctctccacagccctctgaggaagtcacctctgaccctcgaagatttcaagttcctggcggtgctgggccggggtcattttgggaaggtgaggtggagggcagggaattgggagaccccccaggtccctggctggccgctaaaaccacccctgcccactgtggttccaggtgctcctctccgaattccggcccagtggggagctgttcgccatcaaggctctgaagaaaggggacattgtggcccgagacgaggtggagaggtggggacctgccgtggtcctctggggacctctttcttctcttttgggaaatgacagagcagttctctccttggagctacagggagagtgactcatagtagtcactaacgccaggcacagtggctcttacctgtaatcccagcactctgggaggccgaggcaggtggatcacttgggctcagaatttcaagaccaggctgggcaacatggtgacacccccatctttacaaaaaatacaaaataattagctgggtgtggtggcacatgcttgtagccccagctactcatgaggctgagataggaggatcgcctgagcccagtaggtcaaggttgcagtgagctgagatcgcgccactgcactccagcctgggcaacacagtgagaccctgtctcaaaacaaaaagtcactaatacctactagcctaataccaagataataatagctcttaggaaagttattcatttgttcctccatgtagccctataagataaatactgatggcacagagaggttcagcaatttacccaaggtcacacagccagtaagcagcaggtccaggattcaaagctagagactcaggctctgaagcctgtgccctttgtggtgccaccatactgcctctgctttagggtcaggttcctgggttcaaatctcaattctgcagcatgggcttggagatcctggggaggtcacttctcccttcagaacctcagcttcttggctgggcatggtggctcacgcctgtaatcccagcactttgggaggctgaggtgggcagatcatctgaggtcaggacatcgagaccagtgtggccaacatggtgaaaccccgtctctactaaaaatacaaaaatcagccaggcatggtggcgggtgcctgtagtcccacctacttgggaggctgaggcaggagtatcgcttgaacccaggaggcggaggttgcagtgagccaagatcgcaccactgcactccagcctgactctgtctcaaaaaaaaaaaaaaaaaaaaaaaagaacccctcttgttgtggagaagcagaatgctattgccttccacacatggttgtcaggtgctctctacacagtgcctaacccctctaaacattcggtacaggcactgagattgtgcctggtcttcccagcatccttttgataatcaggaacccaactgagaaagactgaaacaagtaaagaaatttattggtctggatctgaaaagtccaggagtgtgctaccttcaggcatggctgtatccaggtgctgagatgacgtttctcagttctgcttccctctgtatgggctttggttgccatctgggagtctggagtaagtggcggccatggtctctgacttctatcccccacccctccccagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatgtgagcctggaccccagcccgggcccctgcctcccctacagcatctgacacttagtccccccgagaggctggcagcctgcttctcacccctccaccctcaggccttgcttccctcagcctcccagagctttggggagactggggggcttttgaggatgtggaagccaggcttatgtgaccctccctccttgcagggtggccccacccctctcagcagcctctctctctctgcagcttttattccgcctgcgtggtgctgggcctacagtttcttcacgaacacaagatcgtctacaggtgtgtgcgtgtgtgcatgcatgtgcacactgcccgttgtggggacaggacccagacccccgctcatccctctttccacccctccaacccccaacagggacctgaagttggacaatttgctcctggacaccgagggctacgtcaagatcgcagactttggcctctgcaaggagggtgaggggctggcctctggattagacaaaggagggggaaggaatggggtccctaaccctattcggggtgccccccaccctgaccctgggacagggctggctgtgtggacaaccccacattgggctgagtgactcctctggcccccataacctcacatggccttgctgtccccagggatgggctatggggaccggaccagcacattctgtgggaccccggagttcctggcccctgaggtgctgacggacacgtcgtacacgcgagctgtggactggtggggactgggtgtgctgctctacgagatgctggttggcgaggtgagaccccgcccctgtgtgtctcggatctcattggaacctgcgcgtgcccagggtgggatccaagtctgcctccaccatgtgttgtgtgattgagggctgctggctctgcttccctggcctcagtttccacatctataaaatggggcatttccctgcccaagtaagccagcacccaagagctgcagcagagtgtggggctcaggccgggctgggtttggagcagccagaggaggggcctcgttcaccccgggcctccctctccccagtccccattcccaggggatgatgaggaggaggtcttcgacagcatcgtcaacgacgaggttcgctacccccgcttcctgtcggccgaagccatcggcatcatgagaagggtgaggacccccgacgtggggcgggcctggggaggggcagtggggcccaggaggggacagatcctgacacagtgctccttcctccaagctgcttcggaggaacccagagcggaggctgggatctagcgagagagatgcagaagatgtgaagaaacagcccttcttcagggtgagattccccacaaggacctcagtgaccccggccctcccccagggccgattcatcaccccacagcagacggcccccatgcctagccgctttgcctcaagggcctcgttgcgcctcaagggcctcgttgcacctccagggcaacatcgtcacctcctttgacacccccatttccctcctccacttttgttccccccaaggaccctcctaatcccacatctccacttttcccttttttttttttttttagccagggtctcgctctgtcgcccaggctggagtgcagtggctcaatctcggctcactgcaacctccgcctcccaggttcatgcagttctcctgcctcagcctcccgagtacctgggattacaggcgtgcaccactccaccacaccaggctaatttttgtatttttagtagagacggggtttcgccatgttggccaggctggtcctgaactcctggcctcaagtgatcctcccgcctcggcctcccgaagtgctgggattacaggcctgagccaccacgccgggcctccacttttcctaatccggcttctccaccaggctctcgcaggtgatccctcctgagccccagtccccccaccccacttgtcctctgtatgctcactcctctccgtggtccccgagccccaggactggtccccactgcagcacgccccctcctcagcctccaggctgaccctcccctccgcttccctcccctgcagactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggatccttgc

SEQ ID NO: 36102 - DNA, 18242 bp, Homo sapiens
agagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtgtgagagaccattgggggtctgtagggggaaggggagtgggggcgtgtgtaaggggcagggtgtgtgaggaggagaggaaccccagcaaagagtagtaataataatggccaccgtcacacgataatattcgagtaatatgtgcggggactttacaaagcatctcatatgcttcattttaacttctactccaatcctccgaggtgcgtactgttatcaaacccattttacaagataggaaaaccgaggcacgaaatagattaagtggcttatgcaaggacacacgactactacgtggcctggcctggcttcgaacttagttatcttagtcctaaggcccgtaattttaactttgctttaccaaacaaaaacagaagaagaatggcgtgtcagaaggaggaggactgagtgtgatttgaagtggaaggatgatgataaacgagaagagaatgatgatgggagacggagtagtggggaggaggacctgaatttggaatcttgcgggcctcccccttctaaatcgccgcctcttccttagttcttgcggccccataactttttcttggtgttctatggctttatgaatggaggagccaactcacagacctgggccattcgggtggttttaagaagtttgaactgcggttcaatccagggcagtgccttgagacactgtttggaggtaagggagggtcagaggatcctcttaaacgctgctgctatttatttcttcaaacgtgccacttccttttctatcatatctatgcacggcaaagcctttgttcagtcctctagaataaggaagtgatgtttattgtttccttgtacacttgggcttaaacgaacaaaatcagactcaacgtttcttttcccgagcaaggccttgattgcttgcagagaaaactttcctgtggctttatcattagttgcccttcagagctttcctgtgtaaataagaagctatgttttggagaagtttacaccgtagatgaacgggagcgatctgaacatactgcactgcaggtcaacacagagcagggacttcagtaattcataggtgtgagtgtgtttgtgaaaacctttccttcttgcacagttttctgtgtagctcatgtgggagtcaagtttttaagtcagcccgtgaggcaaacattgtatgtaataaaaattaacccttaaaaattcctaggaaggtgcaacgcttgagattagcatcctgtttctgactacatcctggacggtttttccttcagttttgaaacttgttactgttgctttggttgtaacccagataagtaattagattacctttaggggctgtgttgtgcaaataagcatatttgaaagccatagagttgtgatgcgctgtgagatgcttgccctgaggaggcttaaaaggaggaagacaaacccctatcttaggctcattttggagcatgtgcttacaaagtggaaagtggcaggcagaattgctggtatgatgatgatgatgatgatgatttttttgagacgtgctcttgctcagtcgctgaggctggaatgcagtggcgtaatcacagctcactgctgcagccttgacttcctggggctcaagtgatcctcccagctcagtctcctgagtagctgggactgcaggcacacactaccatgcctggctaagtttttgtactttttgtagagacggggtctcactttgttgcccaggctggtctcgaactcctggctcaagtgattctgcagtctcagcctctcaaaagtgctgggattacaggtgtgagccactgcccttatcctgctggtatttaagttgctattttattttattttttggccagcatatgcagtaatttgacttgctaaattaaatgtgcatagtgcgattcctctttaatttttgagtggcactacattcaggggcttgcaagctattgtttacttccccacagatcctagctaactttggagcaaaaatggcttacatatttttgccaactgtctggcttcggcagtccccatatatatgccagatatgtataacagtggttagctttttaaaaaccaattctcttttaaatggaagttaaaggcgtcttttggttgtgtggggttttttgttgttgttgcttttgcttttacggaaacatctctcaaaaactcaggagtgatacacccacttcctccaaagtagttatggttatgtttgaaatgacaccaaaaatgaagggtattatttcagttagggaaataaggaagtaccaccgatttaacattatatgggtatagaaaatggttttaaggccttttgcaggggagaaatcttaagcaagtttaggaatctaaaattctgagtcgaaacattttctgaattatggtcagatagtgtaatttactccacattcattctgaacttctctcttttcctgatctttattgttcttttgcaagcctgtaatagaacaaaaacaagagaagaaatttattctggctttaagaagtttctactatgttttttgggggagatgccacatagtctacttaagtttaattactgtaattacagagaaaaatctgtggaagtataggataccttgaataaatggaatcttcaaggtttgctggcaaaccaacagtttgatttctcagaagtttcttagagaaatgatgccagttttgttttgctccagattctcattgttgcatctgccaatcttgaaaataggaagcaaagattttccttgctctgtcccttgggaaccacttacattcgttttactgtttctaggaaattttctttaaatatatacattagagcccactattgtgttgtggatccatgcagtgggcttgccttagaagtaagtgcctttatgataagctcttttttgtttgtttgtttgtttttgagacggagtctcgctctgtcgcccaggctggagtgcggtggcgcgatcttggctcactgcaacctctgcctcctgggttcaagcgattctgctgcctcagcctcccgagtagctgggactgcaggcgcgtgccaccacagccagccaacgttttgtatttttagtagagacggagtttcaccgtgttagccaggatggtctctatctcctgaccttgtgatccgcccgcctcggccttccaaagtgctgagattataggcgtgagccaccatgcccggcttttttgtatttttataaccaggccttgtacgttgtttgccataataataacagcattcgtcagagacccaatcatgttgaatttttttctcacagaatactttcccctccctgatttttctcctggaaaatacaccatgaatcattctgtttctggttgaatgatttacaccagccatctttagtcctactgttgaattgctgcatagtttctttttaatttatgtgtttaaaagtaaatactggccggtggatcacaaggtcaggggttcaagactagcctgaccaatatggtgaaaccccatctctactaaaatacaaaaaatagctgggcgtggtggcgtgcacctatagtcccagctacttgggtggctgaggcaggagaattgcttgcacccaggaggcaaaggttgcagtgagccaagagtgcaccactgcactctagcctgggcgacagagcaagactccatctcaaaaaaaaaaaagtaaatactaactaaaattctgatttgcattgtggtttttagggttcagattagcaagtgggattgttttttagcacttaaatccctcacttcatgctctgtttgcacaaatctaaagaggcactggtatgtctaaagaggcactggtattgtttattacctctagttgtatttgactttgggattgtagagaaaaataatttccttttgtgggatgggggaagaatcccatgccagtattcatcatatgggtacaaaggcttgagtgtgagagtttaggtccacattctttcaggttttcagagatctcaggtacattgaaaatggctaagatgattcctgtaggactgtttccatgatttggtctctgtgcaaagtgatgtgaaagtcatggataagggcatatttgtggtaacggaattattttggtctagtctacagagagctgaaaaactagggtagtggtttcacttctgtggcagaggactgctgggcagaagtttcaataacttcagtttcttcaagaaagaactgtgtgtgtgtgcgtgtgtgcatgtgtgtgtgtgtgttgacaaagtttctccatcatataaaatggagaataaatataatcttaatgttttaaactaatgaagtgattgtaaaatattattttgatgtctttgttgtgttgacatcttatgtgtgtgtaaacttacatgattttaaaatgttttacaatctagatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggtaaggagctctactctgactcaccttctttgtcacttttaaagttggggtcttgctctgttgcccaggctggagtgcggtggctattcacagatgcaatcatagctcactgcagccttgaactcctgggctcaagcagtcctcccacctcacctttccaggttgctgggactgcaggctcataccactatgcccagcttgactcaccttcttatatggatgggtttagggaatgtttaatttgagattttgaaaagaatgggtatgttccactaaagccattgtaaattaaaccggatggaaggttgtgttgcttcatgaaatatcaaggtagccagtgtctctgagaaggatgtaacctctagtatcttagattttttataacattattctgtttgaaagtctttaaagcagaagttacgtcatcccctagggcccagctgttccacagatatgttggatttgactatacgatgttaagaattttaaaaatttattgccagcatttaaaagtcaatagaactcacttgaattccagatttctggcatctctgaaaaaaaaaaataggaagatctggcaatatctgttatccactcctgcctgacactggctggagagagagatgagtattgtggtaatattaagggcctcctgtagacgggcatgtgctctctgttttactccagtcccgattacttgtactattttcatacctagctgactttactcctttacattagctgcttggagtttgtgactcctgctttagaaattatagagttggccgggcgcggtggctcacgcctgtaatcccagcactttgggaggccgagacgggcggatcacgaggtcaggagattgagaccatcctggctaacacggtgaaaccctgcctctactaaaaatacaaaaaattagccgggcatggtggtgggcgcctgtagtcccagctactcgggaggctgaggcagagaatgcgtgaacccgggaggcagagcttgcagtgagccgagatcgtgccactgcactccagcttgggggacagagcgagactccgtcccaaaaaaaaaaaagaaattacagagttaagtctttagcttggtattcagagctccttccagtcttttcactcaagctaagcctgtctctttatatttttttctgaatggctgtttcacttccctgtatttgtatttttattcatatattgttctctacctagaatgttcttaattgactgcatatctacctgtagttactcaactctttctattgacattctgcttatttaggatcaagttgttgtgcaaagcttcatgattttagtgcttcttcagtagataccaacaagatcagtattttaagataggattttggctgggtgtgttggctgatgcctgtaatctgtgcactttgggaggccgaggcaggtggatcacttgagaccagcctgggcaacatggtgaaaccccatctctacaaaaaaatacaataattaactgggtgtggtggtgtgcacctgtagttccagctacttagggaggctgaggtgggaggattgattgcacctgtgaggttgaggctgtagtgagctgtgattgtgccactgccctccagcctgggtgacagagacagaccaaccctatctcaaaaaaacacaaaaagaattttgtgcccaagtttggggcttgccacataacttttataaatggaggtaaaattttatttatgaattaccaattcagcatccactgttttgtgaaaccttgtgatgagagactttttccttttccaggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacgtaagtgatttctaaataaatgcgttaattttaagttttgttttcactgaatccaggtgggtgttggatagagcggtcaagcagaggacggaacagggaatctcagcaagtgaagtcctgcttaaagaactgcagcagctcaacaatgaaaagataaacaacccaactaaaaatgtgcaaaagatagacttttcttgaaagataatgtacagatggccagtaagcacatgaaaagatgctcaacatcattagtcatgagggaaatgcaaattaaacccacattgggataccacttcacacccactagaatggctatagtcaaaaagacataataagtgttgttgagggtgtggagaaaattggaaccctcatacattgctgctgggaatatagaattttgggggaaattctggaaaatagttttgcagttcctgaaaaggttaaacatagagttgccatatgacctagcaattccactcctaggcagtggaaaattccatggtatgtatataccgcattttgtttattcatctgttgatagacacgtgggttttttctacctcttgactgttgtgaatattgctgctatgaacatgggtgtgcaaatatttcttcaaggtcttgccttcagttcttttggatgtatgcccaggaattttcaaagaaaatttcggggagactgtcattttgctgattgcataaaatgatgttagtgtacttcctattgtatcctgctttgtttaactgggcatcgggagtgtttcatgatttaggagtaatctttttttcctgtcaatacagggtctcgctttgtcacccaggctagagtgcagtggtgctaacatggcttactgcagcctcaatctcccaggcttatctgatcctcccacgtcagccccctaagtagctgggactacaggtgcacgccaccatgcccagctgattttttgtagaaagtgatcagcccgctttggcctcccagagtgttgggattacaggtggagccattgttcctggaaggagtaattttttttattgttgttcgtatgttttggaaatttccttgaggttcaagtaattttgggagatcatctggatctttcctttaactgcattttttagtttattgtcaaagcctgtagtttgtaccataaaaataatataatacaaggaagaaaaatgagttatttcactgagtggtttgggtatgtttgggtttaaaataatgtttacttgcagccgggcgtggtggctcacgcctgtaactccagcactctgggaggccgaggtgggtggatcactggatcacttgaggccaggagttcaagaccagcctggccaatgtggtgaaaccccatctctactaaaaataaaaaaattagctgggtatgctggcaggtgcctgtaatcccagctactcaggaggctgaggtgggaggatcacttgaacctgtgaggtggaggctgcagtgagtcgagattgtgccactgcactccagcctaggtgacagaatgagactctgcctcaagaaaaagaaaaaaaataatgtttacttgggattgaagcctagttataataagcaaaacaaaaaaaaaatgtttatttaagtggaaaagaaacttgtgattcatcattggttttaatttagtggaaaaaaatcaagattgcagtggttttcttattgtctaacccaagtttatatgaaaagcaagtgaaagtctagtggaacaggagtcgtttagcttatttccttacttttgtattacatggtattataaataattcctgtggttgaattaatggatatatctttagagtggaatattatgacagtgttacaatggatgagtattgatttgtaaagatggtctgtgatgtagagatgtaagggatgtaggtgtgtatgtgtagatagagaaaatagtctggaaagatctgtaaacaaaggtattggatctgtggggtagcattatacgaccattaattttttcagtttttttcatgacagagtcttttagataatcatctgtataccaagtaataacatgttacaagttatttaattctgtcatctagtaattttgattaagagaaactacaagtagctcaaacaattacactagtattcattgtttgaaccattagcaggaatagactactttaaggctggctgttgcttcacgtgggttacaaataactatttgctactttttcatagataaagcccctgaccttcatggaagcattagggaaaaagaaaacttaatttctttctttcttcaaagaacttttttcctttcactagatataagaaagaaaaagtcaacaataatacatgtgttgcttgagctaaaagacataggagaacagacaacacatacccattacatttctaggaaatacgaggtaaagagaaaaaaaatttttaatgtcttttttaaaatataaaagctttagttaagttgtaagtctgtacaaagaagctagatttgctactctccaagaagtgaagggacctgctatgtaatatacagaaatcatttacttcctttccttttctttttttttgaaacagagtcttgctctgtcacccaggctggagtgcagtggcacaatctcagctcactgcaacgtctgcctcccgggtttaagcagttctcctgcctcagcctcccgagtagctgggattacaggcgcccaccaccatgcctggataatttttgtatttttctagtagagacggggtttcaccatgttggccaggctggtctcgaactcctgaccttgtgatccgcccgccttggcctcccagagtgctgggattacaggcatgagccaccatgccccacctatttactgccttttctttttcttttcttttcttttttttttttttttttgaggtaatgtcttgctttgtcacccaggcaggagtgcagtggtgcaatctcggctcactgcaacctccacctcccaggttcaagcaattctctgcctcagcctcctaagtagctgggattacaggtgcccaccatgcctggctaacttttgtatttttagtaaagacggggtttcaccatcttggccaggcttgtctttaactcctgaccctcgtgatccacccactctggtctcccaaagtgctgggattacatacagttgtgagccaccgcacccgacctatttacttcataagaatataacttgagctttgccaaagctttatgttccctgagggcatctaaaacgccagttcatggaacaggcacttctttctcccactcctttccatttatgctgtagttttcatggatttctgctcagtgtcacagacggtggccaagaggctatccaagccttgttctgccagaagtaggtctggaggctggtcctcttctgggcttcctacgccacttgagtgctgcagctactgggattccagggctgtggcttccttggcctggaccacttcctccctctgcaggtggtactgttaagtttcatccttagctgctcctttgatctacttcagcctctgggtcttttgctcatgggccttggataccttctcagtggcacatttctcagcctgcagcagctgctggatcccctgagactcactggccatggtggcggtgtctgagtctgaggcaagcagcctgaatcagctggaaggcgcgtcaggtcatcttagctggctgcccaccatctgtgcctcaatatttttttgttggtttattttttttttttgagatagagtttcgctcctgttgcccaggctggagtgtgatggcgctttctcagctcactgcaacctctgcctcccaggttcaagcgattctccaacctcagcatcctgagtagctgggattacaggcatgtgccaccacgccctgctaattttgtatttttagtagagatggggtttctccatgttggtcaggctggtctcgaactcccgacctcaggtgatccacccacctcagcctcccaaagtgctgggattacaggcgtgagccaccccacccggccttgttggtttttttttttttttttttaagtttatttatttttttgagacagagtcttgttctgtctcctaggctggagtacagtggcgccatcttggctcactgcagcctttgcctcctgggttcaagtgattctcatgcctcaacttcctgagtagctgggattcaggggcatgccaccacgtccggctaatttttgtttttttgtgtttttttttttttttttgagagggagtctcgctctgtcatcaggctggagcgcagtggcgcgagcttggctcactacaacctctgcctcccagattcaagtgagtctgctgcctcaggctcccaagtagctgggattacaggcgtgcgccaccacgcccagctaatttttgtgtttttagtagagagagggtttcaccacgttggccaggatggtcttgatctcttgacctcgtgatccgcccaccttggcctcccaaatttctgggattacaggcatgagccaccacgcctggcctaatttttgtatttttggtagagacagggtttcaccatgttggccaggctggtttgaactctgggcctcaagtgatctgcctgtctcagcctcccaaagtgctggtattacaggtgtgagccaccatgcccggcctacttattttatttttgagacaggatcttgctctgtcacctagactagagtgcagtggtgtgagtcccctccagttcttggcctcaaacaatcctctcacctcagcctccggagtagttagaactacaggtgcataccaccatgcctggctaatctttgtttgtgtgtgtgtgtgtgtgttgttttttttttgtttgttttgttttttttgagacggagtctcactctgtcacccaggctggtctggaactcctggtctgaagtgatcttcctgccttggccttccagagtgctgggattacaggcgtgcaccactgtgcctggtgttattggtttttttttttttttaaataatgagcaaatgtatacctattataattaggaaatttagtttatggaggaaaatctcatttttctatctgtcacagaaatatgatctactttgcatgcttgtttgaatgttggaaagagtgaattgatctattaagttaggaaaagcatttcaaaaatacttgtactataattataaggtggtggtaatagtgtggccactacttctgtttcattattcaccagttaataaataaacaccttgttttttagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcataggtcagtcctagggaatgtgtatttctctctcactttgggctacactgaagcagggaattgaattcttagtcatttttgcagtcctagtgactgttctgttcagcagcagcagccagaagttgaattggtgcttgttgcccatgtttcagtttttcacaaaacactggggctcatatactggtttgtttcacacagtatttggctctatcatgtggctatcagtgggtttaattccaagtgggaatatggtgggtgtagagggtcacagtacttggttatcttttaaatggctgtctcggagtttcttaggtacttgaaagccagattctccttattttaacttctcagtacttttggatttttggtgaatcgaatctacaattaaaccccttgggtacttttttatatctcccatattagtctgttaggttgttattagaaagttcagattataggccgggcgcagtggctcacatctataatcccagcactttgggaggctgagaaaggtggatcacctgaggtcaggagttcgagaccagcctggccaccatggcaaaaccctgtctttactaaaaatacaaaaattagccaggcatggtgacgggtgcctgtaatcccagctacttgggaggctgaggcagggataattgcttgaacctgggaggtgaaggttgcagtgagccgagatcgtgccattgcactccagcctgggcaacagagtaagactctgtctcaaaaaaaaaaaaaaaaaaaaaagattcagattatagtacgataaactactcagaaaaagtgaaagttcctaacatgaagtagcatttacaagctttgagaaataaaatggttgaacactggggcctgataaccactgcttttttaacctctgtggtttattctcttgtagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaaggtatatgatgtttttcttaataccagtaacaaaaagaaggacagaaaaaaagctgactttgctttattgttacgtgttcagcatgcatttttgagtactagatgctagtgtggtggtagacagggtataatataaagctgatttggtcagatatttgtgtggtaacgatctttaacctggccatgaagggaaccctctgcttctgtcatcttaaggcaggcattcttcactcgagggccatgaacctaatgaaaaggtataaatgctgtttgttagggatggggtctgtggtataacagattcttagaggagttcttaactctagaaagttttagaacttggtaccgtaataaattgttgacatagagctttgctgtctagaattagagtgggatttactatttcctcagccttgcaattctgattttaatggcagagttctggaaaaattaacaacatggaaaggagcaaaatgtaggatgtagcacaatatagcgtctggaaaaagggaataaaagagctaaaaagaggttactaaggcctgttaaataaatggcctgtccccacttcttgctagaattcagtgaactcataactgcacttagttggctccagtaggggcatgttgggtttgtaatattatctttgttctccatacatctccagggaggtcttcaggaagttgctgatcagttggatttgcagaggattggaaggcagcaccaggcaggctcagactcactgctgacaggaatggctttctttaggatgaaagaggtaagcttccttgaatgtgatcacaggcctctcggcagtaacttgctgaaggctaaggaggtagtggatggtctgttatgtgggctgaggtttgttgaacatttattttttatttatttattatttattttttttgagatgaagccttgctctgtcacccaggctggagtgcagtggtgcgatctcagctcactgcaacctccgcctcccgggttcaagcttttcttctgcctcagcctcctgagtagctgggattataggtgcccgccaccatgccctactaatttttgtatttttagtagagacagggtttcgccatgttggccaggctggtttcaaactcttgacctcaggtgatctgcctgccttggtctcccaaagtgctgggattacaggcatgagccactctgcctggccgaattttttgtatttttagtagacacggggtttcactatgctggccaggctggtctcgaactcctgacctcaggtgatccgcctggcttggtctcccaaagtgctgggattacaggcgtgagccaccacgcccagccacatagactgtttttttagcaagttgatgtccactttgaaagtggttgttttttgttatggtattctgcatgtcacatgtttgagaggcaaaagcagcattctgacgtgaaagccactttccagtaaccaagtattcttgagcacacccaagtccagaacttcatgttcttgtcagctctaatcctttcagttatttgctttttttctgattcctgtaatagaaatatatttgttaggccacctactgacattatggtaagttctgttaattattattaaataaatactatattgaatttactataaccccttagtaaaaattagactcttaatttcttcttttagtttctttactcactgactcaggttttaaaatatattcaaagatgtagaaggagtaagacgctgctttgaaaaattgaaatattgattttgttgacacttttgaggaccggatcagattaattgatctgtagacatggatctcctttttagaactaagattgtagagagggagagtacatttcctctttgttactcttaattataaacaactgttaccatgtgttggtaaatgttctaggtcagtgattctcaactggggatgattttgccctggagggtacatttgttaatatctgtagatgattttggttgtcacaatctggtgggggagagtggtgtgctacctgtcaggatgctgctaaacatcctgtgatacactggacaagttcccccaaataattatcctaccccagtagtgccacagtggagagatcttgcgttaagtgcttactgttcgttatctcattcctcataataaccctattatcctgttttatagatagggaactatggcttaaaaggagtttaaatgactttgccaaggtcaagtgagtccggctgaatccacagcccaagcccagcccattgctctgcctgttaaagagaagggagcagttgtgttaaacagcagcagcacagagatactggcagtaaaagaatacatggaaagtatgttcagataggagagcctttctcctatagagaaaggagcatgaaaagactgcattaaaaggaaaggtttaggccgggtgcggtggctcacacctgtaatcccagcactttgggaggccgaggcaagtggatcacttgaggtcaggagttcgagaccagcctggccaacatggtgaaacctgcctctattaaaagtacaaaaattagtcaggtgtgatgacatgcacctgtaatcccagctactcgggaggctgaggcaagggaatcacttgagcctgggaggcggaggttgcagtgagtgaaaccctgtctctttttctttttctttcgagacggagtcttgcattgtcacccaggctggggtgcagtggtgtgatctcagttcactgcaacctctgcctctcgggttcaaacaattctctgcctcagcctcccaagtagctgggattacaggtgcctgccaccacgcctggctaattttttgtatttttagtagagacagggtttcaccatcttggccaggctggtcttgaactcctgacctcgtaatccacctgccttggcgccccaaagtgctgggattacaggcgtgagccactgtgcctggccgagcctttctatactattagtttttttttctagtttggtatattttcagggctttaggaaggctgggaggtggtgatgtggtagtggtttttttcttttttgagatggagtcttcgctatgttgcccaggctggagtgcagtggtacggccttggcccactgcaccctctgcctcctgggcgcaagtgattcttccgcctcagcctcccaagtagctgggattacaggtatgtgccaccatgcccggctcatttttgtacttttagtagagatggggttttgccatgttggccaggctggtctcgacctcctgaccccaagtgatctgcccgcctcagcctcacaaagtgcttggattccagacgtgagccattgcacccggccagatgtgataatatttatacttgtcatgacttctagcataactctcaccatggttctctgtcccattctgcagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggc

SEQ ID NO: 36103 - DNA, 28849 bp, Homo sapiens
ggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgaggtgagcgctgggagggacggcctgggagcccctccttcccgccgggcccgttacctacccagaccccaggggcgggcgggcggcgtggatgcggctcgggtgccgctcgagtctcttctcctgcccggctagccgcgggtgggagcgatctttaagaaggctgggcgatgacgtttatcatgcttccttttttttttttaagcatttgggcatatataatatttttaaacatcatctttgaactttctgtaatcgggaacatcaaagaatgaaattgaagcttcagatcttcgactgttaagcttttactatttcttaacctcatctctgaggtatctaaaattcttcgataattacagtgtattttcttgctttgggaaccctttaagatctagtctcaagctaataggcgatccgtcaaagaagagaccatttcccccattagcattgtgccacactgtatttctgcatctgcaaccagagttttgggtgctttctagtttttgttcctgttcagagatagatctaagctcaaaacagttcaaagaggagcaacttgaaatgacccagtggtaatttagttgctcttgcatacgctaaagatacacatgtaaaaagttgttgacctgagcattgtatgtaatatttataatataattggaaacgaccggaagtccattagtaagagctggtgaaatattaattacggtacgtttgtataatggaacaatatactagcctttaaaaaaagaaaggtaggcgtttatgcacggagaaaatgttgcagtacagtatctgtagtgggttagaagtgcacgggggcttgggcgttgcaagatactaaaaatagaaggactctactttctgaaaataaggcttaagaaaagttaccattgaaattggtagtcagaagctaaaatgaggatgtttgtgaaatctcagaatataggaacctagggcattcctggataaaggatcttatttaggaccataaaaggaactactgcttggtggtggtaaattttagggatttgtgttaccttgaaggaaatattgagtaggttcacaggttagaatcgtggccttttggggctggaaaggaccttagtttttgtctagcaactcccacgctcatggatgcttgaatcttacattctctcacacacaattttccaacttctttgggctaagccacgttaaatggagtgctgggggagtgtgatgtgtaggtcatggaattaagaagacagaatttcaccagaacataactgaagcaggagaaccaagttagttaaaagataaataacatccaggcgtggtggctcaagcctgtaatctcagcacttggagaggccaaggtgggaggattgcttgatcccaggagtttgagaccagcctgggcaacataatgagacctcatctcttaaaaaaaaaaaaaaaaaaaaaaggaaagaaaagaaaaggaattaaaagataagtaacgtaactacagaaggctcaaatgtagcttcagggttttcagcagcaggaatgtggtccttactggcatttatgttatttagctgttctccagtgtgagtttcttttggtccatttaccaagtgagttactctttatctctgcttctttagtttctgtttattcttaacttggatctgctgtaatttcccgtgggcccaatctatggattggcctctttctttctgtaattggttgggatttacattcaggtctttctgcctcaaaagccactatactagactgactcaactgcatagggctgcctcttctgtagtatctgtggcagggtagattcacttaaaagggactgacctgtcgagttagagttacagtcctgtctttaaagagaactatcaaaccctaattcattgaagttcatgatgtttggttccaagtggtaaaaaggatgggttttttaatgatccttgttatgtgactgtaaagcaaataaactaattctactagtaatacaatatagtcttagtctgttttctgttggtcataacagaatgtctgaaatgataatttataagaaactgaatttatttcttatggttctggaggcttggaagtccagggtcttaagggtgcatctggtgagagcgtttttgctggtggggactctgtggagttccaaggtggtgcagggcatcacatggcaaggaagctgagcgtgccagctcaggtctctcttcctcttcttataaagccaccagaaccactcacttgataacccattaatccgtgaatagattaatccattcatcagagcagagccctcatgacccagtcaccttttaaaagctgtgcctctccacactgccacattggagatcaagtttcaacgtgagtttcagagaggacaaacgttcaaaccataccaaatatacattattatttgtcacaagtcatgcaaactttatgagatcctctttgaacagaaacaataaatatacagttggccccctccacaaattcagccaataccaaatagccctttacacttgggagccattttacacaccagattcaccaacaaaaatgcaggaaaggaccctaaataggccacgaaaaggacacttgtttacagtacaagagctgaaacaagaaagcagagcgtcgccttgtttgaccccatctgggaacatgctacctcggctgtgaacggtgcactgggcaactcagaatctgccctgctctgtggctgtctgtgagcaactgctaacggacctcaaatgctagttttgggattacacattttagcaagtaggtaaacttgcaaagaaagaatcagagaataatgagaatgaaccctaccttttataggtgtcttcgttgtgtaaaatgcgatgatagtttgactcctacccatcccccagttgtgagaggatgttattttacgtaaatattaccaaggaatttttaaaaatagaattcaaacatacttcagatatatgtctgtaattcatatatggatgtactactatcattagataattctcaaaactcaatgtccacttaaagtgaggtttatataaagccatattcagatagtctagcatttctatttttttatccaattgtcaggaccgatcaaaccatcattgaggggggttttatttttttagatgactcagtgctgttattttcttattgtttatactttgcattagtgcttacgtctttttttgtttatttttgagacaagatctcattctgccacctgggctggagtacggtggcacgatcacagcgcactgcagcctccatctcctgctctcaaatgattgtcccacctcaggccaccacacccagctaatttttgtattttttgtagagatggggttttagtatattgctcaggctggtctcaaactcctgggctcaagtgatctgcctgcctcccagagtgctgggattacaggtgagagccaccatgccccaccagtacttatgtctttaatgagtggtttctacaggtaccatttgtcagataccaatttttgagggttaaattaaaactggatagaatccataaatccacataactaagtatagataaatctcagtacattgcaccacagcattcagctgttttaaacaccactgtcatcttcgatcattgtggacttcccattctttcaggataccttgaatatagggcacaacttatgaaggtctaatttagcaggcctagtgagtacatatgtgtatcttaatgaaaagaagacactgttgattctaagatgtactatccaggaagaaaaaatactgccagctatgattataagatgccatccttttaagacatgttctttttcagagatgtgaaaatgtaaaaaatgtgttttgggaattattgaaaatatgacagtaaatattgctaaagcctatcatttgagaaggattatagtttagtggttaatctggtgccagattgcctgggtttgaatcttgtctgctgcttattagcaaactttattagttgtgattttcagtgaattattcattatatctgtgccttagtttaaatattaaatgaattaataaatgtaaagtgcttaacccagtgccttaccctcaaatgttagtcttattgtaatagaaataaatatagaaattcattttttccatatctcagcggggtttttacacagtctggtttggagttcactattctgttcaattcaaattctatagtagtcttagataatgcaggcaaattctgcttgaaaaaattatgccttaatttcctttgatgtaatttaagatataaacaagcttcaactttgtctttttctgcctataaagggatgtggaatattatagtcagaggtttactgagtaaaataaaaagtttgttttctaaaagttactttttgcttacttgtaattgcttttattgttaagtcttactttaattgttcagtaacgatatcaggcttcgaagtcttatattgtgtcaatctatataagttgaatcttcatttaaagaaagaaccatttcttgaaatgtgcaattaaagttaaatcaccttgaagcaaaatcttgcttcccattccagacacagtcacaacttatcaaatgagcaagtcacaagcaacaagaagttccagtaggtcttcttaaggtggcaccatatgagctaacaaagtaaaagtgagaagcggtgacgttttcagcaccagatttaggctgtaggaaaaccagtcacccaagagggtgggggaaaactgaaaccagcaggtgctttcaccatcatggcagatctgccatgtaaatggtggtgcccctatttttgtctgcagggatactgacctcaaaggaggtcatacagttcatgatggtactgggattaagctcaggctcactccttgggttttgctattccacaactaatgttaattctgccatcactttagagatgccgactttcatatccagtgtcccctgctgacagtttcttctacttcactaactttcgaagatttcctagcatttttggagtctgttttgtaatacccttatttaaatgcttgtttttgcaagctattgttgtctttttttggatctgaataattgtactaatttttttttctgttagtgttctgttgagaaaacaagttgagtgagactttgaatatttagaacttaaaatttcatttacagaagaaagtaaactaaatggcaaacaaactgggaaaaattgaagttatataaaatgtggtttatataaatctaaagagctcaaatttatgggaagatttctgataggcaaaggatgtaaacataattcacatgaggaaattaggcaaagaaacaacagttttaaaatactgttttatacctgctgaaatggaaacacacacacacacacacacacacacacacacacacacacacacacacacacacacaaaatagctaatcctagcaatggtttggtaatttactggggacgttccaaacagtcctctttttttaaaaaaaaatctgtatggcaacatggagtgaactataaagttcttaataaactttaattcagactcttacactagcaaattttctttaaaacagcattgaatagcttatatacaaatatgttcatgtctgccttattttaaataggaaaacttatttaggttatcaatctaaatgaatcttatacagtcattaagaaggtaaaaagaaaacacaagcaacttatactacatatacttaaaacttatatatcagcatatgtattgtatatatactgtatgtactgttttatatgtatagttatatatatttttatgttttgatagcttatacatatttatatgtattatacaaagggaagaatatgctgaaatcaaaattacgaatggcttagggtgctgggattgcgtttattaaattttatttttaatttcaagaaaacttaatttctgcttgtgttctgtagttctttttcttcaatccttatcttgcaaaaaatatttacaggatgtggcgttctttctttcccattagagatactttttaaactccagaggtctttcctcattcttttttttatcctaagcaacgatgatcagttgtcgtcgttgtcttttttttttttttttttttttgagacggagtttcgctcttgtcgcccaggctggagcacaatggtgcaatctcagctcacggcaacctttgcctcctgggtgcaagtgattctccagcctcagccccctgagtagctgggattacaggcatgcgccaccaagcatggctaatttttgtattttagtagagacagggcttcatcatgttggccgggctggtcttgaactcctgacttcaggtgatctgcccacctcctaaattgtcatttttaattcaatattgttaacatcacttaggaagtaacttgttttactttgagattaacaggcacccccaaacaacattattaatatgtgtttatttttaaaatattttattacagtgtaatatacatacagaaaagcatattaagtataaatttaaagtgtcagaaattattgctaaagcacacactggctgggtgcggtgtctcacacctataatcccagcacttttttttttttttttttttttaaagacagggtctcgctatgttgcccaggttgatctcaaactcctgggctcaggtgatcctcccactttggcctcccaaagtgttgggatttataggcatgagccactgtgcccagccccccaaaacttaactactggtagcctcctgttgactgaaagccttacaggtaatataaacaattgattaactacatgttttgtatgttacaagtattatgttactacgttcttataatacagtaagctagagaaaagaaaatgttaaaatcgtaaggaagtggatcatcataaagatctttatcctggtggtctttcacattgagcaggctgaggaggaggaggggttggtctcactgtcttgggtgataaaggcgatagaaggagaggcaggctcacttggtgtaactttacaaaaatacatcataatttatgcctaacttttgtgctttttcgtttctcttaagatgcttctatgtggtactaataatcttccttctactgtttagtttcagtgtccatatcataaaagcgtccatgttgtaaaataagccaagcagtctcaaatagaactctttgtcagattgtctagtgtcaatttgtttcctggctttgcttcttctacatattcttccgtatcctctggcactgattcagaagcactcatctctatcaaatcatcttctgttaattcctctggtgtgatgtctattagctcttgaatttcaggatccatatcttgaaacccttcacccccaccaaataatccacaatctcattagttccttgattggcactgtcgtaaatcccgtgaagtcatgcgtaatatctggatacagttttctcgagcaggaattcattgtttgagacttgacagctttcttagctttttctgtaacaacaatggcatacacagtggtgaaacccttccagactttcatgatgttctccatgagggttgacagtcttttccatagagcaaggatccccacaccccaggccacgtggcaggtgcctgagctccacctcctgtcagatcaatggtgacattagattctcataggagtgtgaaccctattgtgaactgtgcatgcgcgggctctaggtcgcccactccttatgagagtctaatgcctgatgatctgaggtggaacagtttcatcctgaaaccttcccacccgaccccacaccacgcaaaagttgtctttcccgaaaccgctcactggtgctaaaaaggttggggaccactgcgtagagtgccatgtgtgctgaatcttaaaggtcctctgtgacccccgatctagaggttaaattggagatgttgtgtttgaggacgagtaaaccaccttgacacctttatagggttgaactcatagggttcataggtggccaaagagagacattgtccagaatcaaaacaactttaaaaggtactttactgccaggcacatggcttgagcctgcagccctagctgctcaggtggctgacacagtcacatcacttaagcccaggagttcgaggctgcagtgagctatgattgtgccactgcactccagcctgggcgatggagtaatgccctatctctcttttttttttaaaagcagttctgtattggcaaggtacttccttaccctggggacagaacatggacggaaccaggagggttctcgttgtccagaccttctacaaccacaagactggcagctggtgtttatcttttcccttcaaggctccggggttagcagctttatagttaaggacagttctgatcataaaccctactgcattggcacaagacagtagagttagcctgtcccttcctgccttaaatcctgatgcttgcttctcttttcttataaataaatgtcctttgtggcatttttttccccagaatcaggcacttttattctcattaaaaacctgtacaggcagatcagatgtcctttctccttaataattttttctttttctggacagtctcactttgccacccaggctggattacagtggctcgattgcagatggctcactgcagccttgacctcctgggctcaggtgatcctcccacttcaggccacccccaagtagctgggactgcaggtgtgtgtgtgccatcatgcctggctaattttaaaaattttttgtagagatagtgtctcactatggttgcccaagctgttctcaaactcctgggctcaagagatcctcctgcctcagcctcccaaagtgtgggattacaggtgtgagccattgcacctggccctttctcattagtgattttcttaatggcctctgggaactcgtctgcagcctgttggttggcagaagctgcttctctgttatcttgtaattttaaagccaaacctctttctaaaattatcaaaccattgtttgctcgcattaaattctccaactttagattcttcaccttctttttgctttaagttatcatatagtgacatcattttttctcaaatcatattagagtctatagtcttgtacaatcctgcactcacataaaagatgcatcggcaatacaaaaggcacttcacaaaatatgcaaggttttcatgctggtatcgctactgcagtgacagctttgtgaatttccttttatttgattttatttttacaatggtctttatggtggattcatgtttaaatgatgggcagccgcagttgcagagctccatctaaggtactcatcaagcgttctactttttcttgtaatgtcacaactttgcttcttgggaatgcttccagcatctctagtggcattttgtatgactcccatggtgttactcaaggtttacaatattgcactaaataggataaaaaatactcaaaaaccaagacagatcactttttattgcaacaggcaatttactggagcaacaaactactcacactgaaacaactagcatcatagagcttttttttttttttttcctgaggcagagtcttactctgttgcccaggctggagtgcagtggcatgatctcagctcactgcaacccctgcctcccgggttcaagtgattcttctgcatcagcctcctgagtagctaggactacaagcgcaagccaccatgcctaatttttttgtatttttggtagagacggggtttcaccatgttggctaggctggtctcgagcgcctaacctcaagtgatccacctgcctcagcctcccaaagtgctgggattacagacgtgcctggccgcatcatagagcattttaagcaaacttgcaacacttgaggagactgcagtagcaacaagagatagctgtgaaactgtgacatagaatagtatgtactgtagttaattttatgcagttatgatccaactgcagatccaacaccatgtgttgtatgtgcatgttttgataaattttaacgttacattttaactaggcttgtgaatattttatggtagtaaatgataaagtagactattctctatgtataatgcacttatgacataactaacttttaaggtttttttaaatatttctgggctatgtggtttatctgagtttcttcaaattgtcacaagcctccaaaaaaatttccagtagatttgttgaaaaaaaatccgcatataagtggacccacacagttcaaactcataatattcaagggtcaactataaatagagtccaagagaagatttttttttggcttctctatagtaaagggtaactgaaacttgaaccttcagtgtctgtctcccggttaaatttgttttttgttttctgccacaagctcaactatgtgacaggcagaagcctaggcatctgaagacatcggtattgttaaagcaagctctgtttacccagtctagttcagtcccagaagagtgtgatgagttcccttaaaaattacacagtcccactcctggcaggtgacttttttcaaatactaaggacatattaatttgattatggccaggtgtggtggctcatacctgtaattccagtactttgggaggctgaggcaggggaattgcttgaggccaggagtttgataccagcctgacaacatagcaagactccacctgtaaaaaaaaaaaaaaaaaaaagaaaaagaaaaagaaaaattagctgggcatggtggtgcgtacctgtggtcccacctagtcaggaggctgaggcaggaggatcacttgagtccaggagttcgagactgcagtgaactatgatcatgccactttactctagcctggggtgacagagacccagtctcttaaaaaaagagagacattctgacacatgctacaatatgaatgaaccttgaagacattatgcttagtgagatacgccagtcacaaaaggacaaatacttcatgattttgcttctgcgaggtacctagagtggtcacatttctagagatagaagtagaatggtggttgccaggtctaggggctggggagagtggggagttagtacttaatgagtacagtttcagttggggaagatgaaaaagttctggagatgaatggtggtgatgcttgcacaatgatgtgatgttcttaatgccatagaattgtacacttcgtaatggctagtgcttacttcaggagcacgtgcactaaaattggaatgatacagggaagattaaccaaaaaacaaaaaggttaaaatggtgaattttatgtatgttttaccacaattttaaaaaatgaagaaaaaaagtgcttagtccgaaatggggacactgtgggtatattagggtagaaagcaaaagaatacgaagtcacctgcaagagtaggcctgtataatttttaaggtaactcatcaaaccattttgagagtatggaaaagggaatatgttattaaaatgttgagtatgttattcttaaagggtatttcaggatctgggaaattgaaaatacctgcagtaaaaccttaacaatttagaccaaatgtggaaagcattatttaaatcagtgtaacatttacattgattctttttaaggcaggtttttccaagtacatactaagtaacaaactatatgtaacaaaataatgttggcttgtagaaaggtctttgaggtcttttttaaggagtatgtaagcatttaaaatgaaagcatttaattatcgagcaccttaatagttgtgcaaatacttcattgcatgaaatttaacagatgtttctaaagtacttataggccaggcacggtggctcactcctggaatcccagcagtttgggaggcccaggcaggcagatcacgtaaggtcaggagttcaagaccagcctggccaacatggtgaaaccccgtctctaccaaaaatacaaaaattagccaggtgtggtggcagacacctttaatcccagctactcaggaggctgaggcaggagaatcgcttgaacccaggaggcagaggttgcagtgagccgagatcgtgccattgcactccagcctgggcgacaagagcaaagctctgtctcaaaaaacaaaaataatggcccggcctggtggctcacacctgtaatcccagcactttgggaggccaaggcaggcagatcacgagatcaggagttcaagaccagcctggccaacatggtgaaaccctgtctctcctaaaaatacaaaaattagctgggcgtggtggtgcgcgcctgtcatcccagctactcgggaggctgagacaggggaagcgcatgaacagggaaggtggaagttgcagtgagccgagatggcgccactgtactccagcctgggcaacagagtgagactccgtctcaaaacaaaacaaaaataataaagtacttagagagaacgtctattgctcttcaagtaggtttgaatacaccatttctgagcaaacctttatttttctagattagaaataaacagagctgtaatttatttgcaatctaatgatttagtggtgtctgagtttgatgaggttttctctgtagttttatgctttgaatctttatgttctgagtgttaacagatatcccagaaagaaattatgccaaggaagtactcctgttgtgttttttaccgaacagttactgatatatagatcaaaaatgcctactgacttcagcgaatgtatagattttgacttgcattattttataggccaaatgaaggctaagcatgtcatagtatggtaatgttttgaatgcctgatatagatactaaatattgtgtttttaatatgtgggcactaggtgttctatatttactgacattttattgtagttacttaatggtttttaccctgagtcagcttctattccaagaaagtatatgtgaaaatagaggttggccatcaaatagaagttgaaatgttaaatttggacatttgtgaattttgatattcaggtttatctttttctgcattgggaaaaacgttttttctttttaattttagcaaaaaatcccagaagtgggatgaaatgaacatcttggcgacgtatcatccagcagacaaagactatggtttaatgaaaatagatgaaccaagcactccttaccataggtaatgttacgtagacgtcattcctcttgtgacttacttccattttgcatttcatatgaacgtctggataacagcctatttgaatttgttttattgtagatttgttactggagcactagtgaagtcagtaacctaactgcaatttgtttagtaatggtttaagtgatgtgtaagtttaaaattaagaaagccattttgtacattataatggtagtagtaaatgtttatttgttgcacctcagtggttgctagctactaatggtgcatatattagttttaacttccatgaaaggaagatgagatatgggcttgtttgcttcccaagtagaaatctggggtttactcagtctctttgcagagaagcataactgcatggatggtaacccactgaaagataggtgtcattattactgtttatgtcttcattttttaacttaatgtaatattgttgttcagatcattacatgtaatttttgacaatttcaagtctcagaatttcctaaatgaattgtgaaattacattacgcagcagtaaccagtatgaagacaaaaataatgcaagaagcattatgagaagatgaggattctaaataagtatagatacctaattaagataataccttgggccgggcactgtggctcacgcctgtaatcccagcaccttgggaggccaaagtgggcggatcacctgaggtgaaagaccagcccgtccaacgtggtgaaaccccatctctactaaaaaaaaaaaaaaatacaaaaattagccaggcatggtggcgggcacctgtaatcccagctactcgggaggctgaggcaggagaattgcttgaacccgggagacggaggttgctgtaagccaagatcacaccattgcactccagcctgggcgacaagagcaaaactctgtctcaaaaaaaaaaaaaaaagataataccttggctgggcatggtgactcttgcctgtactcccagcactttgagattacggaggcagaggtgggagtattgcttcaggccaggagatcaaaaccagcctaagcaacatagtaagactctttctacaaaaaaaaaaaaaaaaaaaaaaaaaaaaaatagttatgccctacctaccttgtattgaaaaaaataaaagatttccaagattaaaatattttgtcattgaattaagacagcataaatccaaaagttaccattaaaatagaggtaactgctgtttccatttgttctgtagtgaaagaagagttaagaactactgtattttaagtcagtgggtgaaaactttggaagataatttgaaataacctgttactaacaaaaacagtaaaaataaaaaacttgaagatattaaagactgatgagcataaaaagaaataatgaaataggtacagatgctgaaactcaatactgatgaaatttgagtgaagaaatacacagttttttgtggtatatatgtatgtaccatggaatatatataaaaaggaacaaaataatggcattcacagcaacctggatggagttggagaccattactctaagtgaagtaacccaggaatggaaaaccagaccttgtatgttctcacttataagcgggagctaagcaaaggcataagaatgatacagtggactttggggatgggaggggtgagagggggttgagggataaaagactacacattgggtgccgtgtacactgctcgggtgatgggtgcaccaaaatctcagcaatcaccactgaagaacttacctgtgtaaccaaacaccacttgtttcccaaaaacctattgaagtaaaaataaattgaggggaagaaaaacaataaaattacaattagttaaaaaaaaatacgcatgctaaaaagaggtttatattcttatttttctcctaaattgcaggtatatactttaaaaatcttaaaaaaaaaaaaagatacaagatctggctatgttgcccagtgcagtggctattaacaggcacagttatagcacactacagcctggaactcccgactcaagtgatcctccctcctccgcctcccaggtagctgactatgggcacacatcaccgtgcccaacttctaaaatgtatattaaaacctttattgtaccagaatccaaaatcagagtgtactttctttttactaaatgtagtggccatccgtcactcacttgtgttagttggggataagtatcctaggagaattaagatcagacatgatttaaaaaaatagttgaggccaggtgcagtggctcaacgcctgtaatctcagcactttgggagcctgaagcaggaggatcgcttagcctcccaaagaatgctgttttttattttttattttttatttttttgagacagagtctcactctgtcacccgggctggagagcagtggcacgatctcagctcactgcaagctccatgtctcaggttcaagagattctcgtgcctcagcctcccaagtagctgggattacaggcacccactaccacgcctggctagtttttgtatttttagtattgacagggtttcaccgtgttggccaagctgatctcaaactcctgacctcaagtgatccacccacctcagcctcccaaagtgtgggattacaggcatgagccaccacgcccttccccaaagaactcttgcccaggagttcaagaccaacctgggcaacagagtgagactcttatctccacaaaaaaaattaaaacaaattagactaagcacagcagctcacgcctgtaatcccagcactttgggagcctgaggcgggtggatcacctaaggtcaggagttcaagaccagcctagccaacatggtgaaaccccgtctctactgaaaatacataaaaattcccagatgtggtggtgggcgcctataaccccagctactcgggaggctgaggcaggagaatcacttgaacctgggaggcagaggttgcagtgagctgagatcgcgccattgcactccagcctgggcaaccagagcgaaactctgtctcaaataaaaaaagtaaaattatccagaggtggtggtgtgtacttgtagtcccagctagctaggaggctgaggcaggaggactgtctgagccctggaggttgtagctgcaattagccatgatcacgtcattgcactccagcctggatgacagagggagaccttatctctaaagaaaaagaaaaaaaatttcagaatagctatggccattattttttgactgtttataaatataatttgaatggtagatatttgccattcaaataaccagaaaagttatttggtccctaagtaattgaggctatgtgcatgcagagataacctgtgtcctgcttttatcagttcactgctcagttttatcatttctttccatgactttcttttttctttttgagagtttcatttggccagccatggtagctcatccttgtaatcccagcactttaggaggctgaggtgggaggattgcttgagctcaggaattggagatgagcctgggcaacatagagagaccccgtctctacaaaaaataaaaagaattaagccaggaatggtagcacatgcctgtagtcccagctacacaagaggcttaggtgggagtatcacttgagcccgggaaattgaggctgtagtgagccgtgatggtgccactgtactcctgggtgacagaatgagaccctgtctcaaaaaaaaaaaaaaaaattttatttaagtgaagatgctttttatagaaacatcatgtcttattatctaagaatctcacagttagtatacaagaagttattgcttctgtatacatgtacatatataaacataattcagtaaattttacaactagaattttctatagaacgattctataaattaacaaaatgtttattttaccttactttgcttgattaaactcaataacatagatcaatttcaacttcccttagaaaaaagaacgtcatctaaactatagacttacttgtcaccttaattaaccaggaaatgtataaactggcagtattttataaatagctgagttctgctttatatactttgcagtggcttaagaattaaggttgcccatttttgcattgaagtggggagcaaatttttcattagagggtagagtgagaaagctaaatcacttgtaaacttccgaaattagatctttgggatcgaattttgttactttactcagtcttgtgtctgcgtagatcttttgtctctatcttaagattgatgtagaaatacatgttctaaaaccagacagtgatttactttgcattacttgttccttcccactggatggaataattggaactttgtagtatttttttttccagatcatttacgttttcagtacagttattcctcattatccatggaggtttcaggacctccctcagataccgaaatcctcagacactcaagtctctgatataaaatggcattgtagatgtatataattatgcacatcctcctgtatgtgttaaatcatctctgtgttagttatattacctaataaaatgtaaatactgtgcaaatagttgttacacactgtatcatttagggaataatgataagaaaaaagtctacatgtttagtacagaggaaattttacttttctctggctattttcaatccacggttgaattcatggatgtggatcctgtggatatggcaggcagactgtatttatgtgttttttttaatcatttggagtcttttcttgattgggtgctgtacttttaagtatttgtattgaataggaactatataaagttaaacctcaaagatatcaacagagctataaatatattgatatgttaagtaggttgatggaattgtttttctcccttgtttttgtggctgaaaatgtatgtttcaggtattaattacaatgtgcttgtcatactagtatgatgggggatgatgaagatgcctgtagtgacaccgaggccactgaagccatggcgccagacatcttagccaggaagtaagtactaatgaccggagcacattttcacttaggctgtttataatcgtgcagagttgaaagcagcctgcgtggctgtccctgtatgagcgggaagaaaaggctgttgatcaacatgttttatgccgacttttttttccttttttcccccttttttcaccttctgagtcaccaacttttatagtcttgtctcttgattaaaatcaaggtatgtaggtggcaggaagaccagcgtacctgcacttgggatactgaaatgtgtcacttccctgtggggggttttatttgttttctgagacagagtctcgctctgtcattcagggtggagtgcagtggtgtgatctcaactcactgcaacctccacctcccaagttcaagcaattctcgtggctcagcctccccagtagtagctgggattacaggcccatgccaccaagcctggctaatttttgtatttttagtagagacagtgttttgccatattggccaggctggtctcgaactcttgacctcaagagatccgctggtttcagcctcctaaagttctgggattacaggggtgaaccaccgcgcctggcccctgcttcctgtttttaaaggtagcagtgagaaaggcaaaaataagttaattcataaaagcactcttcctttgctacttactgatttctagcacccattccactgttcttgtctatgcccatttctactctttttattctttttttttttttgagacagggccttgttctatcactcaggctggagtgcagaggcgcaatcaaagctcattgcaacctcaaactcctgggtttaactagtgctcccacctcggccttccaaatagctaggaccacaggcgtgtaccaccatgcccggcacgtttctgctctcttgccttttattttcctcatcaggttatagctagcacattaatgatcttcagatgtttttgtaagaatcaacagttgaataaggcgcttaaataatatcaaaacatcactgttaatttctttgtacatgattgttgcatagattagctgcagctgaaggcttggagccaaagtatcggattcaggaacaagaaagcagtggagaggaggatagtgacctctcacctgaagaacgaggtagtttatttcctttactgctttcatcatggtgctagtaatttttgctaagataaatccattatttggaagatgagcaaatggttttcattttggggacacacaggggaggagaatgaaagcaacatctttataattcagatactacttgtgtgttttgttgtgtaatagttttttacccctgatttcaagaatatggggaagtattaccatctttaaagtaattataagtattattttctttgtactttttagtgcagagtagatactcagtaaatactttttaaattaatgcatttcaagtcattgagcgtttggacggtcttaaagtgggtagctgaaagagctaatttcccagttgcttatgctttttgtgttgttggacagtgatgcaacttaacaaatgaaccaagatgatcagatgcagagtgaaggtctttattaggtcccatcaatcaaaaggagcagtagtgtcacaggaagggagatggagacagccctccccttcacagggatggaagagggtctcgtaggccattcagcacatacacatttaaggcattgctgcctgctcgtgctttctgtttccacaagtaaaagtggttacccgtggaggctgggagaaaaggagtatgtcttatcttgttgcattttatactttttgattcatgtgaatatataatcttctcaggagttaaaaaattgtgtatagtttatttgcaactatttttaaaggaaaatccaagcttgtgggtagaggggaaagatataagaaaagcacatactcacaaaaaagaggaagaaggaaaatatggtagaaacctacttgaagtgttgtggcgtagggactacctcctgtaccgtgaagaagctgagaaactttagaacgaaggatctttgtcgtgtagctgctaagatatcatttactagtctttcctatcatcttcagaatatagcctgttcaacagagctatgatgggctgagcctaatatttgtacgagagaaattttacatgtagcatattctcaagttgtattgtatctcaactttcagtgactttccatttattttcccaaaatataccccaaaagatccttgaaaagtatttcaaatagaaatagtttctggagtttgtttcctcattactctctaaaaacatgatctgttgagaataaggaattttttgttaatgtcagttttaattgagggatgtttttctcaagttgtgatttcatgagtcaaccagcagggggagccatttgactaattataatttcattaattcattttccactggtggggttattactgaattatatagatgttacgtggctgaaaaattgttgtctattgacagtagatagcttagggagaaaaactgtaactcacagcataacaattaagattattgtctaagaagacagacaaacctaagtttgtgctccaggtatgccacttggctaatttgcataatttctccgagcctccgttttctcatttctaaattggcagctgtaaaaatattttggtgactactaaatgagttaaagcatttaaagcacttatcactgatcttggcatattgtgagcactcactaaatactaacttttaacaacttaagatattcccccataaaaagtaaaagtaggtataaaaagaataattcacttgttgtattcatataaatagtctgccttaacctttttaaatgttagttatgacttattaagaatcatgatggccgggtttggtggcttatgcctgtaatcccagcactttgggaggctgagacaggaggatctcttgaggccaggagtttgagaccagcctggccaacatggcgaaaccccatctctactaaaaatacaaaaattagccaggcatggtggtgggcgcctctaatcccagctactcgggaggctggggcacaggaattgcttgaacctgggaggtggaggttgcagtgagccggtatcatgccactgcactccaggctgggtgacagagtgagactttgtctttaaaaaaataaataagtacataaataatcatgatgcacagtttcaaaaacactggctcatactgagaaaataatagaacaaatgcacaatatattttatatatatagtcttaaaaacattgaaaattgctgatataccttcacaaaataaaaacaaaccaaaagaaacattgaaaacatgaaggaaatcagaaatctttaaccaaaaatagggaattaaattatgactcaacaacttgtaacgattttaaaattacataaatcattatggcagaatgtttactgtatgttcatatactttattgtctaaactgggtaattattgcagttctttttttttttttttttttttttttttgagacagagtcctgctctgtcgcccaggctggagtgcagtggcgcgatcttcgctcactgcaacctccacctcccaggttcaagtgattctcctgcctcagcctcctgagtagctgggattacagacgcgtgccaccacgcccagcaaattttttgtattttcagtagagacggggtttcaccatgttagccaggatgttctcaaactcctgacctcatgatccgccctcctcggcctcccaaagtgctgggattacaggcgtgagcactgcgcccggacttcagtataagttttaaaaatataagtatagatgttgataaaagcttagggaattaagaaagtactggccaggtgcggtgtcttacacctgtaatcccagtgctttgggaggctgaggcaggtggatcacttgaggtcaggagttcaagaccagcctgacctacatggtgaaaccccgtctctagtaaaaatcaaacaaagagaaagtactttggaggccaggtgtggtggcacgcatctgtagttccagttacttgggaggctgaggtaggaggactgcttgagcccagaagttggaagccagcctgggcaacagtgagatctcatctctaaaaattaaaatttaaaaaaaagaagaaagtactgtaaatacccttattgagagatgtctctgctttttaaaaagtaaataaataaatttttgagctacggtctcacttgtcaacccaggctggagtgcagtggcatagtcgcggctcactgcagtttcagccttctaagcttagccagtcctcccatctcagccttcccagtagctgggaccacagtcgtgtactaccacacccagctaattttttgtaatttttttgtagagataggttcttgccatgttgcccaggctggtcttgaactcctgggattacaggcatgagccccagcatctggcctctgtgcatttttgacattgaaatattttgatgaaatttttaataaaacaatggtgaagccaggcgcagtggctcatgcctgtaatcccagcacttttggaggccaaggcaggcggatcacctgaggtcaggagttggagaccaacctggccaacatgatgaaaccccgtctctactaaaactaccaaaattagccaggagtggtagcacatgcctgtgatcccaactactcgggagactgaggcaggagaatcgcttaaacctaggaggctaaggttgccgtgagccaagattgcacattgcactccagcctgggcaattagagtgaaactccatcttgaaaaaaagaaaaaataaaacaacggtgaataattttaatgctgttcattggtaaaatagctggcaattttatattggcccccccttttctgttgtttttttttttttaattttctgatctaaggaagttaaaaaccttaaaattatgtattcataaatagttgctctagtgtgatcagttgtgttgctgccagctttatgtttctatggtgaagactaaaatgaaatattttggagtcacttcaccattactttataatacgtttttcttaaaattactctgaaaatgaggttacgtttttagccaacaatgtcttaaatcatggcagtttcttaacaggtaagaattgttttaaaggattttttcttaattataaaaatagaaaataataaaatattaaaactacttcattgttccttgactcagaattaaacactgttaattgctgagtcttatttttctctctgtgtgtgtatgtgacaggcattgtacatagtaaatatagtatatggtgttgtaacttgctcttttgtcaccatttaactctttctggataattttcccatagctttaatctttcttcacaaatataatttctaatggctggatatattcttgttcttccattgagatgaatgccagatagtaaatattttaaattttgcagggcccagtggtctctattacgaactactcaactctgccattgaacacaaaagcagccttaagcatgacaaaaacaaatgagcatcactgtttcaataaaattttatttataaaacaggcatgggccaatccttgagctcaaacttcctaagtttacattttgcatcttatagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggttagatgtctggaaaatgtcactgagacttttgtaatggtctgtgcctaagataatgtactttattttgctttaaacttgtgaaaaaacagaaaattttgctgagattcgctttattataccaaatgtttctaaagttttaacccgcatggccaatttcagaataataaagtttttatacctagagttgatttgattttagaccatatgttttattatatggctttcttatggtttacttgcctttaggcaaggatgtttgtcttcatattaagctatattttgttttgaatattttaggtcatgttgtatttgtcataacgatctaaaatttaaaatttttaaatgaaacttttttttttttttgagacagagtctcgctctgtcacccaggctggagtgcagtggcgtgatctcggctcactgcaagctccgcctcctgggttcccgccattctcctgcctcagcctcccgagtagctgggattacaggcgcccgccaccacgcctggctgattttttgtatttttagtagagatggggtttcaccatgttagccaggatggtcccaatctcctgaccttgtgatctgcccgcctcggcctcccaaagtgctgggattacaggcatgagccaccgcgcccagcctgaaacatgtttttagtatggaagatttggttttacatcccgttagatacaaagtatgtcatatctttccaatacggattcttttgactgttggattgacaagttatttaactgtttttgtttttattttttttttaagttttagacacccagcccctgcagcctagcaactcctgatctgtcataggaaataggttttatttattttttatgaactgttactctggtatttaatgaagtgaatcttctgcatcactaatggagattttttgtgcccaccacctactccttgtacttacaaacttcatacttttcagtggaggcgtaactgatgttatttgtggtgcccagaatggttaagtcttaggaaattaaataattattgtattaccattttggtaagcatagtattaaatatgaataattctatgatacagcctgatgagttgctgtctcatagtgtcaggattacagtactttttgttattccgtaatatgcttcaaccttttagtctatttcatatagcctttcatttccattatatatcccatagtctgtttaacttatatttaacttgagcaaacttcatcttacatagtagctgtggcatgtttttattatccatttttatttttattttgttttttgttatagaggcagcgttttttgtttgtttgttttaacgccatttcttttgaaaaataactatggcattttgtccgtctctgcttataagatattacatttcacatatttagtacataaatatattttttgtttaagtttaatggaggattaaaattttgtattaggtcagtgcctgatttttcttcactggagatgaagtacaccttgcaaaggagtatatcctgcttagcattataaaacccacaagaataggataagacttagggaaataagtaccttatttaccccctaccctttttgggcccttaacattttaccagcttttcagatctctaagttctatagaacccattagttttgggacagtgccagtctcctcccttccccctttcctcccccattcacacaattcattggagaaaatgacatgtttggactcttaggtgatattttatagctttcaggtaataaatatgtatctttttatagctctggatattggagttgtcgtaaactcttacctttccacctgtgacttacagaaatgttcaatctgaaacctgtttgttttatcagcaagtagacacttctgttctttagactatttaggggagtgtatagattcttcaatttcagtctaaatcagcctacatgaaatataccttatttgtttttaaaatttttatatttgcttgtcatgcatgctaatagaagggaactttagccagggttgacaacatataacaaattatgttgactttttcttttatctttgcaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggttttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagagttgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatg

SEQ ID NO: 36104 - DNA, 28822 bp, Homo sapiens
ggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgaggtgagcgctgggagggacggcctgggagcccctccttcccgccgggcccgttacctacccagaccccaggggcgggcgggcggcgtggatgcggctcgggtgccgctcgagtctcttctcctgcccggctagccgcgggtgggagcgatctttaagaaggctgggcgatgacgtttatcatgcttccttttttttttttaagcatttgggcatatataatatttttaaacatcatctttgaactttctgtaatcgggaacatcaaagaatgaaattgaagcttcagatcttcgactgttaagcttttactatttcttaacctcatctctgaggtatctaaaattcttcgataattacagtgtattttcttgctttgggaaccctttaagatctagtctcaagctaataggcgatccgtcaaagaagagaccatttcccccattagcattgtgccacactgtatttctgcatctgcaaccagagttttgggtgctttctagtttttgttcctgttcagagatagatctaagctcaaaacagttcaaagaggagcaacttgaaatgacccagtggtaatttagttgctcttgcatacgctaaagatacacatgtaaaaagttgttgacctgagcattgtatgtaatatttataatataattggaaacgaccggaagtccattagtaagagctggtgaaatattaattacggtacgtttgtataatggaacaatatactagcctttaaaaaaagaaaggtaggcgtttatgcacggagaaaatgttgcagtacagtatctgtagtgggttagaagtgcacgggggcttgggcgttgcaagatactaaaaatagaaggactctactttctgaaaataaggcttaagaaaagttaccattgaaattggtagtcagaagctaaaatgaggatgtttgtgaaatctcagaatataggaacctagggcattcctggataaaggatcttatttaggaccataaaaggaactactgcttggtggtggtaaattttagggatttgtgttaccttgaaggaaatattgagtaggttcataggttagaatcgtggccttttggggctggaaaggaccttagtttttgtctagcaactcccacgctcatggatgcttgaatcttacattctctcacacacaattttccaacttctttgggctaagccacgttaaatggagtgctgggggagtgtgatgtgtaggtcatggaattaagaagacagaatttcaccagaacataactgaagcaggagaaccaagttagttaaaagataaataacatccaggcgtggtggctcacgcctgtaatctcagcacttggagaggccaaggtgggaggattgcttgatcccaggagtttgagaccagcctgggcaacataatgagacctcatctcttaaaaaaaaaaaaaaaaaaaaaaaggaaagaaaagaaaaggaattaaaagataagtaacgtaactacagaaggctcaaatgtagcttcagggttttcagcagcaggaatgtggtccttactggcatttatgttatttagctgttctccagtgtgagtttcttttggtccatttaccaagtgagttactctttatctctgcttctttagtttctgtttattcttaacttggatctgctgtaatttcccgtgggcccaatctatggattggcctctttctttctgtaattggttgggatttacattcaggtctttctgcctcaaaagccactatactagactgactcaactgcatagggctgcctcttctgtagtatctgtggcagggtagattcacttaaaagggactgacctgtcgagttagagttacagtcctgtctttaaagagaactatcaaaccctaattcattgaagttcatgatgtttggttccaagtggtaaaaaggatgggttttttaatgatccttgttatgtgactgtaaagcaaataaactaattctactagtaatacaatatagtcttagtctgttttctgttggtcataacagaatgtctgaaatgataatttataagaaactgaatttatttcttacggttctggaggcttggaagtccagggtcttaagggtgcatctggtgagagcgtttttgctggtggggactctgtggagttccaaggtggtgcagggcatcacatggcaaggaagctgagcgtgccagctcaggtctctcttcctcttcttataaagccaccagaaccactcacttgataacccattaatccgtgaatagattaatccattcatcagagcagagccctcatgacccagtcaccttttaaaagctgtgcctctccacactgccacattggagatcaagtttcaacgtgagtttcagagaggacaaacgttcaaaccataccaaatatacattattatttgtcacaagtcatgcaaactttatgagatcctctttgaacagaaacaataaatatacagttggccccctccacaaattcagccaataccaaatagccctttacacttgggagccattttacacaccagattcaccaacaaaaatgcaggaaaggaccctaaataggccacgaaaaggacacttgtttacagtacaagagctgaaacaagaaagcagagcgtcgccttgtttgaccccatctgggaacatgctacctcggctgtgaacggtgcactgggcaactcagaatctgccctgctctgtggctgtctgtgagcaactgctaacggacctcaaatgctagttttgggattacacattttagcaagtaggtaaacttgcaaagaaagaatcagagaataatgagaatgaaccctaccttttataggtgtcttcgttgtgtaaaatgcgatgatagtttgactcctacccatcccccagttgtgagaggatgttattttacgtaaatattaccaaggaatttttaaaaatagaattcaaacatacttcagatatatgtctgtaattcatatatggatgtactactatcattagataattctcaaaactcaatgtccacttaaagtgaggtttatataaagccatattcagatagtctagcatttctatttttttatccaattgtcaggaccgatcaaaccatcattgaggggggttttatttttttagatgactcagtgctgttattttcttattgtttatactttgcattagtgcttacgtctttttttgtttatttttgagacaagatctcattctgccacctgggctggagtacggtggcacgatcacagcgcactgcagcctccatctcctgctctcaaatgattgtcccacctcaggccaccacacccagctaatttttgtattttttgtagagatggggttttagtatattgctcaggctggtctcaaactcctgggctcaagtgatctgcctgcctcccagagtgctgggattacaggtgagagccaccatgccccaccagtacttatgtctttaatgagtggtttctacaggtaccatttgtcagataccaatttttgagggttaaattaaaactggatagaatccataaatccacataactaagtatagataaatctcagtacattgcaccacagcattcagctgttttaaacaccactgtcatcttcgatcattgtggacttcccattctttcaggataccttgaatatagggcacaacttatgaaggtctaatttagcaggcctagtgagtacatatgtgtatcttaatgaaaagaagacactgttgattctaagatgtactatccaggaagaaaaaatactgccagctatgattataagatgccatccttttaagacatgttctttttcagagatgtgaaaatgtaaaaaatgtgttttgggaattattgaaaatatgacagtaaatattgctaaagcctatcatttgagaaggattatagtttagtggttaatctggtgccagattgcctgggtttgaatcttgtctgctgcttattagcaaactttattagttgtgattttcagtgaattattcattatatctgtgccttagtttaaatattaaatgaattaataaatgtaaagtgcttaacccagtgccttaccctcaaatgttagtcttattgtaatagaaataaatatagaaattcattttttccatatctcagcggggtttttacacagtctgctttggagttcactattctgttcaattcaaattctatagtagtcttagataatgcaggcaaattctgcttgaaaaaattatgccttaatttcctttgatgtaatttaagatataaacaagcttcaactttgtctttttctgcctataaagggatgtggaatattatagtcagaggtttactgagtaaaataaaaatttgttttctaaaagttactttttgcttacttgtaattgcttttattgttaagtcttactttaattgttcagtaacgatatcaggcttcgaagtcttatattgtgtcaatctatataagttgaatcttcatttaaagaaagaaccatttcttgaaatgtgcaattaaagttaaatcaccttgaagcaaaatcttgcttcccattccagacacagtcacaacttatcaaatgagcaagtcacaagcaacaagaagttccagtaggtcttcttaaggtggcaccatatgagctaacaaagtaaaagtgagaagcggtgacgttttcagcaccagatttaggctgtaggaaaaccagtcacccaagagggtgggggaaaactgaaaccagcaggtgctttcaccatcatggcagatctgccatgtaaatggtggtgcccctatttttgtctgcagggatactgacctcaaaggaggtcatacagttcatgatggtactgggattaagctcaggctcactccttgggttttgctattccacaactaatgttaattctgccatcactttagagatgccgactttcatatccagtgtcccctgctgacagtttcttctacttcactaactttcgaagatttcctagcatttttggagtctgttttgtaataccgttatttaaatgcttgtttttgcaagctattgttgtctttttttggatctgaataattgtactaatttttttttctgttagtgttctgttgagaaaacaagttgagtgagactttgaatatttagaacttaaaatttcatttacagaagaaagtaaactaaatggcaaacaaactgggaaaaattgaagttatataaaatgtggtttatataaatctaaagagctcaaatttatgggaagatttctgataggcaaaggatgtaaacataattcacatgaggaaattaggcaaagaaacaacagttttaaaatactgttttatacctgctgaaatggaaacacacacacacacacacacacacacacacacacacacaatagctaatcctagcaatggtttggtaatttactggggacgttacaaacagtcctctttttttaaaaaaaaatctgtatggcaacatggagtgaactataaagttcttaataaactttaattcagactcttacactagcaaattttctttaaaacagcattgaatagcatatatacaaatatgttcatgtctgccttattttaaataggaaaacttatttaggttatcaatctaaatgaatcttatacagtcattaagaaggtaaaaaaacacaagcaacttatactacatatacttaaaacttatatatcagcatatgtattgtatatatactgtatgtactgttttatatgtatagttatatatatttttatgttttgatagcttatacatatttatatgtattatacaaagggaagaatatgctgaaatcaaaattatgaatggcttagggtgctgggattgtgtttattaaattttatttttaatttcaagaaaacttaatttctgcttgtgttctgtagttctttttcttcaatccttatcttgcaaaaaatatttacaggatgtggcgttctttctttcccattagagatactttttaaactccagaggtctttcctcattcttttttttatcctaagcaacgatgatcagttgtcgtcgttgtcttttttttttttttttttttttgagacggagtttcgctcttgtcgcccaggctggagcacaatggtgcaatctcagctcacggcaacctttgcctcctgggtgcaagtgattctccagcctcagccccctgagtagctgggattacaggcatgcgccaccaagcatggctaatttttgtattttagtagagacagggcttcatcatgttggccgggctggtcttgaactcctgacttcaggtgatctgcccacctcctaaattgtcatttttaattcaatattgttaacatcacttaggaagtaacttgttttactttgagattaacaggcacccccaaacaacattattaatatgtgtttatttttaaaatattttattacagtgtaatatacatacagaaaagcatattaagtataaatttaaagtgtcagaaattattgctaaagcacacactggctgggtgcggtgtctcacacctataatcccagcacttttttttttttttttttttttttaaagacagggtctcgctatgttgcccaggttgatctcaaactcctgggctcaggtgatcctcccactttggcctcccaaagtgttgggatttataggcatgagccactgtgcccagccccccaaaacttaactactggtagcctcctgttgactgaaagccttacaggtaatataaacaattgattaactacatgttttgtatgttacaagtattatgttactgcgttcttataatacagtaagctagagaaaagaaaatgttaaaatcgtaaggaagtggatcatcataaagatctttatcctggtggtctttcacattgagcaggctgaggaggaggaggggttggtctcactgtcttgggtgataaaggcgatagaaggagaggcaggctcacttggtgtaactttacaaaaatacatcataatttatgcctaacttttgtgctttttcgtttctcttaagatgcttctatgtggtactaataatcttccttctactgtttagtttcagtgtccatatcataaaagcgtccatgttgtaaaataagccaagcagtctcaaatagaactcttggtcagattgtctagtgtcaatttgtttcctggctttgcttcttctacatattcttccgtatcctctggcactgattcagaagcactcatctctatcaaatcatcttctgttaattcctctggtgtgatgtctgttagctcttgaatttcaggatccatatcttgaaacccttcacccccaccaaataatccacaatctcattagttccttgattggcactgtcgtaaatcccgtgaagtcatgcgtaacatctggatacagttttctcgagcaggaattcattgtttgagacttgacagctttcttagctttttctgtaacaacaatggcatacacagtggtgaaacccttccagactttcatgatgttctccatgagggttgacagtcttttccatagagcaaggatccccacaccccaggccacgtggcaggtgcctgagctccacctcctgtcagatcaatggtgacattagattctcataggagtgtgaaccctattgtgaactgtgcatgcgcgggctctaggtcgcccactccttatgagagtctaatgcctgatgatctgaggtggaacagtttcatcctgaaaccttcccacccgaccccacaccacgcaaaagttgtctttcccgaaaccgctcactggtgctaaaaaggttggggaccactgcgtagagtgccatgtgtgctgaatcttaaaggtcctctgtgacccccgatctagaggttaaattggagatgttgtgtttgaggacgagtaaaccaccttgacacctttatagggttgaactcatagggttcataggtggccaaagagagacattgtccagaatcaaaacaactttaaaaggtactttactgccaggcacgtggcttgagcctgcagccctagctgctcaggtggctgacacagtcacatcacttaagcccaggagttcgaggctgcagtgagctatgattgtgccactgcactccagcctgggcgatggagtaatgccctatctctcttttttttttaaaagcagttctgtattggcaaggtacttccttaccctggggacagaacatggacggaaccaggagggttctcgttgtccagaccttctacaaccacaagactggcagctggtgtttatcttttcccttcaaggctccggggttagcagctttatagttaaggacagttctgatcataaaccctactgcattggcacaagacagtagagttagcctgtcccttcctgccttaaatcctgatgcttgcttctcttttcttataaataaatgtcctttgtggcatttttttccccagaatcaggcacttttattctcattaaaaacctgtacaggcagatcagatgtcctttctccttaataattttttctttttctggacagtctcactttgccacccaggctggattacagtggctcgattgcagatggctcactgcagccttgacctcctgggctcaggtgatcctcccacttcaggccacccccaagtagctgggactgcaggtgtgtgtgtgccatcatgcctggctaattttaaaaattttttgtagagatagtgtctcactatggttgcccaagctgttctcaaactcctgggctcaagagatcctcctgcctcagcctcccaaagtgtgggattacaggtgtgagccattgcacctggccctttctcattagtgattttcttaatggcctctgggaactcgtctgcagcctgttggttggcagaagctgcttctctgttatcttgtaattttaaagccaaacctctttctaaaattatcaaaccattgtttgctcgcattaaattctccaactttagattcttcaccttctttttgctttaagttatcatatagtgacatcattttttctcaaatcatattagagtctatagtcttgtacaatcctgcactcacataaaagatgcatcggcaatacaaaaggcacttcacaaaatatgcaaggttttcatgctggtatcgctactgcagtgacagctttgtgaatttccttttatttgattttatttttacaatggtctttatggtggattcatgtttaaatgatgggcagccgcagttgcagagctccatctaaggtactcatcaagcgttctactttttcttgtaatgtcacaactttgcttcttgggaatgcttccagcatctctagtggcattttgtatgactcccatggtgttactcaaggtttacaatattgcactaaataggataaaaaatactcaaaaaccaagacagatcactttttattgcaacaggcaatttactggagcaacaaactactcacactgaaacaactagcatcatagagcttttttttttttttttcctgaggcagagtcttactctgttgcccaggctggagtgcagtggcatgatctctgctcactgcaacccctgcctcccgggttcaagtgattcttctgcatcagcctcctgagtagctaggactacaagcgcaagccaccatgcctaatttttttgtatttttggtagagacggggtttcaccatgttggctaggctggtctcgagcgcctaacctcaagtgatccacctgcctcagcctcccaaagtgctgggattacagacgtgcctggccgcatcatagagcattttaagcaaacttgcaacacttgaggagactgcagtagcaacaagagatagctgtgaaactgtgacatagaatagtatgtactgtagttaattttatgcagttatgatccaactgcagatccaacaccatgtgttgtatgtgcatgttttgataaattttaacgttacattttaactaggcttgtgaatattttatggtagtaaatgataaagtagactattctctatgtataatgcacttatgacataactaacttttaaggtttttttaaatatttctgggctatgtggtttatctgagtttcttcaaattgtcacaagcctccaaaaaaatttccagtagatttgttgaaaaaaaatccgcatataagtggacccacacagttcaaactcataatattcaagggtcaactataaatagagtccaagagaagatttttttttggcttctctatagtaaagggtaactgaaacttgaaccttcagtgtctgtctcccggttaaatttgttttttgttttctgccacaagctcaactatgtgacaggcagaagcctaggcatctgaagacatcggtattgttaaagcaagctctgtttacccagtctagttcagtcccagaagagtgtgatgagttcccttaaaaattacacagtcccactcctggcaggtgacttttttcaaatactaaggacatattaatttgattatggccaggtgtggtggctcatacctgtaattccagtactttgggaggctgaggcaggggaattgcttgaggccaggagtttgataccagcctgacaacatagcaagactccacctgtaaaaaaaaaaaaaaaaaaagaaaaagaaaaagaaaaattagctgggcatggtggtgcgtacctgtggtcccacctagtcaggaggctgaggcaggaggatcacttgagtccaggagttcgagactgcagtgaactatgatcatgccactttactctagcctggggtgacagagacccagtctcttaaaaaaagagagacattctgacacatgctacaatatgaatgaaccttgaagacattatgcttagtgagatacgccagtcacaaaaggacaaatacttcatgatttcgcttctgcgaggtacctagagtggtcacatttctagagatagaagtagaatggtggttgccaggtctaggggctggggagagtggggagttagtacttaatgagtacagtttcagttggggaagatgaaaaagttctggagatgaatggtggtgatgcttgcacaatgatgtgatgttcttaatgccatagaattgtacacttcgtaatggctagtgcttacttcaggagcacgtgcactaaaattggaatgatacagggaagattaaccaaaaaacaaaaaggttaaaatggtgaattttatgtatgttttaccacaattttaaaaaatgaagaaaaaaagtgcttagtccgaaatggggacactgtgggtatattagggtagaaagcaaaagaatacgaagtcacctgcaagagtaggcctgtataatttttaaggtaactcatcaaaccattttgagagtatggaaaagggaatatgttattaaaatgttgagtatgttattcttaaagggtatttcaggatctgggaaattgaaaatacctgcagtaaaaccttaacaatttagaccaaatgtggaaagcattatttaaatcagtgtaacatttacattgattctttttaaggcaggtttttccaagtacatactaagtaacaaactatatgtaacaaaataatgttggcttgtagaaaggtctttgaggtcttttttaaggagtatgtaagcatttaaaatgaaagcatttaattatcgagcaccttaatagttgtgcaaatacttcattgcatgaaatttaacagatgtttctaaagtacttataggccaggcacggtggctcactcctggaatcccagcagtttgggaggcccaggcaggcagatcacgtaaggtcaggagttcaagaccagcctggccaacatggtgaaaccccgtctctaccaaaaatacaaaaattagccaggtgtggtggcagacacctttaatcccagctactcaggaggctgaggcaggagaatcgcttgaacccaggaggcagaggttgcagtgagccgagatcgtgccattgcactccagcctgggcgacaagagcaaaactctgtctcaaaaaacaaaaataatggcccggcctggtggctcacacctgtaatcccagcactttgggaggccaaggcaggcagatcacgagatcaggagttcaagaccagcctggccaacatggtgaaaccctgtctctcctaaaaatacaaaaattagctgggcgtggtggtgcgcgcctgtcatcccagctactcgggaggctgagacaggggaagcgcatgaacagggaaggtggaagttgcagtgagccgagatggcgccactgtactccagcctgggcaacagagtgagactccgtctcaaaacaaaacaaaaataataaagtacttagagagaacgtctattgctcttcaagtaggtttgaatacaccatttctgagcaaacctttatttttctagattagaaataaacagagctgtaatttatttgcaatctaatgatttagtggtgtctgagtttgatgaggttttctctatagttttattgtttgaatctttatgttctgagtgttaacagatatcccagaaagaaattatgccaaggaagtactcctgttgtgttttttaccgaacagttactgatatatagatcaaaaatgcctactgacttcagcgaatgtatagattttgacttgcattattttataggccaaatgaaggctaagcatgtcatagtatggtaatgttttgaatgcctgatatagatactaaatattgtgtttttaatatgtgggcactaggtgttctatatttactgacattttattgtagttacttaatggtttttaccctgagtcagcttctattccaagaaagtatatgtgaaaatagaggttggccatcaaatagaagttgaaatgttaaatttggacatttgtgaattttgatattcaggtttatctttttctgcattgggaaaaacgttttttctttttaattttagcaaaaaatcccagaagtgggatgaaatgaacatcttggcgacgtatcatccagcagacaaagactatggtttaatgaaaatagatgaaccaagcactccttaccataggtaatgttacgtagacgtcattcctcttgtgacttacttccattttgcatttcatatgaacgtctggataacagcctatttgaatttgttttattgtagatttgttactggagcactagtgaagtcagtaacctaactgcaatttgtttagtaatggtttaagtgatgtgtaagtttaaaattaagaaagccattttgtacattataatggtagtagtaaatgtttatttgttgcacctcagtggttgctagctactaatggtgcatatattagttttaacttccatgaaaggaagatgagatatgggcttgtttgcttcccaagtagaaatctggggtttactcagtctctttgcagagaagcataactgcatggatggtaacccactgaaagataggtgtcattattactgtttatgtcttcattttttaacttaatgtaatattgttgttcagatcattacatgtaatttttgacaatttcaagtctcagaatttcctaaatgaattgtgaaattacattacgcagcagtaaccagtatgaagacaaaaataatgcaagaagcattatgagaagatgaggattctaaataggtatagatacctaattaagataataccttgggccgagcactgtggctcacgcctgtaatcccagcaccttgggaggccaaagtgggcggatcacctgaggtgaaagaccagcccggccaacgtggtgaaaccccatctctactaaaaaaaaaaaaaaatacaaaaattagccaggcatggtggcgggcacctgtaatcccagctactcgggaggctgaggcaggagaattgcttgaacccgggagacggaggttgctgtaagccaagatcacaccattgcactccagcctgggcgacaagagcaaaactctgtctcaaaaaaaaaaaaaaaagataataccttggctgggcatggtgactcttgcctgtactcccagcactttgagattacagaggcagaggtgggagtattgcttcaggccaggagatcaaaaccagcctaagcaacatagtaagactctttctacaaaaaaaaaaaaaaaaaaaaaaaaaaaaaatagttatgccctacctaccttgtattgaaaaaaataaaagatttccaagattaaaatattttgtcattgaattaagacagcataaatccaaaagttaccattaaaatagaggtaactgctgtttccatttgttctgtagtgaaagaagagttaagaactactgtattttaagtcagtgggtgaaaactttggaagataatttgaaataacctgttactaacaaaaacagtaaaaataaaaaacttgaagatattaaagactgatgagcataaaaagaaataatgaaataggtacagatgctgaaactcaatactgatgaaatttgagtgaagaaatacacagttttttgtggtatatatgtatgtaccatggaatatatataaaaaggaacaaaataatggcattcacagcaacctggatggagttggagaccattactctaagtgaagtaacccaggaatggaaaaccagaccttgtatgttctcacttataagcgggagctaagcaaaggcataagaatgatacagtggactttggggatgggaggggtgagagggggttgagggataaaagactacacattgggtgccgtgtacactgctcgggtgatgggtgcaccaaaatctcagcaattaccactgaagaacttacctgtgtaaccaaacaccacttgtttcccaaaaacctattgaagtaaaaataaattgaggggaagaaaaacaataaaattacaattagttaaaaaaaaatacgcatgctaaaaagaggtttatattcttatttttctcctaaattgcaggtatatactttaaaaatcttaaaaaaaaaaaaagatacaagatctggctatgttgcccagtgcagtggctattaacaggcacagttatagcacactacagcctggaactcccgactcaagtgatcctccctcctccgcctcccaggtagctgactatgggcacacatcaccgtgcccaacttctaaaatgtatattaaaacctttattgtaccagaatccaaaatcagagtgtactttctttttactaaatgtagtggccatccgtcactcacttgtgttagttggggataagtatcctaggagaattaagatcagacatgatttaaaaaaatagttgaggccaggtgcagtggctcaacgcctgtaatctcagcactttgggagcctgaagcaggaggatcgcttagcctcccaaagaatgctgttttttattttttattttttatttttttgagacagagtctcactctgtcacccgggctggagagcagtggcacgatctcagctcactgcaagctccatgtctcaggttcaagagattctcgtgcctcagcctcccaagtagctgggattacaggcacccactaccacgcctggctagtttttgtatttttagtattgacagggtttcaccgtgttggccaagctgatctcaaactcctgacctcaagtgatccacccacctcagcctcccaaagtgtgggattacaggcatgagccaccacgcccttccccaaagaactcttgcccaggagttcaagaccaacctgggcaacagagtgagactcttatctccacaaaaaaaattaaaacaaattagactaagcacagcagctcacgcctgtaatcccagcactttgggagcctgaggcgggtggatcacctaaggtcaggagttcaagaccagcctagccaacatggtgaaaccccgtctctactgaaaatacataaaaattcccagatgtggtggtgggcgcctataaccccagctactcgggaggctgaggcaggagaatcacttgaacctgggaggcagaggttgcagtgagctgagatcgcgccattgcactccagcctgggcaaccagagcgaaactctgtctcaaataaaaaaagtaaaattatccagaggtggtggtgtgtacttgtagtcccagctagctaggaggctgaggcaggaggactgtctgagccctggaggttgtagctgcaattagccatgatcacgtcattgcactccagcctggatgacagagggagaccttatctctaaagaaaaagaaaaaaaatttcagaatagctatggccattattttttgactgtttataaatataatttgaatggtagatatttgccattcaaataaccagaaaagttatttggtccctaagtaattgaggctatgtgcatgcagagataacctgtgtcctgcttttatcagttcactgctcagttttatcatttctttccatgactttcttttttctttttgagagtttcatttggccagccatggtagctcatccttgtaatcccagcactttaggaggctgaggtgggaggattgcttgagctcaggaattggagatgagcctgggcaacatagagagaccccgtctctacaaaaaataaaaagaattaagccaggaatggtagcacatgcctgtagtcccagctacacaagaggcttaggtgggagtatcacttgagcccgggaaattgaggctgtagtgagccgtgatggtgccactgtactcctgggtgacagaatgagaccctgtctcaaaaaaaaaaaaaattttatttaagtgaagatgctttttatagaaacatcatgtcttattatctaagaatctcacagttagtatacaagaagttattgcttctgtatacatgtacatatataaacataattcagtaaattttacaactagaattttctatagaacgattctataaattaacaaaatgtttattttaccttactttgcttgattaaactcaataacatagatcaatttcaacttcccttagaaaaaagaacgtcatctaaactatagacttacttgtcaccttaattaaccaggaaatgtataaactggcagtattttataaatagctgagttctgctttatatactttgcagtggcttaagaattaaggttgcccatttttgcattgaagtggggagcaaatttttcattagagggtagagtgagaaagctaaatcacttgtaaacttccgaaattagatctttgggatcgaattttgttactttactcagtcttgtgtctgcgtagatcttttgtctctatcttaagattgatgtagaaatacatgttctaaaaccagacagtgatttactttgcattacttgttccttcccactggatggaataattggaactttgtagtatttttttttccagatcatttacgttttcagtacagttattcctcattatccatggaggtttcaggacctccctcagataccgaaatcctcagacactcaagtctctgatataaaatggcattgtagatgtatataattatgcacatcctcctgtatgtgttaaatcatctctgtgttagttatattacctaataaaatgtaaatactgtgcaaatagttgttacacactgtatcatttagggaataatgataagaaaaaagtctacatgtttagtacagaggaaattttacttttctctggctattttcaatccacggttgaattcatggatgtggatcctgtggatatggcaggcagactgtatttatgtgttttttttaatcatttggagtcttttcttgattgggtgctgtacttttaagtatttgtattgaataggaactatataaagttaaacctcaaagatatcaacagagctataaatatattgatatgttaagtaggttgatggaattgtttttctcccttgtttttgtggctgaaaatgtatgtttcaggtattaattacaatgtgcttgtcatactagtatgatgggggatgatgaagatgcctgtagtgacaccgaggccactgaagccatggcgccagacatcttagccaggaagtaagtactaatgaccggagcacattttcacttaggctgtttataatcgtgcagagttgaaagcagcctgcgtggctgtccctgtatgagcgggaagaaaaggctgttgatcaacatgttttatgccgacttttttttccttttttcccccttttttcaccttctgagtcaccaacttttatagtcttgtctcttgattaaaatcaaggtatgtaggtggcaggaagaccagcgtacctgcacttgggatactgaaatgtgtcacttccctgtggggggttttatttgttttctgagacagagtctcgctctgtcattcagggtggagtgcagtggtgtgatctcaactcactgcaacctccacctcccaagttcaagcaattctcgtgcctcagcctccccagtagtagctgggattacaggcccatgccaccaagcctggctaatttttgtatttttagtagagacagtgttttgccatattggccaggctggtctcgaactcttgacctcaagagatccgctggtttcagcctcctaaagttctgggattacaggggtgaaccaccgcgcctggcccctgcttcctgtttttaaaggtagcagtgagaaaggcaaaaataagttaattcataaaagcactcttcctttgctacttactgatttctagcacccattccactgttcttgtctatgcccatttctactctttttattctttttttttttttgagacagggccttgttctatcactcaggctggagtgcagaggcgcaatcaaagctcattgcaacctcaaactcctgggtttaactagtgctcccacctcggccttccaaatagctaggaccacaggcgtgtaccaccatgcccggcacgtttctgctctcttgccttttattttcctcatcaggttatagctagcacattaatgatcttcagatgtttttgtaagaatcaacagttgaataaggcgcttaaataatatcaaaacatcactgttaatttctttgtacatgattgttgcatagattagctgcagctgaaggcttggagccaaagtatcggattcaggaacaagaaagcagtggagaggaggatagtgacctctcacctgaagaacgaggtagtttatttcctttactgctttcatcatggtgctagtaatttttgctaagataaatccattatttggaagatgagcaaatggttttcattttggggacacacaggggaggagaatgaaagcaacatctttataattcagatactacttgtgtgttttgttgtgtaatagttttttacccctgatttcaagaatatggggaagtattaccatctttaaagtaattataagtattattttctttgtactttttagtgcagagtagatactcagtaaatactttttaaattaatgcatttcaagtcattgagcgtttggacggtcttaaagtgggtagctgaaagagctaatttcccagttgcttatgctttttgtgttgttggacagtgatgcaacttaacaaatgaaccaagatgatcagatgcagagtgaaggtctttattaggtcccatcaatcaaaaggagcagtagtgtcacaggaagggagatggagacagccctccccttcacagggatggaagagggtctcgtaggccattcagcacatacacatttaaggcattgctgcctgctcgtgctttctgtttccacaagtaaaagtggttacccgtggaggctgggagaaaaggagtatgtcttatcttgttgcattttatactttttgattcatgtgaatatataatcttctcaggagttaaaaaattgtgtatagtttatttgcaactatttttaaaggaaaatccaagcttgtgggtagaggggaaagatataagaaaagcacatactcacaaaaaagaggaagaaggaaaatatggtagaaacctacttgaagtgttgtggcgtagggactacctcctgtaccgtgaagaagctgagaaactttagaacgaaggatctttgtcgtgtagctgctaagatatcatttactagtctttcctatcatcttcagaatatagcctgttcaacagagctatgatgggctgagcctaatatttgtacgagagaaattttacatgtagcatattctcaagttgtattgtatctcaactttcagtgactttccatttattttcccaaaatataccccaaaagatccttgaaaagtatttcaaatagaaatagtttctggagtttgtttcctcattactctctaaaaacatgatctgttgagaataaggaattttttgttaatgtcagttttaattgagggatgtttttctcaagttgtgatttcatgagtcaaccagcagggggagccatttgactaattataatttcattaattcattttccactggtggggttattactgaattatatagatgttacgtggctgaaaaattgttgtctattgacagtagatagcttagggagaaaaactgtaactcacagcataacaattaagattattgtctaagaagacagacaaacctaagtttgtgctccaggtatgccacttggctaatttgcataatttctccgagcctccgttttctcatttctaaattggcagctgtaaaaatattttggtgactactaaatgagttaaagcatttaaagcacttatcactgatcttggcatattgtgagcactcactaaatactaacttttaacaacttaagatattcccccataaaaagtaaaagtaggtataaaaagaataattcacttgttgtattcatataaatagtctgccttaacctttttaaatgttagttatgacttattaagaatcatgatggccgggtttggtggcttatgcctgtaatcccagcactttgggaggctgagacaggaggatctcttgaggccaggagtttgagaccagcctggccaacatggcgaaaccccatctctactaaaaatacaaaaattagccaggcatggtggtgggcgcctctaatcccagctactcgggaggctggggcacaagaattgcttgaacctgggaggtggaggttgcagtgagccggtatcatgccactgcactccaggctgggtgacagagtgagactttgtctttaaaaaaataaataagtacataaataatcatgatgcacagtttcaaaaacactggctcatactgagaaaataatagaacaaatgcacaatatattttatatatatagtcttaaaaacattgaaaattgctgatataccttcacaaaataaaaacaaaccaaaagaaacattgaaaacatgaaggaaatcagaaatctttaaccaaaaatagggaattaaattatgactcaacaacttgtaacgattttaaaattacataaatcattatggcagaatgtttactgtatgttcatatactttattgtctaaactgggtaattattgcagttcttttttttttttttttttttttttgagacagagtcctgctctgtcgcccaggctggagtgcagtggcgcgatcttcgctcactgcaacctccacctcccaggttcaagtgattctcctgcctcagcctcctgagtagctgggattacagacgtgtgccaccacgcccagcaaattttttgtattttcagtagagacggggtttcaccatgttagccaggatgttctcaaactcctgacctcatgatccgccctcctcggcctcccaaagtgctgggattacaggcgtgagcactgcgcccggacttcagtataagttttaaaaatataagtatagatgttgataaaagcttagggaattaagaaagtactggccaggtgcggtgtcttacacctgtaatcccagtgctttgggaggctgaggcaggtggatcacttgaggtcaggagttcaagaccagcctgacctacatggtgaaaccccgtctctagtaaaaatcaaacaaagagaaagtactttggaggccaggtgtggtggcacgcatctgtagttccagttacttgggaggctgaggtaggaggactgcttgagcccagaagttggaagccagcctgggcaacagtgagatctcatctctaaaaattaaaatttaaaaaaaagaagaaagtactgtaaatacccttattgagagatgtctctgctttttaaaaagtaaataaataaatttttgagctacggtctcacttgtcaacccaggctggagtgcagtggcatagtcgcggctcactgcagtttcagccttctaagcttagccagtcctcccatctcagccttcccagtagctgggaccacagtcgtgtactaccacacccagctaattttttgtaatttttttgtagagataggttcttgccatgttgcccaggctggtcttgaactcctgggattacaggcatgagccccagcatctggcctctgtgcatttttgacattgaaatattttgatgaaatttttaataaaacaatggtgaagccaggcgcagtggctcatgcctgtaatcccagcacttttggaggccaaggcaggcggatcacctgaggtcaggagttggagaccaacctggccaacatgatgaaaccccgtctctactaaaactaccaaaattagccaggagtggtagcacatgcctgtgatcccaactactcgggagactgaggcaggagaatcgcttaaacctaggaggctaaggttgccgtgagccaagattgcacattgcactccagcctgggcaattagagtgaaactccatcttgaaaaaaagaaaaaataaaacaacggtgaataattttaatgctgttcattggtaaaatagctggcaattttatattggcccccccttttctgttgtttttttttttttttaattttctgatctaaggaagttaaaaaccttaaaattatgtattcataaatagttgctctagtgtgatcagttgtgttgctgccagctttatgtttctatggtgaagactaaaatgaaatattttggagtcacttcaccattactttataatacgtttttcttaaaattactctgaaaatgaggttacgtttttagccaacaatgtcttaaatcatggcagtttcttaacaggtaagaattgttttaaaggattttttcttaattataaaaatagaaaataataaaatattaaaactacttcattgttccttgactcagaattaaacactgttaattgctgagtcttatttttctctctgtgtgtgtatgtgacaggcattgtacatagtaaatatagtatatggtgttgtaactcgctcttttgtcaccatttaactctttctggataattttcccatagctttaatctttcttcacaaatataatttctaatggctggatatattcttgttcttccattgagatgaatgccagatagtaaatattttaaattttgcagggcccagtggtctctattacgaactactcaactctgccattgaacacaaaagcagccttaagcatgacaaaaacaaatgagcatcactgtttcaataaaattttatttataaaacaggcatgggccaatccttgagctcaaacttcctaagtttacattttgcatcttatagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggttagatgtttggaaaatgtcactgagacttttgtaatggtctatgcctaagataatgtactttattttgctttaaacttgtgaaaaaacagaaaattttgctgagattcgctttattataccaaatgtttctaaagttttaacccgcatggccaatttcagaataataaagtttttatacctagagttgatttgattttagaccatatgttttattatatggctttcttatggtttacttgcctttaggcaaggatgtttgtcttcatattaagctatattttgttttgaatattttaggtcatgttgtatttgtcataacgatctaaaatttaaaatttttaaatgaaactttttttttttttttgagacagagtctcgctctgtcacccaggctggagtgcagtggcgtgatctcggctcactgcaagctccgcctcctgggttcccgccattctcctgcctcagcctcccgagtagctgggattacaggcgcctgccaccacgcctggctgattttttgtatttttagtagagatggggtttcaccatgttagccaggatggtcccaatctcctgaccttgtgatccgcccgcctcggcctcccaaagtgctgggattacaggcatgagccaccgcgcccagcctgaaacatgtttttagtatggaagatttggttttacatcccgttagatacaaagtatgtcatatctttccaatacggattcttttgactgttggattgacaagttatttaactgtttttgtttttattttttttttaagtcttagacacccagcccctgcagcctagcaactcctgatctgtcataggaaataggttttatttattttttatgaactgttactctggtatttaatgaagtgaatcttctgcatcactaatggagattttttgtgcccaccacctactccttgtacttacaaacttcatacttttcagtggaggcgtaactgatgttatttgtggtgcccagaatggttaagtcttaggaaattaaataattattgtattaccattttggtaagcatagtattaaatatgaataattctatgatacagcctgatgagttgctgtctcatagtgtcaggattacagtactttttgttattccgtaatatgcttcaaccttttagtctatttcatatagcctttcatttccattatatatcccatagtctgtttaacttatatttaacttgagcaaacttcatcttacatagtagctgtggcatgtttttattatccatttttatttttattttattttttgttatagaggcagcgttttttgtttgtttgttttaacgccatttcttttgaaaaataactatggcattttgtccgtctctgcttataagatattacatttcacatatttagtacataaatatattttttgtttaagtttaatggaggattaaaattttgtattaggtcagtgcctgatttttcttcactggagatgaagtacaccttgcaaaggagtatatcctgcttagcattataaaacccacaagaataggataagacttagggaaataagtaccttatttaccccctaccctttttgggcccttaacattttaccagcttttcagatctctaagttctatagaacccattagttttgggacagtgccagtctcctcccttccccctttcctcccccattcacacaattcattggagaaaatgacatgtttggactcttaggtgatattttatagctttcaggtaataaatatgtatctttttatagctctggatattggagttgtcgtaaactcttacctttccacctgtgacttacagaaatgttcaatctgaaacctgtttgttttatcagcaagtagacacttctgttctttagactatttaggggagtgtatagattcttcaatttcagtctaaatcagcctacatgaaatataccttatttgtttttaaaatttttatatttgcttgtcatgcatgctaatagaagggaactttagccagggttgacaacatataacaaattatgttgactttttcttttatctttgcaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggtttttgtttgtttttgttttttaatgtttttggtacactgggcagacttcagagcagttttttaaaaaaataaatattctaatgtagctatctcgccattccctttaaatacctgtcttaacctcctgcttttctttcctactcctttccacacatacgcacacaatcttctaccttttaaaggatcattaagactgtcaccacattaggagctctttctctcactcttctgtcatttgctgctatgttgaaattcttattttgaccatcaatgcctatgaattcttctaatacgtgaagaaaatagtttgagtagcagcagtgctataggtgggaaatacagtttagctgctgaatttctatacctctctgatttacagattgctaattaaatggctattattagtttggattaattagacttaagaaaacaactaactgagggttttttttgtttgttttttgagggttttctttgcatgagaattgtatgtaaccagtgatatgattattcctgaatgtacagacagaagtaagcctggacattgttaaatagtccctgctttaagggactacgataatgtgtactatgacaaacgtgctttattcttctaacgcagtaagaattaggtggaattttttccttcaaccaagtgcaggaaagccctgtgtgtcttggtttagttatggtttcatttctagccatacaattgatgaattgtgtacaacttttgttagtaccaaaataatctgttatatgaacagacttctaaaataacgtctgtatattttatatatagatacatatatgaaagaaggcttttattgaacagcttatcttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactctttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatg

SEQ ID NO: 36105 - DNA, 427225 bp, Homo sapiens
gccgggatgcactaggcaaagccagctgggctcctgagtccggtgggtacttggagaacttactacgtctagctggaggattgtaaatgcaccaatcagcatgctgtgtctagctcaaggtatgtgaacgcactaatcagtgctctgtgtctagctaatctggtggggacttggagaacttttgtgtctagctaaaggattgtaaacagaccaagcagctctctgtaaaatgaacccatcagctctctatgaaatggaccgatcatcaggatgtgggtggggtgagataagggaataaaagcagctgccagagccagcaacagcaacgtgctagggtccctttccacagtgtggaggctttgttcttttgctctttgcagtcttgctgctgctcactgtttggctctgcgcagagctgtaacactcaccgagaaggtctgcagcttcacccaaagatattccaaagatacagaaaactatatagagacattttgtatagttctaatagcatataatccacaggtccctgatctataatatgggttttttataaaattgtttttttgtatgctatgaggaattttacttgttaaaaagaagaggtggaaaggcagaatatgaaaactatgaaaatgacataagagactatgaattaggtgagaaaccagagaggtttagaaacctgtagacattgtgcatcccccaatgcctttccccttaaaaaaaattatattctaatccagtccatcaaataaagtctacgttcattagaaacatattctcttggtttttataatttcagtttttttcagacacagatagtgcatatgcagatttgttacttttgtacagtgcaccctggtagtgagcatagtacccagtaggtagttattcagcccatgctcccctctttcccccacccccgtagcctgcagcatgtcttgttcccatgttaatgttcctgtgtgctcagtgtttaggttccacttataagtgagaatgtgtggtatctggttttcttttccagcactaatttgcttaggattatgtccttagctccatccatgttgctgcaaaggacataatttcattcttttttatggaggcatagtattccatagtgtatatgtaccacattttctttatccaatccacctttgatgggcacctaggttcattccatgtctgtgctattgtgaataacatgctgatgaacgtacgagtgcatgtatatttttctggtagaataatttattttcctttgaatatatacccagtaatgggaatgctgggtcgaagggtatctctgttttaagttcttagagaaatctccaaaatactttccacagtacctgaaccagtttacatttccatcaacagtagtgtataagcattccctttactctgcagcctggccaacatctaatttttttactttttaattatagctgttgtgactgatgtgagatggcatcttactgtggtttttgcttgcatttatttatttgatgattagtaaggatgagtgttttttcatatacttgagtgtcttcttttgagaaaatatctgttcatgtcctttgccttttcttgatttaaattttaagttctggggtacatgtgcaggaagcgcagttttgttacatagataaacgtgtgtggtggtggtttgctgcacctatcaacccatcacctaggtattaagcccagcatgcattagctatttttcctgatgctctccctctcctcaaccccctacagaaaattatagtgtgtgttgtgtgttgttccccattgtgtgttgttcccctccctgtgtccatgtgttcccattgttcagctcccacttataagtgagaagatgcggagtttgattttctgctcctgtattagctttgccctttttaactggggttgttttatgcttgtcattttttcttccttatggatttgttatattagatctttatcagatgcatagtttgcaaatattttctcccattctgtaagttgtctgtttactctgtggatagtttctattgctgtgcagaagctttttagtttgattgactttcacttgtcagtttcgtttttgttgcaattgtttttagaaacttagccaaaaattatttgccaaggccaatgtcgagaaaaatatttcctaggttttgttttagagttttcataatctgaagtcttacattttaacctttaatccatcttgaattaatttgtgtgtatggtggaaggtaagcatccagtttcactcttctgcttatggctagcgaattatcccagcaccatttattgaatagggtgccttttccccattgtttgtttttgttggccttgtccacgatccagatggtggtaagtgtgcagctttatttttgagtgttctattctgttccattggcttaagtgtctgcttttgtaacagtatcatggttagtgtacacttatagtatagctggaaattgggtagtatgacgcctctctggctttattatttttgctcagaattgctttggccattctggcttttgggggtgttccatataaatttagaatagttttttctaattctgtgaagaatgatgttggtagtttcatggagatagccttgaatctacaagttgctttgggcagtgtggccattttaacatattgattcttttaatctgtaaacatggaatgttattccatttatttgtgttatcaaaatctccttccttccttccttccttccttccttccttccttccttccttccttccttccctccctccctccctccctccctcccttcctcccttccttccctccctccctcccttcctcccttccttccatccttccttccttttcttatttccttccttttttgagacagagtctcaccctttcacccaggctggaatgcagtggagttattatagctcactgcaggcttgaactcctggcctcaagccgtcagggtagttaggactacaggcatgtgccaccatgcctcgctatttaaaaaaaaaaaaaaaatttgtatagatgaggttccactatgttgcctaggttggtctcaaaactcctgggtccaagcgatatacctgcctcggcctcccaaaggcatgaaccactgcatccagcttcagatttcagctgtgttttgtaattctccttgtggagatcgttcacatcttaggttagttgtatttgcagggattttattttcatcctaggtgttgtaaatatgattgtgttcttaatttaactctcaacctggatgttgttgttgtatagaaatgctactaattgttgtacattgattttgtatcctgaaaccttgctaaaatcctttatcatttctagtagacttttgttgaagtctttaaggttttttaggtatagaaggatattgttgggtgaagacagatagtttgccttaatcttcacttcctatttgggtgcttttctctttttctgttgcaagattgctctgactaggatttctggtactatgttgaataggagtggtaagagtggatgtccttggcttgtttcatttctaaaggagaatgctttcagcttttgcccattgagtattatattggctgtgggtttgttgtagatagctcttttttattttgaagtatgcttatttgaagcctcaactgttgagggtttttttttgttttgttttttcatgaagggacactggatttaattgaaagcttttccggcatccgttgagatgatcatatggtttttgatttaattctgtttatctggtgaatcacatttattgatttgcatatgttgaaccagccatgcatcccaggaataaagcctgtattgtcatagtagattaattttttgatatgctgctgatggattcagtttgctagtactttgttgagaatttttgagtctatgttcgtcaacagtggtcacctgaatgttctttttttttgcgtctctgccaggttttggtattaagctgcttctggcttcacagcgtgagttaggaaggagtacgttctcttcaacttttctggaatagtttcagtagaattgtactagttcttcgttatacttccggtagaattttgctgtgaatccatatagtccagggctttttggcttggtagattttttattacttattcaatttcagagcttcatattggtctcttcagtatttcagtatcttcctgattcaatcttggaagattgcctgttttcagaaatttatccatttcctctagattttctaatttttgtgtctagagttattcctagtattctctgaggattattttgtatgtctgtgggaccatttttaatgtcgtttttgtcattctgatttatatatttagatcttctcttttttttctttgtttatctagctaaaggtctatcaatctctttttttaaatcaactcttggtttcattaatcttttgtatggatttttgcatctcaatttcattcagatcttctctattttagttgtttcttttcattcctagcgttgatgtagggttgttcttttttttttcttccctagttcctttaggtgtagtgttagattgttaatttgaagtatttctaactttatgataaaggcatttaaacgttcctcttaacactgatttagctgcatcccagagattttggtaatttgtgttcccattttcattaatttcactttcttaaaatttctcccttaattttgattttcacacagaagttattcaggagaaagttgtttaattttcatctatttgtgtagtgttgagagatgttggtatttatttatattttgattacattgagatctaagagtgtgcttgatatgatttcattttttaaaatttatccagacttgctttatgaccaagcatgtggtcaatgttagaatatgttccctgtgcagatgagaagaatgtatattctgtggttattgagtggagtgttctgtagatgtcttattaggtccagatggtcaagggtgaagtttaagtacacagtttcttccttagttatctgctttgatgatccagtgctgccagcgggggtgttgaagtctcctacagttattgggtggtcgtctgtctttttgtagtccaaaaagaacttgttttatgaatctgggtgctccatgttgggtgcatttatatttagggtacttaagtattcttgtttgatcatatactttctcatgacataatgctcttcattcttcaattgttctttttaattttgattaaagtctgttttatctgatataagaatagttactcctgcttttttgttatcatttgcatggcagattttctccatccccttattttgggccagtggctgtcattacatatgaggtgagtctcttgaagactgcagatggtgagccttgcatttttatccagtttgccattgtatgtcatttaagtgggggtgtttagcctatttacatttatggttaatgttgatacatgagattttgatcctatcatcacgtttgtagctggtttttaggtagacttgattgtgtagatactttatagtgcctgtgagctatgtacttaagtgggtttttgtggtagcaggtgtcattctttttactcaatgtatagcactcccttaaggacctttcataaggctggtcaagttgaaattgattccctcagtatttgcttatctgaggagaaatttgtttcttcttcacttaggaagtttagtttagtgaaatataaaattattgcctggaatttattttcattaatgatgttggacataggcccttaatctcttctggcttgtaaggtttttgctgagatatttactactagcctagtggagttcttgctttatgaaaacatgacctttctctctagctgcctttaagattttttttttcttttgtatttactttggtgaatatgatgactgtgtgccttagggatagtcaccttttatagtgcctagctgggtttgctgtattttttggatttacatgtcactctctctagcgaggttaggaaaattttcatagactctattctcaaatctattttccaagttgccttttctctttgtttctcttctaggaatgacaatgagtcgtagatttggtctctttatataattccatatttcttaaagctttggttcattttctttttttaattcttttttaaaattttcttttgactcagttgattcaacgaaccagtctttgagctctgagattctttccttagcttggcctaccttctgttaatatttcttactgtattataaaattcttatactgaattttttctgctctagaaattcagtgtggctgttgtttaaaatggcaatttcatctttcagcacttacttagattgctttactggattacttggctagggtttcaactttctccttaatgttcatgagcttccctgccatcgaggttctgtattctatgtctgttgcaattattttagactgattaagaaccattgcttggtagctagtgggctaattttgaggtaagaggacactctagctttttgaattgccagagttcttgcactgattttttctcttctggtagggttagtgttcctttaactgtagtgtatgttgagtataggcaattggttttgtttctggatgctttcaaagggtcagggctttctctgtccaggatttttatgtatgagtaattcttgtgtttggtttcacaggtgtatatgtagcaggataaattttgatgttgtagtttgggatgtgatccaatgcatagtgcttaagagtgatggccagtggctagcctaatacccagtggcatggctgttttatacttccttttgtttgcaggtgtgctctatagtgggggtgggagagatgcctccatcaccagatgtgctcctgggccctgggggagtctcctgcaatcactgtgtttcttgtgttaggtgttctaggccacaggtctctctcaggcagaggccctttcctaggagccattctggggaactagctgtagtgtttgggttccctgcacaggcttcctccctcttcagctcagcttcattgctgcctctgcatccactcagcattttctctctcaagatctgcctaaattacggtggtttactccataatttggtatctctcagtgggggtggtgcttcctgaccatgtcaaattgaccatgtattgtcacagaatgaaaacctctttgatagactttgtaacatttttgaatattacattcaggagtaaaatcttacgcagtgtgatcccagctatctcttcacttttgagaataaccttaagtaattaaaggataattaaatatgtaattaaaaatggaaaaatataacagctacacttccagatgtcaacttctttcagaaaattttaaaatctctttaaagaaaggtaaattgagaccaaaatagattaatagctttataaaaataagtgctcaaggagggtgttacatgagaaaattaaacttggaatttgtcattttacccgtaaaattactgagagtaatttccttgaaatggaaataactttacaaatttttaattaacaaaaatgctgaaatattactccgcttacctttatgtaacctcttccttgaaaacaacaatttactcatctggtgtgtgactctgataaccttcaatcattctctatatctgacaccatgactagtaacttagatctttaactaagcaacctttctttccacctttgtgatattatatctagtaatttaataacagacaatctatgttgcaaattaaacttccaaattgaatagtaattttcaaatcccaaggacccatttcttctgcctcaatcttaattaggtcttagttaatagaaaaattaactggctgggtgcggtggctcatgcctgtaatcccagcactttgggaggccaaggtgggcggatcacctgaggtctgaagttcgagaccatcctggccaacatggtgaaaccccatgtgtactaagaacacaaaaaattgaccgggtatggtggtgggtgggtgcctgtaatcccagctactcaggaggctaaggcaggagaatcacttgaactggcggggtggaggatgcagtgaaccgagatcccagcactgcgctgcagcctgggcagcaacagtgaaactcctcagaaaaaaaaaaaaaaaaaaagaaaaagaaaaagaaaaaagaaaattaactaaatcaagcctaaataaaacatattcacaaagtggcagacttttttaatccaaaaatttaactgtattaatgtctcatttacagaacattattttacaatgaggttttacacatcaatcagttgagtcacttcttttttttttttgagatggagtctcgctctgttgcccaggctggagtgcagtggtgtgacctcagctcactgcaacctccacctcctgggttcaagcgattctcctgcctcagcatcctgagtacaggcactacaggcacgtgagcaagagaagctgacagattcaaatgttcacaaacatttatgttctattttgatagatacataaactatgtttctcattcttatatactttatattagggcatgggattaaagtcaaaatagtggaaaattagtagaaataacatattttatatccaatttagtctccaaaatcccaacatgcactcttctgtatacgtttttcagtatgcttgactggaacggccaattctacagtagtcttggaagcaacatactgcagattaaataccttagtagcctatgttcttgaatgcggacataaaggagcaatgcttttcctatcttaaaaaaacagtttatatgaatgaaacttctgttctgtttaagatattatatgttgttgagtgtagttgtcaaagcaactagcacgattccaagtaatatagaaatcaccagcttgagttgggtctgccataacagcacctaaaacgtatccactaaattagtattaaatggacaagtaaaccaaactcagagggttgaaatgaagacttgtaatacccagtgaaaaaaaattattgaaactaccatctaaaattaattggaagcttaatattacctctaggaaagagtgtgggaaatgaggaaaggcaaaaggtaatgtgttcatgtttgttctgttccataatccaagaaatagataaacacaggcaaaaaaaaaaaaaaaaaaaaaagaaaaaagaaatatcctgtctttagagtggaaagaaagtggatagagttgagttgctaaaccttagcattattgacattttatgcctgatattcctgcattctgtgggaggttattctttgcattgtaggatattaatagtatctttaggctataccaccacataccagtagcatcaccacctaatcattataattcaaaatgtctccagacactgacaagtgttctatggaaacaaagtcattccttgttggaaaccacttgtaaacaaaaagtctagtaatggtggaattatacagtgacagaaaagctcaggtttttctgattaggttgaaaaagctgctcagaaattaaatcctactgtgttcataaaaaacaaggaacccagccctgaagcaaagaactcatcagggaagttgttttctctttcaagtctatgatttcaaatgaccttaaagtggtcatctttacagtcagagaagcatatgtgtgttggggaggagaaaaaagaaggaaatgaggcagactttagaattatacctaggaaagaactgtatgtttggttataaactagatccaataaataaataaatggtttccacgtaactacttggcaaaggtacaataagcctattgtgagaaaaaaaaattaaggcttaaaatatcctcaagcatcccaaattgcactaatcagtgcaattgattagtcatgctgagaaaacactcattgttctaatttaagatggaggcatggagaataagagaaaatgtaaattacctcagaaagtaaatctatgagccacagggacaatggaccttaaagttatttccacaggacatgtttatggtttcatcaaataaatatttgtactgctcagaaatatttttgtcagtgctctgcagacttctttgtcttctgataggagcttcaccatggtaacttagattttacagataatttgtcttttgactttataggacactagtcctcgttaagtcatatagtggcctgagggagagaactgcacgtcatgaaacatcctgaactctaagttgtaggcagtaactgggcaaaactttaagttgtttacagagggaagaaaagtgaatttttcatatataaagaagtgtgcaaattgtatttcatgagtagtcttttgtcttctggaatggtgatatatacaaagtaatctgggaagatacaatttggtaatagtagatccttcgttaacttgaattattttttgcaggaaagatgcgtctttagccaaaattacttatggtaaactgttatgtaagcaagaaatcaccttctacttggtttaagctattcagtgtactctctagatagatatgacacaaagctagcattatgatacagtaaaccaagtgttaatgtaactttatgttgattttgactacattctgaaaataataaaagtcatctggtattttaggcttacgatatgaacttgatactatgataggtgtctgaaatgtttatctcatttgattcttagaacaaacttatattgtgggtactaatacagtactgattttttaaataagaaaaaggattgcaaaaaatgtaaaaagtcttattaaagagtacaaaattctatctccaaatgtgtaatgaattttatatagtcagttaatatttgtttagctcaataaagtaatgttcggtgtaatagttgatttctttaatgttcattcagaatcacattatcaatttgaaattaattcacctattcgaagaagttgcttcctccaattaagacagtatagtaagcaaaataatggtttacaaaacaaacaaaccaacaaaaaaaaaaccgcatgtcctgatttctggaagctgtgaatatgttaactatctggtaaaaggggctttgcaagtattataatgttaaggatggtaagatgaaaaagtgtccttttgagttcagtgtaatcaaatgggtttaaactagggaaacattcttggctagaaacataaggtggtatgatttcaaaagaatggtcagagagacacagcatttctggtttgaacaaatgaaagaccataagctaacaaatcaggacagcctctggaggctggaaaagtcaaggaaactgattttcccctaaaaccttcagaaaggaacacaacagttctcactctttgattttagcctcataagatgcattgcagacatctgacaaacacaattgtttgacactatatttgtgctattttaaaccactaactttgtagtaattggctacagcagcagtaagaaaataatgcagagtgtttctataatggagataaaagtataaacaagaggcaaggatttccttccttcacagtgtttataatatactaagaaaacaaacattaaatacacagggccccaatagattattccactttaattttagctggcactgtggaaggaaaatagaaattctagaatatagtgaataggaatataacttattcttatgtgggaagaaatgcttattactgaatactatttgggctgaaaataaatgcactgtagttacagtaagtacagtaaaaaaggtagtttgctataagggaacagagccattgaaatgtaatgaaagtcatcaaagttttaggcactaactataagttgcaaggagttaaacaattataagcagtccgattattaaaaaaatatgtgcctgattctcaaaatcacaagtattctttaagattgctaaccgtagtagtcagttttcacaatgatataaagaatgacttgagactgagtaatttatgaagaaaagagatttaattgattcatagttcttcaggctttacaggaagcatgaatgggaggactcaggaaactcagaaaatcatggtggaaggcaaaggggaaacaaggttcttcttgacatggcaccaggagagagagagcacaaggagggaagtgccacacacttttaaaccatcagatctcttggaactcactcactatcatgagaatagcatgtggaaatctgctcccatgatccagtcacctccacccaggcccctctcttgacatgaggggattacaatttgagatgagatttgggtggggacagagggccaagccatattatttctcctctggcccctcccaagtatcatgtccttctcacatttcaaaaccaatcatgccttcccaacagactgaaagtcttaacttattccagcattaactcaaaagtccatgtccaaagtttcatctgagacaaggcaaatcgcttctgcctataagcctgtaaaatcaaaaacaagttagttaatttcaagacaacagtgggggtacagggatcaggtaaacactccaattccataagggagaaattagccaaaacaaagggtctgcaggccccatgcaagtccaaaacccgacaaggcagtcattaaatcttaaggctctgaaacaatcttctttgacctcatctctcacgtccagagcatactgatgcaatatctgggctcccatgagctttgacagctctgcctctgtggctctgcaaggcacagcccccacagctgctttcacaggctaggattgagtgcctgtgacttttccaggcacactgtgcaagctgtcagtggatctaccattctggggtctgaagcactatgaccctcttctcaaagctccagtagggagtgccccagtggggaatctgtgtgggggctccaaccccacattttccctctgcactgccctagtagaggttctccataagggctccacttctgcagcagacttttgcctagacatccaggcatttccatacatcctctgaaatctagatggaggttcccaaacctcacctcttcccttctgcacaaccacaggcccagcctcatgtggaagccaccaaagcttgaggcttgtattctctgaagcaatggcctgagtagtgccttggacccttttagccacagttggagctgagcagctggaacactgggcaccatgtcccgaggctgcccagagcagcagggccctgggcccatcccactaaacaatttctccctcctaggcctccaggcttataatgggaggggctgcctcaaaggtctctgaaatgtactggagacgtattccacattgtctttgccattaacatttggctcctctttacttatgcaaatttttgcttgaatttctcccaagagcgtgggtttttcttttttactatatggttaggctgcaaattttccaaacttttatggtctgctttccttttaaatatacgtttcagtttcaagccatctctttcttcatggacatgagcataaacttttagaagcagccaggccacatgttggaaggtctgttgcttagaaatttgtttcaccagataccctaaatcatctctctgaagttcaacattacacagatctctagggccgggtcaaaaggctgtcagtctctttgctaaagcatagcaagagtaactttttcttcagttctcaatgagttcctcatctccatctgagaccccctcagcctggacttcattatccaaatcattatcagcattttgttcacaaccattcaacaggtctctaggaagatttaaactttcccatatctccctgtcttcttctgagtcctccaaactgtttcctacctctgcctgttacccagttccaaagttacttccatattttcaggtatttttatagcaatgccccacttctctggtaccaattttctgtatctatctcttctcaaactgctataaagaactactgggtaatttatgaggaaaagaggtttaattgactcacagttctgcaagcttaacaggaagcacgactgggaggcctcaggaaactaacaatcatggcagaaggtaaagggggagcaggtgccttcttcacatggtgtcagtagagagaagagccggggggaagttccacacacttttaaaccatcagatcttgtgagaactcactgactgtcacgagaacagtatgggaaatccacccccatgatcaaatcacctcctaccagacccctcccctgacacgtggggattacgattcaacatgagatttgtgtggggacacagagccaaagtatatcactcacctaataagtgcttatcttgattaaattgtatggaaaactacaacttaaattatgtgatcagaaattctatctaatgatagacattaattcaaatgccaccatgttctcctgtcagcttctcatatattgtcatggatatgatttaattgtccttcagtgtcatggaacgcatcctgagattcagctgatgaagttgcaaactggataaatataaatgatgatgtttcaaaaaagaaaatcctcacttagtaaaaaaatgttaggtttattttacactttcttgacagctgaactaatataaaaagcactcaccttgtttctttcagttttgtgtatgttttgattgtgtcagctgagttcttcttcacgggattttctatgtgtcagagacacttgtcccccattctgttttcctgtgtaatctcaaaattgacaagggtcttcactgtatgtgaaaaggatgtctgtgttgcttgattttatgtgtgactactgtttgcgattgtccttttcccaatatgacatgtaattttacagcacagatagtttttcaaaagaattacattcccaggcttagcagagggagcggcctacttattgaaatgtgaaatcgaatctctgaaacagaaacaccaaattattatactaatctgtaaagtagctataaaacgttatttttcagagtgaagtatctgtcaagatggctagttttggtgtataatagaaacggtattttattccttttatttctgtaaacagattaagtctgtgtgtgtgtgtgtgtgtgtgtgtgtgtgtgtgtgtgtgtgtacatgggatataatacaaatctacctcgacttataatgagttacatcctgataaccacaggccaagatgtgttatgatggatctggatatactcataagttgaaaatattttaggtaaaaaatgcatttagtacatttaacaaaaatactggcaaaccgagtccagcagcacatcaaaaagcttatccaccaagatcaagttggcttcatccatgggatgcaagactggttcaacatacgcaagtcaatagatgtaatccatcacataaagagaaccaaagacaaaaaccacaagattatctcaatagatgcggaaaaggtctttgacaaaattcaatagcccttcatgctgaaaactctcaatgaactaggtattgatggaacatatctcaaaataataagagctatatatgacaaacccgcagccagtatcatactgaatgggcaaaaactggaagctttccctttgaaaactagcacaagacagtgatgccctctctcaccactcctattcaacatagtgttggaagttctggccagggcagtcaggcaagagaaagaaataaagggcattctattaggaaaagaggaagtcaaattgtccctgtttgcaggtgatatgattgtatatttagaaaaccccatcatctcagcccaaaatctccttaagctgatgagcaacttcagcaaagtctcaggttacaaaatcagtgtgcaaaaatcacatgcatttgtatacaccaataacagacaatcagagagccaaatcatgagtgaactcccattcacagttgctacaaagagaataaaatacctaggaatccaacttacaagggatgtgaaggacctctttaaggaaaactacaaaccactgctcaacgaaatacaagaggacacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactaaagttcatatggaatcaaaaaaagagcccatattgccaagacaatcctaagcaaaaagaacaaagctggaggcatcacgctacctgacttcaaactatactacaaggctacagtaacaaaaacagcattttactggtaccaaaacagagatatagaccaatggaatggaacagaggcctcagaaataacgctaaacatttacaaccatctgatgtttgacaaacctgacaaaaacaagaaatgggaaaaggattccctatttaataaatggtactggctagccatatgtagaaagctgaaactggatcccttccttcaccttatagaaaaattaattcaagatggattaaagacttaaatgttagacctaaaaccataaaaaccctagaagaaaacctaggcaataccattcaggacataggcatgggcaaggacttcatgtgtaaaacaccaaaagcaatggcaacaaaagccaaaatagacaaatggggtctaattaaactaaagagcttctgcacagcaaaagaaactaccatcagagcgaacaggcaacctacagaatgggagaaaatttttccaatctacccatttgacaaatagctaatatccagaatctacaaagaacttaaaccaatttacaagaaaaaaacaaagccatcaaaaagtggacaaaggatatgaacagacacttttcaaaagaagacatttatgcagccaacagacacatgaaaaaatgctcatcattactggtcatcagagaaatgcaaatcaaaaccacaatgagatagcatctcacaccagttagaatggcgatcattaaaaagtcgggaaacaacaggtgctggagaggatgtggagaaataggaatgcttttacactgtttgtgggagtgtaaactagttcaaccattgtggaagtcagtgtggcaattcctcaagtatctagaactagaaataccatgtgacccagtgatcccattactgggtatatacccaaagcattataaatcatgctgctataaagacacatgcacatgtatgtttattgcggcactcttcacaatagcaaagacttggaaccaaccgaaatgtccatcaatgatagactggattaagaaaatgtggcatacatacaccatggaatactatgctggcataaaaaatgatgagttcatgtcctttgtagtgacgtggatgaagctggaaaccatcattctgagcaaaccttcgcaaggacggagaaccaaacaccgtgtgttctcactcataggtgggaattgaacaacgagaacacttggacacagagtgggtaacatcacatgctggggcctattgtggggtggggggatgggtagggatagcattaggagaaatacctaatgtagttaatgagttaatgggtgcagcaaaccaacatggcacatgtatacatatgtaacaaacctgcaagttgtgcacatgtgccctagaacttaaagtattaaaaaaaaatacacttaagaaatgtgctcagaacacttacattagccagtccaaaaaaaaaatctaacctaaagcctatttttaaataaagtgttgaatatcacatgtaaattattaaatactgaatgtgaaaaacggaatgggtatatgggtaataaaagcattgtttctactgaatgtttatcacttttgtaccatgataaagctgtaaagttgtaccattgtaaatctgggaccatctgtgttacattcaagagaaaagctcagtcgaactaataaataaatcaaaatttcttctgattatttaggtgttttttcctgttagataattaagacatccaactgttgcttgctgcttcaccacacagaccatacacagatacaaatacacactccatgaatgagcatatgtgcttgtttaaagagacatactaaccaaacagttgtatgctgccgtgatattgattatgtcatcaagttccttatttaacaaaacacagctgtgtatgaagtatttctctaaaatgtacattcaatagcaactggttttgttcagtcttatgtacccatattatttaaatgagcacctggagtctagaattaactaaaaaatatctatgttgatgcatattaagttgattttgaagtcataaattttgacaagaattgatactatggcactgtcataactttacaaaagatgacctgaactaacatgattttatgcttttaccagtggaactccctgaaatatattcagataatttgttattaaagcaaaactaagtttattgaaaccctgtgccaagaaagtacaccattttgacatacttttgcagtgtttcagcagggaagagtgagaggaagatttttcatgtttgtggagaatggcttaagagagttaaatgagtctttcaaagtgagtagctgattgaaattgagctaaactcagagcataatagtttagatagtctaagaaattgaaaaaaaagttgatgccaagcatacaagaaataacaccaccaaaaaatagacctaaatacagacaaaattagattaaaaacaagaatatgttcaatgttaataaaagcaaaaggaacatagacatagttatggaggagttttgttttgttttaataagataaaaatatggttagttttatagcaatacacctggaaatctggatcaattctgtccactatagtcattactagtgacatgtagatattgaacacttgaaatatggtggatttgaattgatttatgctatatgtaaaatacaaactagatttagtttaaaaaatgtaaaactgaataattttaatattgttttatgctgagatgacaatattttggatatactggattaaatacatataaaatattgttaaaaatcaagtagtatagtaaaattggtctttttgttttacttttttattttgttttggtttttgaagggatagaaatcatggctaagatggaccctggggcatatcattgaccatcatgaaacatgcactgatttgccaaatgtattattttcctgtggctgttataaaaatcacaatacacttagtagtttaaaacaacataaatttattgtctagcagtattccaggttagaagttcaacacaggtcttactgatttaaaatcaaagcattggaagactgcattccttctataggctctgtggaataatccatgacctggcctttcccaggctttagaatccagctgcattctttgatgcatgttccctgtcttgggcagcttggaatactgtaagaaaataccatagaccgggtgacttaaacaactgacatttatttctcagagttctgaaagttgggaagtccaagattaaggtgctggtatatttggttcgtggtgagggcccactccctctctggttagtagatggcctccttctctctgtgttcacatggcctttcctggatacatgtttacggagagagaaagagaagggtggttgggtgggaggtggtctagtatctccaccttttcttataagaacactaacattatcatgagaacaccacacttaggacattatctcaacctaggttcctcccaaaagctccatctccagatactatcacactgccaattaatagatcattgaaaataatctattaatatttgaacaatgccaatcatcttcaatagattaattttagggagacacaaatattcagttcataacagttcctttccttgaccttcaaagctacaaatgaaggagcaagtcttcacattctccttttatatctccctcttctacgtgtaaagaatcttatgattgcatttggccatctaaaaatctatgatagtctctccatttcaaaatccttaactctaattgcatttgcaaagtctgtcctgccaggtaagctaacaaatttataaattatctggattaggaccgcatcatctctgaagagccattattctgactaccacatcagtatgttagtttatgtcaagattgctgtaataatcaataggttctggtaccacaaatccagtagcagtcattaaggttgattgagtttattgattgctttcagctccattctgctattaatcacttttggggatataaaatgaagaccttatcacatagaggaagaggtagatgtgataggagcttgaatatgtaataagaattttttatgatatgtaaatgtgagaaatgaattaagtatgtgccatttgttctcttctttttaagacatttctttctaaaggtttagtgacagaagttgcattctattaaagatccctaagtgctgttctgctgtaggcataagctttctttcctgggtgcagcatgttaggatttaagatttctatttatctaatactctgctgtttgtcagataaaataacaataaatagtgagtccaattattgataaacccagatgtttcatatttaggaatcgatgttaaaaaaaaaaaactctaattggcatcctaaggaaaatgtgtgcagcttagcactgattcaactgcatgtttagccaaattgtgaacaaattacggccagcttccggactcttctagagagtgactaaggacggcatagaggaattaggaatagtagctttataggtaaaataattaaatgtaaccttaagcataaaaagataaagttaactaggaaaatgaaaactcaagatatacagattaaatatgacaaacaatggatctttttttgtggatcttggtttgcagataccgatatctcatatagtgattcacttgatccaaaggcatttgatggaagctgtcttctcccaaagactatttgcttttggaagaatcctaagagtcattagttagaagtttttggtagggatactttcctgtaatatgaagatgacctaaacctctttacttgagagataggaatcaaaggatcagtcttttaaagactatgggtttgctagttgttagctgtgcctgatagtgacttttttcctatgatctttccctgccgtgtctcttagaagacaaggtatccaggtatgaaaaccaattttgcagacattgtttaggatactaatggggaaagtcttcagtaacttttgttgaaagaatggatttcctgagtccttacagcatttagttaaataagtgtagatttctagaatcagagctaatattcctagacacttggtttagctgttactaactcatgaaccacagaaagaagaaataccttagaccatgcaagtttgacgatgtctgtgaactttaccaactttagtttcagaattccatctttctaccttcccaaaaggttgaaagtgatatggacagtgaagtctgattaattgacagaacttttccatgttaataaaaattccggtaaaatggtttccttgttactagagatatagtttgggattccccaggctgaaaaaaaaaaaaaggattttctccatgccaacaagagacaaataatgatcagaacatatttaaaatctattgccagcacttgttatgaaaaattcatttagatttttactgagacattttacagttttgttaggattaatctgacgaaggttgagacaagttgtaaggatatagttatataaagatatacttaccaattttagcaaaattttcccccagctattggttaaatacattggtcaatttgtcctcattgtgccagaaaagctcagcagttctgactaaagtttatgttaacccattgccagtagaatgaaagagttgaatcctctcttaaattataatatatagttgactcctcaacaacacaggtttgaactgtgcaggtctgctcatatgtagattttttcctataaatatattagaaaatttttggagatttatgaaaaattgaaaaagataacaggtgacccatctacacaagaaatattaaaaaactaagaaaacgatgtcatgaatgcataaatcatatgtagatactagtgatcatttaatacaatgagatatatatgcgtctattataaaaagttaaaatttatcaagacgtaggcaaacacagagcatacatgcagccaattgaagtttagagaaaagtaaaacaaaaatatacaaaagtaaatcataactgcacaaaattaactgtagtacatactgtactactgggataatttcctagcctccacctgttgttcttgcagtgaactcaagtgttgtgagtattcacttaaaatgccacataatgctaatcatcttcttgtgagtagcttgtctctccagtaaattaacacagtaaaaagtgttctctcatgtttctcctgtattattcatgatgtctagtgcaataccataaaccttgaataacaccttcagacctataaaaagtgctgctagtgatgctgaaagttcttccaggaaacagagaagggtcctgacattacaggaaaacaatgaattgcttgataggtaccctagattgaggcctgcagctgtgtgtgctgccatttcagaagaaggatccatcttgtaaacacaggattgtaaacttatgagagaaataaatatactgtagtactgtaaacgtattttttcttccctataattttcttaataacactttcttttctgtaactagcttcattgtaaaactacgttgtaaaatacatacagcgtatgaaatatgtgttaaggattgtccagtcaacagtaggctgttagtttagttttggggagtccaaagttatatgtgaatttttgactgtgctggggtggtggggaggggttagggaggtttgatggccctaaaccttgtgtttttcaggagtcaactgtacaatttagaagaatatgatttagaatttccctgagattaagaacatattaaatggtgggaaggatattgatagacctctagatctagtgacactatcaactttgactgtgtctgtttgatgaaggaattaaaatctagtaacaaaagcattttgtagatagttattgtaccagtctttgttcttgaacatcagtgtgtttttttgaactgaaaatcacacattgaatgaaaggcttcatctcaatatattttatttacacataaatttgagctgttttttgttcacaagtttggccgataaaagagccctcacaatagctttaattaccatttaaaattacaaattaatgtgattttttaatttttctctcttttgtagggtgaaggagcaatgcttttggttactcagtattctctcaagaaaatttaaagatagtttatacatagaagatattttaacaggctatattctgaacttgtggcccggatttggaaaaagcaatatatcaagtatggttcaaggggacaagaaagagagaagcatttgttaccatttttccaagtcaaaaatatttaatcagataatattttaaaagccagcaataattagtaatgattggtataatgtttttgtcaaaattattaaataggagataaaattaaaagctttatttttttgcattcaaataaaattttaagtattttgatgagcatattaaatcaacaatgcatgtattacattgaacctgacttcttaataagttgcaaccaaatctttaatgataagtttaggtcagagagataattttgagatttgtcaccataaagatagggtataatgtgatgtaaataattaagatcaggtggaaagacaaataagattgaaggaagacccaagaccaaggtttgaggcactctcagaagttctaaaaaaaaaatttagactatgagtaaagaaggattgatcagcaaggtgaaatggatcaaggaaatgtgggcactcagaggtacagaggggttaattgctgctcagaaaatactcagacgaatgctgaacaatagattagatagaaccgatgtcctagaaatcatgaagataagtgactttattaaaatacatattataaacaaagaaggaatttactgttcgaaaagttgtcttgaagaattgttttgggagaaaataaaaaataaaccttattttctaaaatacactaaaactaattccaaatgagtcaaaggattgtgtacagatattttaaattaataaaacaatgttagtgcagattctctttaattacttccctgattgttttacctatagtaactcatttaattctactagcaatcttttcatgttggatacagctattcaaattttcttttgttattgcaatagcctcctaaccattcttccacaaaattgaggcgctaaaaggttgtgaaatttcctctatgccacagagctttttagtgatgatttggcatttggaagcacatctttgaaatgttcatttttctctgatggccagtgatggtgagcatttcttcatgtgttttttggctgcataaatatcttcttttgagaagtgtctgttcatgtccttcgcccactttttgatggggttgtttgtttttttcttgtaaatttgtttgagttcattgtagattctggatattagccctttgtcagatgagtagattgtgaaaattttctcccattctgtaggctgcctgttcactgtgatggtagtttcttttgctgtgcagaagctctttagtttaattagatcccatttgtcaattttggcttttgttgccattgcttttggtgttttagacatgaagtccttgcccacgcctgtgtcctgaatggtaatgcgtaggttttcttctagggtttttatggttttaggtctaacgtttaagtctttaatccatcttgaattaatttttgtataaggtgtaaggaagggatccagtttcagctttctccatatggctagccagttttcccagcaccatttattaaatagggaatcctttccccattgcttatttttctcaggtttgtcaaagatgagatagttgtagatatgcggcgttatttctgagggctctgttctgttccattgatctatatctctgttttggtaccagtaccgtgctgtttttgttactgtagccttgtagtatagtttgaagtcaggtagcgtgatgcctccagctttgttcttttggcttaggattgacttggcaacgcgggctcttttttggttccatacgaactttaaagtagttatttccaattctgtgaagaaagtcattggtagcttgatggggatggcattgaatctataaattaccttgggcagtatggccattttcacgatattgattcttcctacccatgagcatggaatgttcttctatttctttgtatcctcttttatttcattgagcagtggtttgtagttcttcttgaagaggtccttcccatcccttgtaagttggattcctaggtattttattctctttgaagcaattgtgaatgggagttcactcatgatttggctctctgactgtctgttattggtgtatacaaatgcgtgtgatttttgtacattgattttgtaacctgagactttgctgaagttgctcatcagcttaaggagattttgggctgagacaatggggttttctagatatacaatcgtgtcatctgcaaacagggacaatttgacttcctcttttcctaattgaataccctttctttccttctcctgcctaattgccctggccagaacttccaacactatgttgaataggagtggtgagagaggacaaatcaaaaccacagtgagataccatctcacaccagttagaatggcaatcattaaaacgtcaggaaacaacaggtgctgcagaagatgtggagaaataggaacacttttccactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccgacccaaatgtccaacaatgatagactggattaagaaaatgtggcacatatgcaccatggaatactgtgcagccataaaaaatgatgagttcatgtcctttgtagggacatggatgaaattggaaatcatcattctcagtaaactatcgcaaggacaaaaaccctaagaccgcatgttctcactcataggtgggaattgaacaatgagaacacatggacacaggaaggggaacaccacacgctggggactgttgtggggtgggggaaggggggagggaaagcattaggagatatatctaatgctaaatgacgagttaatgggtgcagcacaccagcatggcacatgtatacatatgtaactaacctgcacattgtgcacatgtaccctaaaacttgaaatataataataataaaatttaaaaaaaatgttcatttttaattatagcactacaccatgcactgaatcacggagggtaaaaatgcacactgttaataagaaggagggagtcaatctcattagtattataatatttatactgaatgagactccattcccgaaattcacagaattaaaataataaaaataaaaatttattgctagccaatttgcagcaaaaaagattcattctcatattctgctatgagaaaataaatgaaattgaattttaaaagacatttttggaaagccctttgaattaaccagaaaattgttaaattcgtagtttttttgactaacattcttcttccacgttaacagaatttatatataagtgacactcattgcatatacttttaaggggtaaaataattactaaatttatgtacactattaatacttcattgtataaaattgcatatatacccatatgcaaatgtgcacagaatcagtagggtaaccatagacataaaatgatcagtgcaggatattttatttatgcattttatatataatatacttttcatttaatatttttgctaattttattgaattgaatatttatgccttggttatagaacaactaaatttattttcaaagaaactccattattattgtctgcaagagtaaaacttataaacaatctaaaaattcaaccaaatacaaccatttacaattgtgccctagttgaatttgtaatcgtaggagaaaacacaggtgttgaattttttgaatttcatttaaaaaataattgacacaatccctaaggtatcatataaattaattgaattgttattgtcttgggttaacatttatttctagagttttttttcccctaatatctgattttttccattaacattacttatttggataatcagaaaaaaatcaacattgccaaaagatagataataccacaagcgaaatatctatgataatgataggaaaatgctttgaattcaggctgaatgagaattagtctaggaaaacagcttggaccctctcattcctgttaatgtcatctctgtgtttagcactgctgctattcctcagctactaagaaatgctctattgctgggcatggcatatgggaagccaagaaaaatgactggctgcttggtgacagctctctagtcctcatgccaagttctgccagtgatttaaatattaagtaatggaaagaattttgaaatccaggatgattagaaaagtcattttctacaaaagtgaagcattgtctttagagattaaaatctatgaaaataacattattgaaatactagacttcagactatttttctgaattactgtaactgttgaaataggtctttcagcccattaagataaacaccacacttttctcttcatgatctccagctgtaattttatagtgaaaggtgcttgcataaaagagttcacactatctgaaagatgtcacatgtaacattgactggcagccatttcagaatggcagacagccaataaatcattcagaactatgtgtcactcgttgtggctttaaaattgtattccttctcctttgataaagaacatttcaatgtcaaatagtttgttctatttaaacttatacatcaaccagaatattgagatacacaataaaattaaatgatttggtaatacctttagaatttatctaaaaacagccgtatgtatttgcatgacagatttggttcacaaaccgatcaagttgttagtatcaaaggcatgttttagtgctgatttgtgtatagataaatttaggaaattacataaatagaaatacttctttataaaattccttgaccttgtgatatcttggtattaagaatcttaaaggaatcatttaaaaaaattcaaaagcaaacaatttcgattttacaagagctaagaaaaaaacattttgctatggacacagatcgctcttcaagaaaagatttctttcccccttggctgctaggagcaatattacaaagcagccttcagctctcagctccttcaaagtttgcctcagctgtaaccattgtctggctcaatgttagggcatcctggagcactggacatgcaaacacgaatggagatgaggttataaagcctggccattttgacccacctgagaggattctgacaggtccttccagtgcctgagaaacccagggctcacatgctttatattctgatcattctgtaggggttgttcccatgggtgatagaagctgccaaatataaagaggcaaccatgcaaatttttaggaattatttccaaaactctcataacaacatcatatatatttattggttgtttaagtagatttctgaggagtagatagcaacgatagaagtgaaagaaagtaaatgcagttgttaaaggattagtcttcccatacttagaaagtacacaagttgcatatacactatgttccttccctagagcaagtatttcaatgcagtcatgtgtgtgtgtttgtgtgcttgtgtgtgtgtggtgtgtgtgtgtgtgtgtgtgtatgctaactgaactcattatagattttattggatcagatatatgaagagacttggaagacttgggtttgtctggaactgggtgaaatagagaaggacgatcattgacatagaaagctgattactttgtcctttgagtataaatagtcttacaataaaatggcatctccactgtctaaaacacatttttacatttgctctccttctgaaattatttatgtgaaattaacaaatgtacttattaccttagaaacaaacgatccgtaatttatattatttattgtatatttgtagatccacttaaaattgatttgcaatataaggaaaaaatgcgttttataagttgtttgctttgtgtagtgcatcttgttaaccgtaggactactgttgcattgaaacaaaatagaattaatctgttcaggtaaatagaactggaagtgagatttgttgtcactccttctccttcaagtactgaccagtcttttaattcacacataactaacactctgtgcaataatatttttttgttctctgtcttttcaaacagaactcaagctccatgaggagatgtttcattgtcggtgagcacattcttgtcaattagttccttcttgtttcttactatagcccctgtgtctagaacctttccaggtattcagtagccatttaaaaattatttgttgaatgaattgttattttaaagaacatccacaattttgcctgactgggcatgggaatacatgcccatctttggactgaatgtccatttttcccttctttgatttatcaaaatattggttaaatgatcaggactaccgtcagaaggaattttatatctaaaaatagtttaccttctatggatgtaaaaaatagttgtagtagttctggcttttatattattcgatgtttcaaagcggttttttttttccatcaccatattctacgttcttgaaaagtactcgttcatgtgactgctatcatttatgcttgtgcagcacgtagatacaggagagaagataaggaaaatgcttaccctgtgtctccttccctgtaacacagttttttttaccatattgattctccactttctactccctaagtaaaattttgcaacaggcatttgggaaactctggatacaagaaaaaaattttaatattgtacaaagagacaagaggtgacttcttttttatttttcatttagagtttatagtttaattaaagaaaatgcacatatatctaaagataatcatggataatacactcatgtaattactactttcagtggttgtaacaacagccaaagcacaaacagaaatgagaaagaattatcagcattatgcaagtacatatcctctttaagaattcctgttatagtgaaagcattaaaataattgaacacgtacagagaccatatactttgtgatctttttaaaaaagtattcaaaatatatttctgtgtgcaaaacattttcataatggtcttgtttaaatgaaagtatttagaatagcacattgtaaaattatgctgcagagcacaagtatttttctctttagaagacacataataaaatagaatcatcagtgttttttcataaacatgaatctttagagtgttacttgatcctgcataataagggtacttttttgcttaatgtaagcatagtatactaattcttttaaacttcagaaagcatatttacagtctaggcagatgggacatgaaggtcacacagcatgagcggtgaaatatctcatttacctagagttctagagagaattttaggaactcttatttattatcagtgcataaacaagagtaaactctacaaaactgtttgcaaaactctcctctttctactcagaaggctttccctagaataatcattatggagtctgtccatcctttactcattcactgcatggggacaggtgttagttatgagattggtgaatttagaaagctaaccaatttcatacctattttgggattctcaattcacaaacttttgtgcgtttcttaattatttcctttctttttcttgtagagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacagtaagtaataaaggtgacgttttgatctttatctgcttaattacttctgctatgattctattgattctaacattgaaggagcagtaaatttatatgtattatccaactataaaacaataaataaacgatatgtcaaatacattatcacatccttatgttcttatgataatattgtcctttttttaacagtttttattcttatttgttgattggtttgtctttatgttgtcctttctactatcaaactgaacatgttgaggtcataggctatcaaaactgtacatttctgatgctaaccatagagacttaacaacagtaaataggccaaaatggaatgttgttagccatagtgtgtattattatttcttttatacatgtggtcactgttagaggagtttatgactttttgcctagattaatgacacacaaaccatctacaaacgaatcataccttattccctcactgtaatttttaatgttgctatttttgcctgttaacattccataggtttatcacattgcttaaagatttaatttaatttctgtaattgtatatgtcatgagagattgcttttaaccttccaatgttcgtggtctcattttcactaacataatcccaactttagctgcgcacaataccacatttcccagcattccttgcatctggatatagctgtattcaaataagccgtgtgaaacttctgggatggctccttaagtgcagttgactcattagggaggtatgtcttttttatttttctacactttgtgctgctgtcctggagtacagacatggtggctagaagcatgaaatcaccttgaaggtagaagtcatgcattgaagttagtaaaagtgaaatgtaagtgtatagtttcctgatgaaaatgggaagcttatgtactagcaacagaatgcttattatgcaggcttcctatatgtaaaagaggacaaattctcattttattaagtttctgaaagtagatttctaaatgctggttctattttttattgaaagtaatggcaaaaaacgcaatgccttttgtaccaacctaatagttaataaacatatcctcaaatgaaatgtcttagaattgtgttcatcaagttaatattaataatttattagaatagcactctaaagggttgcagcctatgcatgaaaatacttacaaactactacatgataatcaattctttttggcaagactgctatttacatggacacaagagttattataagaatgttgtatgtatacatgaatagtgtctgttaaacactggatataataaaaacaatagtttttctgttaattataacaatctgaacatttttgtgattatatttcacaaatgacacaccattttatttgcagatttttcttatccccaaagtttttgttaatttattaccaacacagcacacaagtctagtggcaatgcattacctctgcagttgattttgaagtaagaaggcctatttattgcattcattcctgcttagatgacatcttaaatttgttaattggattattatgctctattctatacatttattgatttatagattttgtggacacaaatttcaaaacatattcgaaaatttggtgatagctttttagaatctattcttcaacatagttattgaaagtgaacaagaaggacctcctctagagattaggttgagaaccacttctttgatttgttaaatatgtgtacatggataccatgtggctttattatgaggagccacttaagtggctgagttacaattcacaaaacattgtcacagggaaaatatcaggacaaattttcaagtcgcatgccaagaaaagaaactttctgaatgcttataagaaataccttaattaatgggagcccttcaaagtacacaaaacatcataactaggagttgcaacacaaccagcaatttgctgattgaaatgcattcattcatactgacttcacctgctgaatggaatattgtgctgtactgtccttagctatggagagagaattaaggaatatccccttctggtgttcaacaacaacgaaagagcaagaaagatatattcctaatttttaaagaagaatgtagagatacttaaacaagacaatgaaggtggtagaaagattattaccatccccaaagtgtttgctcattaaaacattttgtgattttctctgccaatatcatacctgtatggataattgttttcctatccacacagttatgagagtgagaagatggaatataaaagatggaacaagagggaatctgtgtggtgaccacagtaatcacaggctggttgggatcctaaactcggccacagcacaaaagcatgttcaagtttaaagtcatgagagaggcctggcatagtggctcacacctataatccctgcactttgggaggccaaggtgggaggattgcttggggcaaagagctcaagatcagcctgggcaacatagtgagatcccatctaaaaaaatgttctttaagttagccttatgtggtggcatgttcctgtggtatcagctactcaggtggctgaagtgggagggtcacttgagcctggaggttgagccataatcatgccactgcactccagccttggtgacagattaagactctgtctccaaaagtaaaacaccaaacaacacaaaaagtaaagtcacaataaaatgagatgctattaaggttgttttaggttgattttcaactagaccagcatttagcctgtacaaaggcatatacaaaataaaccctaaacctaaatgggattcagcagcagcagtgtgggttaaagaagccaccagttccctggaggccagaaccacaggcctgtggccttttttattgttttgacagggaggtggaaagcaggagtataactacattcaagtgtctgctctgttgctgtaggagaaaatccgtgctgtagcacatcaaagtttttccaaattttatttcttaggacatctttggggtttatgtaagtattaaatagagctcccctagcccaggcttacacaggacatatgtctagtgtcataggtctgtatgcttaaattatagcagaaagtttgctaaaatttaagtgaagtaatgttgaaggttgaatcatttgaaacaaactacctgcaccaaaatattctttagtgtactgatttctatcccacccctaatgaggctgaattttaatcttaactctgcttgtaattaggtatttatatgtgtctgttattcattttttaacaagatgtctcttcagagataaaatgagggtagcaaaaaataattttaatagccatttatatggctttgataacaattgtctgttctacttatctgactgattctaaactctaaaggttattttacagttagtaaattacataatttttatgcaacaatttgcctgccaggattcctataatacttgtcagctatcagtaggtataagcctgttagcctctaatgtgaagataatatctctttaagttataacgcatttacaattgttacagtttctaaggtctttttgaagttagagatgcatctgaggatgatggttttcaaggagatagctctttgacaaaaaatgacaatatgggacttagtgttatattaatttacacattatgtttttgctataaagataaaaggtgtgctatactacctatcaattactgtatgccacattttgtagaattgttttccatattattgtagaatgtggcacttaaatagtatcatgaaaaaagtttattcaagaaataagacattaatgaaatataattaatatataaagactatatttaaaaataattatgtatttctaatcctaaactttttaaggtgacattatttttttctgtgatataatttcagttgagaagaactttaaattttaataagattttaagatgattcagtaatgttaacatacttttcttctgtaaattttgttaacaatttagctgcattaattaaatatttatgtagctaattttaatagtgatattttaatacaattcttaattttactcctggctttcaatcattcatatatgtttttaaaaattgctttttccattgctttacttcttaattacttttatcaaagtcttaattgtgtgtggttgattttaaaagttaaatatttctataagatttataaagacaaactgggtacagtgactcacacctgtaatcccagcactttgggaggccgagggggtagatcacttgaggtcaggagttcgagaccagcctggccaacatggtgaaagcagtttctactaaaaatacaaagatatgcctggtgtggtggttggcccctgtaattccagccacttgggaggctgaggcaggagaattgcttgaaccttggaagcggaggttgcagtgagctgaaaccatgccattgcactccagcctgggcagcaagagcgaaactccatcacaaaaaaaaaaaaaaaaaaaaaaaaaaaatatatatatatatatatatatatatatatatatatatatattatatattatatatatgtatgtatgtatatataaatgtatatgtgtgtgtatatatatagatacacactatatatatatatatatatatatatatatatatacacacacacacaatagaaatgtcctggctatatctatattaataggttttgcacatttaaaccaaagtcacacatatggtttgattctaattaattctaatgcatcttgcaggtttcaaactgtattctattatgtaattatctgctgatccactctgtatcctgttgtgtaagttgcgatgattaacctctgcctttacgatgtaatccaaatgtagcatatagacctcaatgataagattgatcatggtgcatttaatcattaatttattattaatctcttttatcctggtacttagagtgcagatttttctcaacaactatttacgcaatcattaaatgaaatatagccttgtgtcacttagcaatgaggatatgttctgagaagtgtgtggctaggtgattatcttactgtgcaaacttcatagagtgatcaatctataatggtgatagcaatttttcaaccctattataatcttaatgagccattgttttacatgctgtctcttattgatgtaaacgttgttatgtggcacatgattatgtaaaagatattaatccattcattatttatgcattcatccatttgacctatggtagtgttctattgaaaatgagtcatcgtgatacagaaatccactgttagttgtttttactttctcttgttcgtggggaagagtgggtattgattttaaaagtctaaagaatggggtattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttcgacaatggttgaactagtttacagtcccaccaacagtataaaagtgttcctatttctccacatcctctccagcacctgttgtttcctgactttttaatgattgccattctaactggtgtgagatggtatctcatcgtggttttgatttgcatttctctgatggccagtgatggtgagcattttttcatgtgttttttggctgcataaatgtcttcttttgcgaagtgtctgttcatgtccttcgcccactttttgatggggttgtttgtttttttcttgtaaatttgtttgagttcattgtagattctggatattagccctttgtcagatgagtaggttgcgaaaattttctcccattctgtaggttgcctgttcactgtgatggtagtttcttttgctgtgcagaagctctttagtttaattagatcccatttgtcaattttggcttttgttgccattgcttttggtgttttagacatgaagtccttgcccacgcctgtgtcctgaatggtaatgcctaggttttcttctagggtttttatggttttaggtctaacgtttaagtctttaatccatcttgaattaatttttgtataaggtgtaaggaagggatccagtttcagctttctccatatggctagccagttttcccagcaccatttattaaatagggaatcctttccccattgcttatttttctcaggtttgtcaaagatgagatagttgtagatatgcggcgttatttctgagggctctgttctgtcccattgatctatatctctgttttggtaccagtaccgtgctgtttttgttactgtagccttgtagtatagtttgaagtcaggtagcgtgatgcctccagctttgttcttttggcttaggattgacttggcaacgcgggctcttttttggttccatacgaactttaaagtagttatttccaattctgtgaagaaagtcattggtagcttgatggggatggcattggatctataaattaccttgggcagcaaagacttggaaccaatccagatgtccaacagtgatagactggattaagaaaatgtggcacatatacaccatgcaatactatgcagccataaaaaatgatgagttcatgtcctttgtagggacatggatgaaattggaaatcgtcattctcagtactatcgcaaggacaaaaaaccaaacaccggatgttctcactcataggtgggaattgaacaatgagaacacatggacacaggaaggggaacatcacactctggggactgttatggggtggggggaggggggagggatagcactcggagatatacctaatgctagatgacgagttagtgggtgcagcacaccagcatggcacatgtatacatatgtaactaacctgcacattgtgcacatgtaccctaaaacttaaaagtatataaaaaaaaaaagggggggtatacacacaatcaggtgtcaagcagtggcacctcgtgcaaaataataaactcatctaagatcctagcagttcattctgaaaataaagctggaaatatatcttggatatgtaaaatgtgagtgtaaaaattaatgaaactaagcaatgggaatatgagtagtaaattatttgagaaaatattataacatttacttttttaaatttcaaaactatatttccttatttaaaactgaaaatttttgtgtacatataggaaactaattgtgtcatttttctttttgttacaatatagagtgatgtttcaaaacacaaacataataggtagagtcaattacttaggggagtctaaacctggaggtaacattagaaatagaaataataaaatgcagtgtttttggatttgtctgttaagattattttaatccagatcatatttaatggtttacatagttgtatatcaaatttggtttcagaaataaattatacagtaaatttaaaaatgcaaaaaatgtatattgttatacattctgtaacctatgaatccatataacttgggcaagaaaattatataattaaaaataaaacctttctgttctcaattatgttttagggacagctatatagttcacactcacaaaggaatcataaaaactctatgtataatcttggaagtaaaaatatctgttgtatcatatttatgaagtatacaattgattaaaaatgataatgtctgtcttctatccaacggcaataacagaagataatggcatataagtaggcctgtctccttttttttggcattgatttatatatctttactagctttgttgttttaactccaataaaagattatttagtaagccaaagcaaaaaaaaaaaaaaaatcctgtgagcagccacaaactgaaagactacgatttttagtcaatgtcctaagcaacacagtaattttaggttaaccaatgtgtcaaagagaatgaggaaaaattattacaaaaatgaataaataaactggtctaggtcaaaccgtactccttctaaagagagtagtcaactgatattaaagcctgtgacgtagtatgtgccatattgagtatgcaatatctaaatatttcttttttttctttctccagctactgcaaaccctaattgtttccttatccgatcactttaaagtcattcagcaaatcataattatgccattgttaacatcagaaactgaaaacctactgtcaaaagtgagctaaaatatcatatttggatttatttataaatttattttataaaaagattgactttcaatttgagaataacataaaaaatcaattcattcctctgtgcatcaatattgtatcattggtagtttaaacttttcatctaatattagattgcatgcaggattttatatctaattactctggcagatggcctttagaaagttcaaaaataaaatgcagcaattcatattggcagatttactattgagaccaatgctttcttaactaaaaggttttgtttaaaatcgttagtttaggaaatctgataaagatttttgaatatcagagcgtttaaaagagattcttactttacatctggcatatttcttgtgttacatattataatttcattgaacatggctgtctgtaaaactatgtatatgatccggaagagactcaaattaaattaagttttaacagccatcaattcattttaaaatgacacaggcatgaaaaatgatctatcaagatttgtaaatcttattctgttagctattgctagagatagtctaaaggtattctacttggaatttgagatcaagacaaagattttctgttagtaataatattcagattatttttattttaatgtataaatttaaaattcttagaatattttcaacaatattttccatttctaaatttattttatttctaaacaaatgtaattactttatttattaacttttattttcagttcaggggtatatgtgcaggtttgttatataggtaaacctataggtaaataggtatacagattattttgtcacccaggcattaagcctatgcgcgttagtgaaaaatgttattgctttaaatatccaaattattcagctgcatttgatctcattctttagtccaatgtaagtaagagtaaaacaatgacatttaaggccaccaggctattctcatttttggaaaaatgctggattacattaccagcatattaaatgagaatatcaaggtgtaatatctccctagaaattgtctcaccttcaatactattgacatttttggacctgataattttgttgtgggctctagcctcatattataggaggtttaccagttttcctgccctaaacttaccggatgtgaatagcacactccactacctacagcagtaaaaactaaaattgtctctaaacattgacaaattgtccctggtagtgaaaatcacccctggttgagaccgtgttgttgaaaataaaacaaaaactttcacatcaataaatatgttaggctgtgtatgttaaggattaacattaagacaatatggagcaagcactacatgaaagcagtgacgattgggaattagtggcacattatcctaatagttaatatagtgactgtaatatctaaatatcatcctatagagtttttcttagattttttcattagtataacaggatgttgtgtatgttacactgtatatactgttattttgagagacaattttgggagattttgccaaggtattttcaattataggtctttaatacattctaagcaagtgggtctcaaaaatgggaattttacaccccacattcttcttcccatccggtggacatttgtcaatgtgcgcagatatttctgattaaaaaaaaaaaaaaactgtgaaagagagggtgtgctactggcatctggtggtcgaggctagggatgttgctaatcatcttacaatgtacacgatagttccccacaatgactttgagaaaccctgctctgacactactgcaggatgaattttaagcacaattataagagaggacctagatattgagttttaaaaggagaaaatataagtacaaaagaagaatgaagattgttacaacaggggcaagtagaagttagaagaaaatgtgataaagtaaatctacattttagaatagtactggaagttattatcaggtgttacagacaagtttgagacttccgtaagtgacctaaagaaattatggacactgcaagactaaataatcattcatttaggaaggagcttaaatgcactttctcaaggccgggcgaggtggctcacgcctgtaatcccagcactttgggaggccaaggtgggcagatcacgaggtcaggtgatcgagaccatcgtgggtaacacggtgaaaccccgtctctactaaaaaatacaaaaaaaaattagccgggcacggtggcgggcgccttagtcccatctactcgggaggctgaggcaggagaatggcgtgaacccgggaggcggagtttgcagtaagccgagatcccgccactgcactccagccagggtgactgagtgagactctgtctcaaaaaaaaaaaaaactttctcaagcatgctaagtcacaaaatttgagttatcctgagctttttttactttaagctatcaagccattgtttggaatcttcagaacctctttagagtttgggatttaagagtcagtaggtagatagtgagcttaagatgccaaacacaacatataaagctataaaaatccatatgatcttgaaagattaaatggaagcccagcacaaaacaattgctgagtatattatttacattatctgaaagtatgccagacagacactttatatgttaataaagatatgagaaagaaaattccaaagagtttctaaaaagtgaacaaccacaaaatttcaatagcttgcaacaaacattttcttctcactcatgttacctgatggaaaatcaaatggctgcctggagacagcatggagggagagactgattactgaggtgcacaagaaaacttttcataatgatggttgtgaatgtagtgatatttccaaaagtatatacatatatatatatatctatctcaaatttgaccacatcacacatttcaagtatactgaattgactgtgcatctcttattataccccaggaaagttgaagatatgacaatgaaaaaaaaattcttccaccgactacccatcaattttcttctcattagcctcacagatttcacagttaattaaagggaagatgcaaatatgttcaaactgtacatattctgaggcccataccttgccattagctcaataaagagagacattgtccctggcatgaaaatgaaaaacttgcacactccctaggtggcttctggacactcttaagacatgaacacactttgggggctcaccctgtcaggctttgctctccgagcttagatgagaaaaacacaaaaataaaaccaaaaggtgacatttaggtgcccatcaagaaagatgtgttgggaactggacaggtcagggctttaagtactgtatcttactgtatgtttaagtactgtatgttactgtggaaacttacccattttcccctcagaacaactctgtctcaggaggtgagtctgagagctactgtttctttgtaaaggttttatctgatcaggcccacggtcaccacgtcagccccactgcccctaaatagtttgaatcttgatgttttgatttcaaggacttctgattctagctacatagctttgtccatttcccaccttaccactatttactttgaattttgttgcatgccgagaccagtgactgccacaaatgtgactgttcctagaatctgctttctgctctgatctttagtcagtgcgcagactctaacataaactcctttctatcgtattttcttgagtccaagagcccatagattgtataatgcactattttatgtcccgttaagcaagtaattcgcattgtggctaattaaactaagacataccactgaattgtaaaatgcattatattttcaggagatattaaaatatgaaatgtataggtcttggaatagatgaattgtgacagtatctttggaaagctaattcagttgcagtattgcttaagatgtctttaagagctgacttcctttagttggaatacatatgtaaattatttgcagaggagatttacctcttttatctcattcatttgtttattcagtcatttattgatatcaatatggactaaggaaaattacatttttgggtataatccaaatatactaccaattaatgtattgtgttgctaaaattattctagaaattgaaagacctttcacctggcccctgtgcttgtttgacatatctcacaaatagatttttgttagtattttcataatttctggcactagaggatgtcccaggctcatcttgtgtattttcttccccattcttagaatcagccactttcaaagacgccctgctttctatatatgaaatcaatatttaagtgctagctgtgcctgtagctaagggagtatcaattttttcatagctctctaagatgagagagcaaagaaacaatgtgtatattcttacacatatgtagacacatatctttaaatatttctatatgtaaacatctatattagtccattatcccattgttataaagaactacctgatcctaggtaatttataaagaaaagagctttaattgcctcacagttgcacaggctgtacaggaagcaaggatggggaagcctcagaaaacgtacagtcatagcagaaggcaaagaggaagcaggcacatcttacatggctggagaaggaggaagagaactaagggggagatgctacacacttttaaacaaccagattgtgtgagaactaagtcattatcacaagaacagcaaggaggaaatctgcccccataatccagtcccctcccactagacccctccttcaacactggcgattacaattggacgagaggtttgagaggggacaaaatgtaaaccatatcaccatctatgtctgtattaagctaaacatgggttcttactgatgtcactacctctaacctagtcccgcaagcatcaatgccttcctgtatctctaaacccccactccaacaataaaaatcctgactcttactttgtgacatctatttagttaattgttcacttccagtatatgtatatagctgtaccagaattgataacctgcccttagtagaagaacatctttatcaactaaattaagtgccttcgtacaagtttcttttgcctttcatcttaagagactgcactcattttcaatatcactttgactagcaccctttcccttaagtccctcactgaagttattttgtatggttcataatagagctagataaatttgtaacagtctgcattccatcctgagattctacaaccttttaattaatttttaattaaaaatataacttttattttggtaaatattagcacttctgtgccacactactatatataaatatcaaaaaaaggtccagaaagctatagaaaatttgagtaaagtgctgaatgttgaacctaacaataactgggctaaagtaagtacagaaggcaattttttatttatgtaaatttatgggatacaaatataatcttattacctccataaagtacatagtgttgaagtaagggttttagaatatacatcacctgaaaaatgtacattgtgctcattacataatttctcatcatcccctcctcccaccctcctgaaatttccaagtctctgttgtctatcattccacattctatgtccatgtgtatacattatttagcgtccagttataagtgagaacatgcagtatttgtctttctgtgtctgatttgtttcacttaaaataatgaccagttacatccatgttgttacaaaagacatgattttattcttttgtatagctgaatagtattctatagcgcatatgtgccagatttattaatgtaatcatccactgagggacacattgctattgtgaatagtgctgtgataaacatatgggtgcagatacctttttcatacaattatctgttctcctttgggtagatctccagtagtgggattgttgggtgaaattgcggttttattaagaatgtatattctgtagttgctgggtagtattttctgtaaatgtcagttaggtctatttcatctaaggttgaatttaagtcttaggtttatttgttttctgtcttgatgataacatttaatgctgtgagtgagatggtaaagtcccccagtattatcgtattgctgtctattccttttttatgtctagtaatatttatttgatgaatcttggtggtctagtgttggatgcatatgtgtttagaattgttatatcctcttgctgaattgatccctttatcattatgtaatgacttcctttgtcattgttatactgttttagatttaagttctgttttacttgatataagtatagctattcctgcttgcttttagtctccgttacatggagtatcttttttcacccatttactttaaatctgtatgtgtctttacttttcagtctgtatgtgtctatatgtttcttgtaagcataatatttttggatcattttttagttcgttccatcaatctacctttcttttttttttttttacttttagatggagtttcactctgtcatccagagtggagtgcagtggcgcaatcttggctcactgcaaactccgtcttgcaggttcaagcgattctcctgcttcagcctcccaagtagatgggattacaggtgccggccaccacgcctggctaatttttgtatttttaatggagatagggtttcactatgttggccagcctggcctcgaactcctgacctcgtgatccacccacctcggcctcccaaagtgctgggattacaggtgtgagcaactgcacctggcccaatatctatcaatctatatattttaagtggaatgtttaattcatttacattcaaggttaatgttaatacatgaggttttctttctgccatattgctgtttgttttctacttgttttataagttctttggggttattttgttgttgttttttgtttttctttctgtgtgtctctttgtctttgtggtttggtggaaatctgttgtgttgctatttgattgctcgtcctactttgtgtgactgttttacaagacctatgagtttgctactttcatgtgttttgatgatgatgatgaatgttgacctttcatttttgtgtttgggacacctttgagtatttctcataggactcgtttggtggtgacgaattccctcagtgtgtgcttgtctggaaaatactttgaatcatttcaagaaaattaacagtgagttatgtcaatcaagccattggtttgtatttggtggcacatttactctgtattatttcacactagaaccatctgagttaagttttattatttgctatatgttgcagatgaagaaactgaagctgagagaggtttagtgaatgactaaaaaggttgtcaggctgcagggaaaaaaacaaaacaaaactgtacgactagcctgcaatgcttcccaaagtatgtagcttattattattggtcactttttgagtacaaaatgctgtgctatgtaacagaataatacaatgtacatatacatatcaattaacataagcataactgtaatcacatatactgataaataaaaatataaagtaatatatggtaatgacccaaccatttgcctaagtttcatgtattacagaagttttgaggagggacttcagctgtatgcaaatcagcaattcgggttgtacagttgattacccattagttcagaattttaataatttaaaatatatttattaagaacctaacaattggaagaccttacaataggtgggaaaattcgacagatgaataatgcttaggagatatcagcatgttttggaaggatattcccatgaagagaaaaagtatcgtgggaagtgtgggaagtgttatggtgcgagagtaatacaggttccagcatgtgtttacattattttgttggaggtgttggggaacctttcatggaaggtgtgtggtagactgttggacaggtttcctcaactttcgttccactctttgaagaggttagaaaactaaaacaaaacaaaacaagcaatgcagcttcccttgagctagctttatgaatgcagcttagaccacttaccgattgtttgcatatgaatcagacttagaaaaatggaagagatcaaagcctgtcttgctattgttgattctggcaagtgaaatcatggggacaatagttcagaagtagtggaagtggtaggattcaatatccttgtgcctaatccccagtttcatgggcataagaggcttaaagttttaatagcaggagcatctttttgacccaggattgcagaaatgattgcgtgcctttgaattcaagaactcaaaaccttcctccatgccacagctactttagttattttagcccttcctattgtatatgtatgaaatgcactttctgcttaagatacctattgcggtttttatttccttattaaaaccttggaaaaatatagcacttaaattatgttttgtagaaattcactaagcaaataaagctaaagggggagagagttaaccttctctgccccctttttatcagaagttagttgtagaagaaatacacaatttttgcgcaattttagcaccatctaagttctgtaggtctggaacacagactggttaaatgagcatttcaggagcactatagttgcaaagttaagcagtcaccacaattttatgtgtcatacaaagatttttaactttatgtttaagcaacgagcctagaagcaaatggtatttccatcaagaatcgtctcatataaagtagagcgttttggaaaatgaagttattaatagataaaaacatgtttatgcagttggtttctaagtatgacaaacctatttcttggtaaattgcaagtccattccacctgtgtttgtaggctcatttgcctaaaagtcttgggattttttctgatgatctattaaattttctttctgattatcttttctaatgctgtaatagcatttctaacactgtaatgaaagagaacaaaagtacacgcttgctcatcatttactaattctaaaaatatatattgaatacatctatgtagcaggtactgtggtaggtgtggaagatagttgagacaggtaacaagcccaacattacggagcttagcatcaccacctagaagagtttttaaaaaacatagataagtgaataatgattataaagacaaagagattcttgccatataattacatataagcaaatttaggatgtgatgaaagattttgatattggtcttctgatttggctgtaggatgaagtgtttataagtcatcccaaggaagaaacaattcagatgagaactattcaatggatttgcaataacaatccaaagatggaagaagacacttctaggtagacaaaattgcaagtatagagaatgtaaattaagagagagcttagctttcagatgaattaaaagattgtggtgatcagaatgtagagattgacgagagacaaatgaaataaaactagaaggacaagtagagatttgtgggtcaagttttaaaattttattataaatgcactgatactgttctgaacattttcttacacatggaaatttaatgattatggctattgaaaaatgtaactcttcatttatatttttccgagaatgaaatcggtggaattgctggggggtgaaaatgtccaatgcgaaacaggaggctaatttaagaagggatactgcaaaattggtcatgatggctcaaactgctgttcataatagagagaagaaaatggatagagttacatatggatgagagtaaattgacaaggctaaatgctaaaacgtgggtagtgacagaaagtaggtgtcaaaatagacttccaggaaaagaaaaaatgggtctacaaaagagccaaatgctgatgtgggttacatgatcctgagcagatgcagatgtaattggttaagtaaagtaagttcttaagatagatttggcctggcgctatacattctagagcccctgaatataagtgggatataaaaccatgggaatgactgtatttgtctaaggagagaatttggcagaagaaaaggagacataagatgaaatgcagaggaaattcaaatttaattggcaggtgtaggaagacaaggagatgacaaaaggaactggaaatgagtaatcagagacagaaaagtaaaagtaagagtagaatgtcatggaaggcaaataattggaatgtttcaagaacagggaaatgggcaataaagagaagaaaaaaatagtgaccagagggtatagtaatgtgtagaaattcatcctgtgttaggtttgattgcttagacgttttatataaaaatctttcccagagagtaataaaacagaagtgaggttagagaaagaacatacgatttagccaaaaggtgggaaaagttaggaaatgaagaataaatatgtttaaagataatgttatggctactcaatgtacaacctcttttctttcattatttttaattgtcatatttaaaaatagtaattaccacttttaaaaattgtcttattatttgttacataagaaaatgcattaattcaagccacatagtatcatttatattatgactgtcgaaacattactagaattactagaactattaacctaatggcctgaaaatttcaactcacttccctagctgtcctgatgatcattagtgaaaggaaagactccattaaataatgcttacttatagagaactggttatatctgtctcatttccatacatatatctgtataaattaatttgattaataaaacaaacacaaggcacaaacaacaaaacacagtttataaatgtcattgaaaaatgcatgcctgtacaatttgggtatttgtaattgtaaattgatatacttcattttttatccaggagttacttagattgaaactttacctaatgtatgataaaataatacgtgattaaatttaaaaacatgatgaatttatttaaaattggcttcaataatgtcagaaagtaataaaataaaatgattccttcaaagactgcacctgtttattgcctgagattatctctcttggccacaaatcaatattactttctttcattcatcagtgataaagcttttcaataattctaattttaaaggatgattacagcaagtatatagtcattgattgcttaaaggttgcagctaaaatgaacacaatggtcattttatttttaataaatgagcccttttgaaaagtcaagcatttttcctctcacaaaactttgtgtaataagattatagatttgatcatgtatgagtttgcactgtgtgtgtgtatatatgtgtgtgtgatttcagcgataaagttcactgttccacagctggcaatttcttctgcttaattgaaaattccgttttaaaatatttctttaaagttctaaaatgggtttaaatgggttcatgagctgtaatactattaaaaatatatatatatctacatatttgttgattcttctcagtttaagaagtggagcttcatactcctccccttgaaggcaggctaagctgagtgactcccatctaagaaataaaacaccgcaggattggaatgttaccttgtgagacaaggtcacaaaggctagggttttaattttgagtgaactaatttgctccttactggtgtttctctctctttctctccttcaactctttacgagcccagccaccatgcaaataattccaaactatcttttctagaaagctcacatgaagaaccgaggcatcctatctgatatccagccaaatgattaaacattctagaagcagactatgatgcactgaatttgtgaaatcctaacccccagtgtaatgatagtaggaggtggagcttttggtagatgatagtctgtcttcatgttggggattagtgccttgattattattttttgtttttatttttatttttatttatttatttatttatttttgagacagagttttgctctgttacccaggctggagtgcagtggtgccatgtcagctcactgcaacgtctgcctcctgggttcaagtgtttcttctgcctcagcctcctgagtagctgagtagctgagactacaggtacgcaccaccacacctggctaatttttgtatttttagtagagacggggtttcaccatactggccaggctggtctggaactcctgacctcgtgatctgcctgcctcagcctcccaaagtactgggattacagatgtgagccaccgtgcccagccggggattagtgcccttataaaagagaccccaaaaagcgtccttgccccttctgccatgtgagctagaggacagtaatctatgaactaaaaaatgggctctgaccagacaccaaatctgcaagcaccttgattttgcaccatccagcctccggtaccattacaaacgtttctgttgtttataagctaccctgtctatggtattctgtagcgacagtgcaaacaaactaagacacggaccttccaacacaagttaaaggcttcaggggatgctgcctgggtcaacaacatgacagcaacctttactcatgagagactttgagtcagaaccacctacccaaatccatcatttccctgacttctatgaattgtgtcatacatatttgttattttaagccattaagttttagggtaatttttaaatggaaaaatacatgatcataggtaaactataattaatagaaaaatctaatgccaataatatttaccattgattgaccgtcaaaactccattaattatttgctttccatttatatttatttttggatttcttttttaagagaatggcacctgtgacagcatactgttaatattacccttttatcgtactttaccatgccatctctgaagaatattacagaccattttggagcatggtgaataagaaattttcaccttaggagttcacttgaatagtcatttttatatttgtgactgcaaatcactcttaggggctgtacttccttagtactggtagcattattatccaatggacttttatagctttcattaggttttcttttgtttttgttctttaaagaacgttttacttatcttagtatttcatttttcatctatattatgaggcagtaagagtcttctgtttttccaaagttgagactgctttatatttatttcgtattgtctacagctgtagtgttcaatacattagccactagccacatgtggttatttaaataagataaaataaaaattggccgggcgtggtggctcacgccggtaatcccagcactttgggaggccgaggcgggcagatcattaggtcaggagatcgagaccatccttactaagacggtgaacccccatctctattaaaaatacaaaaaattagccgggcgtggtggcgggcgcctgcagtcccagctactcaggaggctgaggcaggagaatggcgtgaacctgggaggcagagtttgcagtgagccgagatggcgccactgcactccatcctgggggacagagcgagactccatctcaaaaaaaaaaagaaaattaaaaattaagttctttagttgcactagccatatttcaaatacttgatggatacatgtggctagtggctaacataagggatagcacagatataaaacatttgctcgtcatataaagttctattggatagtgctggtctgtagcttataggatggtatcttagtctgcttcagctgctaaaacagaataccataaattaggtagcttaaacagtagatattttgaccaggcgtggtggcttatgcctgtattcctaacactttgggaggccgaggcaggtggataacttgagctcaggagtttgagactagcctgggcagcatggcaaaaccttgtctctacgaaaattagctgggcgtggtggtgcacgcctgtagtctgagctacttgggaggctgaggtgggagaattgcttgaacctgggaggcggaggttgcagtgagccatgatcgcaccactgtactccagcctggatgacagaatgagactctgtctcaaaaaaaacaaaaacaaacaaacaaaaaaacacagatatttctcacagttctgcagactggaagtgcaagatcaaagtgttggcaaattatgtttcttaaagagggcctgcttcctagattggaaatggccatcttctctcggtatcctcacatggtagggagaaaagcagctctagtgtctcttataaaggaagtaatgccaccataggggctctattctcatgacctcatctaaacctaattctctcctaaaggccacgcctcccagtatcctcaccttgggggttagggctttatcatatgaatttttttttttttttttttttttttgagacagagtctcgctctgtctgtcacccaggctggagtgcagtggcacaatctcggctctctacaagctccgcctcctgggttcacgccattctcctgcgtcagcctcctcagtagctgggactaaggcgcccgccactgcgcccggctaattttttgtattttcagtagagacggggttttaccatgttagccaggatgatctcgatctcctgacctcatgatccacccgcctcggcctcccaaagtgctgggattacaggcatgagccaccgcgccgggcctatcatatgaattttgagggaacacaaacatgcagtctgtagcagatggtaataggctgacatattacacttgttgatgtaaatctgataggtttctttctctccaaggacagctttttaaatatttaacagtatcaataatttttcaggttctgtgagaattttataatttataatttgcagacttaatgtataatctattttgtcctaacaattacaaatatattttttatttcagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaacggggcaaagtgagttatacagctccattcttagaaaccttggagtacttttcttagtttatacttgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattcctatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacatttcagtgcttgccaatatttggtaatatttatgtttcctatatttgtaatgaacattcttcttccggtacattttttgttaaattattgtttgatggataaaagttcaccctttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccagtaggcccaggcagtcttgggacttgggtctgtcctgctgtgcatccatagtgggtgctttagaaacgggaggcccacccgaagtccctgttgcaagtgaggacaaagtgtgggaaggccgtgagggtctgcagtccgggatggccttgtcctcaacgtgcagtgcactgttgatgcgctggaatgccgtctctttttccaggtgcaggtcttcagccgtgacccggtaccccagctctaagggaggtggcagcatcaaaggctcccctcgcctgcgtggcagcaggggaatcttgcgtctacggggcctagagtcctgggatctgggggagccacccgttggggcgattgtctgccctggtgctgtatctgcccccttttcacaccgtgtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtgtggttatatctgatttctgagctctgggcgtggaggtctgtctgcagaggcccgggcctgggcacaaagggagaggggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtaccggcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaaaaagaaaaaaaagaggccgggtgtggtggcttatgcctatgatcctagcactttgggaggtcggggtggacggatcacgagatcaggagttggaggccagcctggccaacatagtgaaagcccgtctctagtaaaaatacaaaatttagtcagacatggtgggcaggagagagcatgtgcaggggaacatccatttataaaaccatcagacctcatgagacttattcactaccatgagaacagcatgggggaaactgcctccatgattcagttatctccacctggccccacccttgacacatgggaattgttacaattcaagatgagatttgggtgcggacagagccaaaccatataattcttccccggcccctcccaaatctcatgtcctcatatttcaaaagcaatcgtgccttcccctaagtcccccaaactcttatttcagcattaactcaaaattccatagtccaaagtctcatctgagacaaggcaagtcccttccacctatgagcctgtaaaatcaaaagcaagttagttattttctagatacacagggatacaggcattgggtagatacactcgtttcaaatgggagaaattggccaaagcgaaagagctacaggccccatgcaagtccaaaacccagcaggcaaatcttaaagctccaaaatgacctcctttgactccatgtgtcacatctaggtgatgcaagaagtgggttcccagggtcttgggcagccccgcccctgtggctttgcagggtacagccccccttctggctgcattgagtgtctgcagcttttccaggcacacagtgcaagctgtcagtggatctaccattctggggtctggaggatggtggcccttttctcacagctctgcttggcagtaccccagtggggactctgtgtggaagctccaaccccatatttccctttgacactgccctagcagaggttatccatgagggccccccctcccctcccctcccccccacagcaaacttttgcctggatttccaggcattttcatacatcttctgaaatgtaggcagaggttcatgaacgttaatgcttgacttcggtgcatctgcaggcttaacaccacctagaacctgaaaggcttggaacttgcaccctctgaagccatggcctgaggtgtaccttggccccttttacctatggcaggagcagctgggatgcagggccccaagttcctaggctgcacacagcagggggttctggacccacaaaaccatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctgtagggaactctagaaaaaaattcttattttccctctttcccgcctatcttatgcccgtttctaatacaggtgcacaatgcctgcagtgtctttgcatagtaagagtgactttactccatttcccaacaaattcctcatctgcctctgagaccacctccgcctggaccttgttgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcaccccactctactggtatcaacttattgtattagtctgttctcacactgcaaataaagacatacctgagactgggtaatttataaaggaaagaggttgaattgactcacagttctgcatggctggggaggcctcacagtcatggtggaaggcaaggaggtgcaaaagcatgtctcacatagtggcaggcaggagagagcatgtgcaggggagctcccatttataaaaccatcagatctcatgagacttagtcactaccgcgagaacagtatggggggaaccatccccatgattcagttatctgcacccggccccacccttgacacgtgggaattattacaatgcaaggtgagatttgggtggggacccatccaaactatgtcagtatgttttgacttcttgcttgattgctaggttgcatagaggacaaacatggaaattaatgaagtaccttaatatctggcttcagatcttagacaggatcagagggccagctcaaatttgcaaggaggggaggtagatcccaccattttatgggtgaatggcaaaatcaaacagaaattatgtgggatgggagatactgatgcaggcatctttggaaacattctacttagctaattttatgctaggctttaggtcaagaaggagagagagagctgacatgctgtggtacacacttatagtcccagcgacttggaaagctgaggcaggaggattgcttgatcccaggagtttgaggtagtgtgcgatgatcgttcttgtgaatagccactagccactgaactccagcttgggcaacattgagacaccctgtctcttaatttaaaaaaaaaaaaaaaaaaaaaggaggaaagaaagtggtctcagtttttaatgtaaatatttttaatgggatactgatattttaagattaatgtatattgtatatcagttaactgcaggtcaataattatataaaacttaaggtacgaaaaacatttatttttgctaacatatctgtgagttgactgttgttggcttggtgaggctgcaagctgcagatagagtctaggtatgttttctgtgtgtttgttcccccttggatcagtggactacctgagaatgtgtttctgtcacagtgatagaatcacaaggaaactccagttctggaagtacattttaagccattgcttctctcatgtccactaacattcagtcagccaaagcacataccttgtccatggctaacattgatagtatagataaatatacctgatctctagcaggaggaactgcattgtcttggggaaaggttttagatatagggaggggtgatgagttgggaacaataatgtagtctgccgcaaacatattaaagtgtaactggatatggttgctgcagaattttgaacctttgttttaattgtgatttttactctttcccccctatctagtgcccttttgtaatacagtaattatcatgatttttgtctgaactgaaatcttctgagattagattgtctacgaaaatacagtcgatcctccttgttttcagcttttgtatttgtgaactcacctactattttttgtaacccccaaatcagtactcacagcactttcatagtcatgtgtttgcgcagagtgtcaaagaatttgagtttgaacaggatgatattctgccttctttttcagctctcatacaatagtcaggtatcctttttgtggtctatttaatgccatgcttttcctgtttttgtactgtttgttggttgttttgccatttaaattaacccccaagcatagtgctgaagtgctgcttagcattcacaagtccaagaagtctgtgatgtgtcttacagagaaaatacatgcattaaataaactccattcaggcgtgagtgctgtagtgccgttggctgtgagttcaatgttaatgaatgaacaatgtatattatttatttattcttcatttaattaattattattattattttttttgagatagagtctcactctgttgctcaggctggagtgcagtggtgcagtcttggctcactgcaacctctgcctcctgggttcaagcgattcccctgccttcgcctcccaagtagctaagactacaggcatgcgccaccatgcctggctaattttttttttttttttttgtagttttagtagagacggggtttcaccacgttggccaggctggtctcgaactccagacctcaaatgatctgcccgccttggcttcccaaagtgctgggattacaggcgttagccactgtgcctggccaacaatatatattaaataagcacacatacaacaaaagtaggtgttggtaagcttacaaaagtgtgaccagtagcttgctgaaacctaactttttatttgttcatggaactttctagaccgtaactacactgaataatgagaatctgctgtaatctttttaggtgctgtagatgagccattggattaaattattacagtatgtttcagactgctgtatgttgaaccctagtgaaatgcctctcaaaccttcataaggatcacaatctcatgtcctttttttttgttattaaatgcccagtatgtgttagcgatttaaacaaaattcaaatattttttttttttttttgagacagagtctcgctctgtcacctaagctggagagtgcagtggtatgatctcggctcactacaacctctgcctcccgggttcaggcgattctcctgcctcagcatcctgagtagctgggattacaggcacccgccaccacgctgggctaatttttgtatttttagtagagacggggtttcgccaggttgtccaggctggtctggaactcctgacctcatgcgatctgcctgccttggcctcctgaagtgctgggattataggcgtgagccaccatgcccggcgttgacttcttaataataaccatactgactggtgtgagatggtatgccattgtggttttgatttgcatttctctaatgatcagtgatattgagctttttctcatatgcttgttggccgcatgtgtgtcttcttttgaagtgtctgtttatgtcctgtgcccactttccaatgagattttttttttttcttgtaaatttgtttaagttccttatcagtgttggacattagatctttgtcacatgcattgttgcaaaaattttctcccattctgtaggttgtctgttcactctgttgatagtttcttttgctgtgcagaagcttcaagaagaaaggaatccgattggttctgtgtctgtctcttttggtattctcagaattatgtagtcattcatatagaaagatgattaggaaaataggacaagaatagcagaaatctacataaaaatgtaggaaattaaaattagttaccagcatacaaaaaacttctgtatgttataattacatactataactcacccctccttggcaaatattctctctcttttgacttcaaaatcatggcttatatgtactttctctatttcccagatgcaaatataattaattgactttatttatctaggaaatgttactcatatcttaattgtagtcattggcttgagtgacgggttttggtaattcaactactattacttgaaagtagtagatttcataggatactgttataaaatctttttaacctcttttctgatttcaggagtaattagtaattgtggtttactggaaaattcaatgaatagggtgttaaaggaagcaattcattaataatatatgtaatctattgggagactgaggcgggtggatcacctgagttcaggagttcgagaccagcctggccaacatggcaaaactccgtctctactgaaaatagaaaaattcgccgggcatggtggtgcattcctgtattcccaggtactcggaaggctgaggcaggagaatcacctgaactccagaggtggaggttgcagcgagtcaggatcgcagcactacactccagcctgggtgacagtgagactccatctcaaaaaaaaaaaaaaaaaaaaaaaaaaaaaaaattaaaaaattaaattaaaagcgggctgggcgcattggttcagggccgggcacggtggctcaagcctgtaatcccagcactttgggaggccgaggcaggcggatcacgaggtcaggagatcaagaccatcctggctaatgtggtgaaaccccgtctctactaacaatacaaaaattagctggatgtggtggcaggtgcctgtaatcccagctattccagaggctgaggcaggagaatcacttgaacctgggaggcagaggtttcagtgagtccagatcatgccactgcactccagcctgggtgacagagcgagattctatctcaaaaaaaaaaaaaaaaaagcaacagaagcaaatgagagtgcctgggagtggtcattgtggggccttcccgtttgtgtgacccaggtcatgtccctccctaagccctggtctctcttgcctcctgcagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggtaatggtggtttgggacttgcgtaagggaggtcttttgcccccatctggtagccctggcttcagcaggagcccaggacaggtgaacgggcaggtgtggtcctctgagctttctgatgtttcccacccttggtgggaggcccagattttttatttatttatttatttatttatttatttatttatttatttgtttgtttttgtgatggtctcactctgtcacccaggctggaatgcaatggcctgatcacagctcactgcagctttgagctgcaatcctcctaccttggcctcctgagtagctgggactacaggcacatgccaccatgcctggctaattaaaaaaattttttttgtaggccgggcatggtggctcacacctgtaatcccagcacttcgggaggctgacgcgggcggatcactttaggccaggagttggagaccagcctggccaacatggtgaaaccccgtctctactaaaatatgaaaatttgcagggcatgatggtgcacgtctgtaatcccagctactcgggaggctgaggcaggggaattgcttgaacccaggaggcaggggctgcggtgaattgagatcatgccgcagcactctatcctgggtgacagagtgagactgtctcaaaaaaaaaaaaactcctttttatagagttggggtcttactaggttgcccaggctggtcttgaactcctggactcaggtgatcctcctgccttagcctcccaaagtgtagggattccaggcatgagccacctcgtctggtcaaggagaaggcctgattttgaagggcaggtcccagggtcagccagtgaagggcagagcctctggttgctgcttctctgcaggcccagtggcgacttctggggtgcatgcacgaggggtcttcctgctgtagggcaggccagatggggctcaggctgtcggggcgctcacacctggcgctttggctgtcgtaggtgcggctgactgcacagaagtcactggggcctttgacttctacacactccctgtggggctccgcactgtgcccgtcaccgagagccagtgggtgagagccagtttcatttgcggtagaggcagcagaggttgtagaaatgctccttgaggcagatgccacaccccaatttcatggagtgatttgggctgagccgagtctgcagcaggcagaaggctctgagatgttgtcctagcctgggcaaaggacagttcagagctcgggggaataggggtgtgctcagcacgactgggtggacaggccgtttgttgtgaatcgtacaggcttccaggagcgggtgcctgaggcttccagacaggctttgggaggtggccagaggagatgcctgtttccggggcaggaaatggagggagggcccaggctggagaggttcagccaggctgtcacaaggctttgaagcttcccatctgagagcctggctattggagagtgtgggtttggaacttgaggctaggaggttctattctgtcctgtgccagccacagccttcggatgggcagagcaatgatggggggaagatgtaaaagaaaagaactgaggaaagaagaagaaaaccagcttcaacaacggtctaggccggatgcggtgggtcacgcctgtaatcccagcagtttgggaggctgaggtgggtggatcacccgaggtcaggagttcgagaccagcctggtcaacaggtagtgaatcctgtctctactaaaaatacaaaaattagctgggcatggtggtggacgtctgtaatgccagctaccaggtaggctgaggcaggagaatcgcctcaggtgaaccaggaggcagagattgcaatgagctgagataatgccactgcattccagcctgggctacagaatgagactctgtatctcaacaaaacaaaacaaaacaaaaacacaacagtctgttctgtggaggccttgggcagatgctgggagctctgagcacggactggtccctctgttgggagcctcttcccttcatccctcctggttaacttgactcagcataaaggccatttcttctaagagcctgtccctgactctccaatcggggatgtgtctgttgtctcatagagtgcccaattcctgccaccacttgtcatttccattcgcaacatttctttcattgtttgtttttcagagtcagggtctcactctgttgcccaggctggagtgcagtggtgcaatcatagctcgttgccatctcgacctcctgggcttaagcgatcctccccactcagcctcccaaatagctgggaccacagacgtgcgctgccttgccaggctaaattttaatatttttttttccccacgagtcagagtcttgctctgtctcccaggctggagagcagtgttgcggtcttggctcactgcgtcctctacctcctgggtacaaacagttctcctgcctcaccctcccgagtagctgggattacaggctcacgccaccatgcccagctagttttcttctttattttttgttgagatggggtttcaccatgttggccaggctggtctcgaactcttgagctcgtgatccacctgccttggcctcccaaagtgctcacaggcttgagccaccatgcccggccctaatttttaaatttgttgtagaaacaaggtcttgctatgttgtccaggctggtctcaagcgcctggtctcaagtaagcctcccaaagtgctggggttctaggcttgagccacctcgcctggcacttgcaccgtttttctgtgcatgcatctccactcccactgcccaggacctgtggacttagatttgagtcattactgagcacctagcacccagcctcatgcctacctcccacctcgcactacctgtttgcttgatgcattaataaatattccacctgaatccacagcccattcactcctgtgttcaagagctatttcaggaagtgaacctcatttctggcagtgttcagtccagtgacctcagctctgtgtacccggcagggtggctacgcctctgggggagttggattcaggggtgggggagaaagagtgttgttagagagctcggtctaggactagaggaacgtgcccttatgtaaaatacatctcaagttagggaagaaagcagcggctctgtgctttgtttttttttttttttttcttttctttctttcttttttttttttttgtttgtttgtttgtttgtttgttttggggcagggtcttgctctgtggcccaggctggagtgcagtagcgtgatttcggctcactgcaacctccacctcccgggttcaagcaattcttgtgcctcagcctcccgagtagctggagttacagatgcgtgccactaagcctggctaatttttgtatatttagtagaaatggggttttgccatgttggccaggctgttcttgaacccctgacctcagtgatctgcctgcctcagcctcctgaagtgctgggattacaggcgtgagccatcgtgcctggcccccagttgtgttctggcaggggaagatgggacagagaggatgggagggtgtctgagcctttcccggactgacggaacctgtgtcttctctcttttgtggacaggatggtgattgctcacaccaaagccttggacccctcccagcctgtgacctttgtgaccaactccacctacgcagcagacaagggggtgagcctgggggtccccaccccatttctccctgcctttgcctgggcttgtcctgaagcctgctcatgggaacagctggaaagaaccatgtgctgccagtctgagctttttattttgttttacttagaaagatagagacagggtcttgccatgttgcccaggctggtctcgaactcctgggctcaagtgatcctcctgcctcggccttccaaagggctggggttacaggcgtgtgccaccgcactcagccgcagccagtctgttttcaaagatggtctttgggttaatgacaattctctctctgcttactctccaggcagtgtggctttctgaatccaaggaggctgggcatagggagatgggatttgtttgcccggtttggactcagcattttttgtactcgatttaatagactcataaaatgtcaaaggtttaagtgagcttagagttgatctggcccaaacctggctgatcagaatctccaggggaagttttattgaaatgccagatctctgcgttctgagatcctgatttagtaactccagggttggaacctgagttttttgtttttttgtgtgtgtgtgtgaaggcaaggtcttactctgttgctctggctggagtgcagtggtgtgatcacagctcactgcagccttgaattcctgggcctaagcaaccctcttgcctcagccttccaagtagctgggactccgggggtacaccactgtgcccggctaattttaaatgtttttgtagagatgggatctcactatgttgcccaggccagtctcaaactcttgagctcaagtgatcctcctgccttagcctcctaaagtgctgggattacaggcatgagccaccgtgcctggctgatactagcattcttttttattttttattatttttttaagatagagtcttgctctgttgcccaggctggagtgcagtggcacagtctcagctcagtgcaacctccgcctcccaggttcaagcaattctcctgcctcagcctcccaagtagctgggataacaggcacatgccaccacgcctgcgcttgatcgtgggaggcagagcttgcattattgtgccactccattctagcctgggcaacagagcgagactctgtcttccaaacaaagcggaaaaagattatctgcgagaatgactgcattggccccttgggtgggagggcttctccagggcaaggtgaggggatgcccagtgctgggagtgctgcctggagaggagtcagttccagtggcgggggccctgggttttggctgaggactgcgtgttggcagctgctctgcctctcacagcccttcccagctgcacacgtcgtgagcgtcagtgtgcaatcacaggcctgcctcctttgggccactttgtgaccatgttttttgcttgtggggcagggtaatttcaggatctaaattggtgcagttggatgttctcagccccgagaggcagctcttcccgttctaggctttttgttttgttttgtagaaatggagtcctacgacgttgcccaggctggtctcaaactcctgggctcaagtgatcctcccaccttggcctcccaatgtgctgggattacaggcatgagccactgtgccgtgctgattttcttgatactattttttgtagagctggggtcttgctgtgttgcccaggctggtctcgaactcctggccacaagccaccctcctgcctcagcctcccagagtgctgggattacatccccttcttaccttctctgtcagaggagcccccacagcatgtgagtactgagtcatgcggtcttgtggttgctgaacgggctctgctgctctggtcctaggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggcttcaccaggtaagcggtgttgaactttctgcttgtgtattctctctgggcagagatgccacttgcctcccccaccatgccatctctgaagaatattacagaccattttggagcatggtgaataagaaattttcaccttaggagttcagttgaatagtcatttttatatttgtgactgcaagtcactcttaggggctgtacttccttagtactggtagcattattatccaatggacttttatagctttcattaggttttcttttgtttttgttctttaaagaacgttttacttatcttagtatttcatttttcatctatattatgaggcagtaagagtcttctgtttttccaaagttgagactgctttatatttatttcgtattgtctacagctgtagtgttcaatacattagccactagccacatgtggttatttaaataagataaaataaaaattggccgggcgtggtggctcacgccggtaatcccagcactttgggaggccgaggcgggcagatcattaggtcaggagatcgagaccatccttactaagacggtgaacccccatctctattaaaaatacaaaaaattagccgggcgtggtggcgggcgcctgcagtcccagctactcaggaggctgaggcaggagaatggcgtgaacctgggaggcagagtttgcagtgagccgagatggcgccactgcactccagcctgggggacagagcgagactccatctcaaaaaaaaaaagaaaattaaaaattaagttctttagttgcactagccatatttcaaatacttgatggatacatgtggctagtggctaacataagggatagcacagatataaaacatttcctcgtcatataaagttctattggatagtgctggtctgtagcttataggatggtatcttagtctgcttcagctgctaaaacagaataccataaattaggtagcttaaacagtagatattttgaccaggcgtggtggcttatgcctgtattcctaacactttgggaggccgaggcaggtggataacttgagctcaggagtttgagactagcctgggcagcatggcaaaaccttgtctctacgaaaattagctgggcgtggtggtgcacgcctgtagtctgagctacttgggaggctgaggtgggagaattgcttgaacctgggaggcggaggttgcagtgagccatgatcgcaccactgtactccagcctggatgacagaatgagactctgtctcaaaaaaaacaaaaacaaacaaacaaaaaaaaacagatatttctcacagttctgcagactggaagtgcaagatcaaagtgttggcaaattatgtttcttaaagagggcctgcttcctagattggaaatggccatcttctctcggtatcctcacatggcagggagaaaagcagctctagtgtctcttcttataaaggaagtaatgccaccataggggctctattctcatgacctcatctaaacctaattctctcctaaaggccacgcctcccagtatcctcaccttgggggttagggctttatcatatgaatttttttttttttttttttttttgagacagagtctcgctctgtctgtcacccaggctggagtgcagtggcacaatctcggctctctacaagctccgcctcctgggttcacgccattctcctgcgtcagcctcctcagtagctgggactaaggcgcccgccactgcgcccggctaattttttgtattttcagtagagacggggttttaccatgttagccaggatgatctcgatctcctgacctcatgatccacccgcctcggcctccgaaagtgctgggattacaggcatgagccaccgcgccgggcctatcatatgaattttgagggaacacaaacatgcagtctgtagcagatggtaataggctgacatattacacttgttgatgtaaatctgataggtttctttctctccaaggacagctttttaaatatttaacagtatcaataatttttcaggttctgtgagaattttataatttataatttgcagacttaatgtataatctattttgtcctaacaattacaaatatattttttatttcagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaacggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattcctatatagctactgcatgaagaagagttcttagtgaggcctgggtgaacagctcttcttagtattctgtgtgaccccatttgaccttttaacaaatccctaagtaaataaatagcccctcaggaaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatacaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacatgggagctgtagaggagacctctgcagcagatgctaggggggccagtaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcagtgttgatgcggggcctagaggcctgggatctgggggagccacccctgggggcaagtgtctgccctggtgctgtacctgccttcttctcacagcgggtgtgacccgaagagacagcctgaggtccgtcctcactcactgtgtttgaggaactgtgggccagctggcagtaggatgaggctggccccctcctccgctttagttgcgggaggccttccgtagagctgtgggagctggagctggcatttccttggaggcaggatctggtccgggaggtctgggatctctggttatatctcacttctgacctctggacacgtgctgcagctgtggctgaggccaagaaatgtgaggggcctccatccactgcattgagtagtgaccccgacgtggggttcaatgtggaggggggaggggctgctgctgcagctgcaggagccgaggtgccaggccttgttcttctcatgccggcatcgctgcttgcagctgtgaagggcgcgggaatcagcgaggtgacctgggctgagtcccgtgagtgggaagaggtggcaggaaggggatctgaggaggagaacaggggtcctggtggtctgtgcttcttcccagacacgggagctgtagaggggacttctgcagcagatgctaggggggccagtaggcccaggcagtcttgggacttgggtctgtgctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcggggcctagaggcctgggatctgggggagccacccctgggggcgagtgtctgccctggtgctgtacctgccttgttttcacagcggtgacccgaagagacagcctgaggtccgtcctcactcactgtgtttgaggaactgtgggccagctggcagtgggatgaggctggccccctcctccgctttacttcctggaggccttccgtagagctgtgggagctggagctggcatttcgtttgaggcaggatctggtccgggaggtctgggatctctggttatatctcacttctgacctctgggcacgtgctgcagctgtggctgaggccaagaaatgtgaggggcctccatccactgcattgagtagcgaccccgacgtggggttcaatgtggaggggggaagggctgctgcggcagctgcaggagccgaggtgccaggccttgttcttctcatgccggcatccctgcttgcagctgtgaaggtggcaggaatcagcgaggtgacctgggctgagtcccgggagtgggaagaggtggcaggaaggggatctgaggaggagaacaggggtcctggtggtctgtgcttcttcccagacacgggagctgtagaggggacctcttcagcagatgctaggggggccactaggcccaggcagtcttgggacttgggtctgtcctgctgtgcgtccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgtggggcctagaggcctgggatctgggggagcctcccctgggggcgagtgtctgccctggtgctgtacctgccttgttttcacagcggtgacccgaagagacagcctgaggtccgtcctcactcactgtgtttggggaactgtgggccagctggcagtgggatgaggctggccccctcctccgctttagttcctggaggccttccgtagagctgtgggagctggagctggagctggcatttcgtttgaggcaggatctggtccgggaggtctgggatctctggttatatctcacttctgacctctgggcacgtgctgcagctgtggctgaggccaagaaatgtgaggggcctccatccactgcattgagtagtgaccccgacgtgttgttcaatgtggaggggggaggggctgctgcggcagctgcaggagccgaccttgttcttctcatgccggcatccctgcttgcagctgtgaaggtggcaggaatcagcgaggtgacctgggctgagtcccgggagtgggaagaggtggcaggaaggggatctgaggaggagaacaggggtcctggtggtctgtgcttcttcccagacacgggagctgtagaggggacctctgcagcagatgctaggggggccactaggcccaggcagtcttgggacttgggtctgtcctgctgtgcgtccatagtgggtgctttagaaacgggaggcccacccgaagcctctgttgcaagtgaggacaaagtgtgggaaggtcgtgagggtctgcagtccgagatggccttgtcctcaacgtgcagtgcagtgttgatgtggggcctagaggcctgggatctgggggagccacccctgggggcaagtgtctgccctggtgctgtacctgccttgttttcacagcggtgacccgaagagacagcctgaggtccatcctcactcactgtgtttgaggaactgtgggccagctggcagtgggatgaggctggccccctcctccgctttacttcctggaggccttccgtagagctgtgggagctggagctggcatttcgtttgaggcacgatctggtccgggaggtctgggatctctggttatatctcacttctgacctctggacacgtgctgcagctgtggctgaggccaagaaatgtgaggggcctccatccactgcattgagtagtgaccccgacgtggggttcaatgtggaggggggaggggctgctgcggcagctgcaggagccgaccttgttcttctcatgccggcatccctgcttgcagctgtcaaggggacaggaatcatcgaggtgacctgggctgagtcccgggagtgggaagagttggccggaaggggatctgaggaggagaacaggggtcctggtggtctgtgcttcttcccagacacgggagctgtagcggggacctctgctgcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcgctggaatgccttctctttttccaggtgcaggtcttcagccgtgacccggtaccccagctctaagggaggtggcagcatcaaaggctcccctcgcctgcgtggcagcaggggaatcttgcgtctacggggcctagagtcctgggatctgggggagccacccgttggggcgattgtctgccctggtgctgtatctgcccccttttcacaccgtgtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtgtggttatatctgatttctgagctctgggcgtggaggtctgtctgcagaggcccgggcctgggcacaaagggagaggggcctccattgtcccgcaggggccaaaatgcagaccgtgcatccccggtgacctcggggaccgttctctgatcatcaggattttcttggactctggggtccttgtgctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcagagcacacagcactggcttactgtggtacctgtgcagtgaagttgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaaaaagaaaaaaaagaggccgggtgtggtggcttatgcctatgatcctagcactttgggaggtcggggtggacggatcacgagatcaggagttggaggccagcctggccaacatagtgaaagcccgtctctagtaaaaatacaaaatttagtcagacatggtgggcaggagagagcatgtgcaggggaacatccatttataaaaccatcagacctcatgagacttattcactaccatgagaacagcatgggggaaactgcctccatgattcagttatctccacctggccccacccttgacacatgggaattgttacaattcaagatgagatttgggtgcggacagagccaaaccatataattcttccccggcccctcccaaatctcatgtcctcatatttcaaaagcaatcgtgccttcccctaagtcccccaaactcttatttcagcattaactcaaaattccatagtccaaagtctcatctgagacaaggcaagtcccttccacctatgagcctgtaaaatcaaaagcaagttagttattttctagatacacagggatacaggcattgggtagatacactcgtttcaaatgggagaaattggccaaagcgaaagagctacaggccccatgcaagtccaaaacccagcaggcaaatcttaaagctccaaaatgacctcctttgactccatgtgtcacatctaggtgatgcaagaagtgggttcccagggtcttgggcagccccgcccctgtggctttgcagggtacagccccccttctggctgcattgagtgtctgcagcttttctaggcacacagtgcaagctgtcagtggatctaccattctggggtctggaggatggtggcccttttctcacagctctgcttggcagtaccccagtggggactctgtgtggaagctccaaccccatatttccctttgacactgccctagcagaggttatccatgagggcccccccctcccctcccccccacagcaaacttttgcctggatttccaggcattttcatacatcttctgaaatgtaggcggaggttcatgaacgttaattcttgacttcggtgcatctgcaggcttaacaccacctagaacctgaaaggcttggaacttgcaccctctgaagccatggcctgaggtgtaccttgtccccttttacctatggcaggagcagctgggatgcagggccccaagttcctaggctgcacacagcagggggttctggacccacaaaaccatttttccttctaagcctcctggcctgcgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaaattttatgctctgcttcttctcgaatgctttgctgcttagaaatttcttctgtcagataccttaaatcatctctctcaagttcaaagttccacagatctctaggcccagaaaaaaaaaattagcctggcatggtggcatgtgcctgtagtcccagctactcaggagtctgaggtgggaggattgcttgagcctgggaagtccaggctgcagtgagtcaagactgcaccactgcactgcagcgtaggcaacagagcgagtctgtctcataaacaaataaaaaataaaataaaagaccccactgtgttgttgcctataacaattcactttaaggctgggtgcagtggctcatgcctgtaatctcaacacttagggtggcagaggtgggaggacagcttgagcccaggagtttgagatctgcctgggcaacatagtgagaccccgttacccacaaaaaggaaaaggaaaaaacaagaattgactttaaatatagtcacagatagattaaaaagaaaataatctaaaagatgtaacatgaaaaaactaataaaggcctaaaaaatactatcaaggataaagagggatatttctgttttttagagacaaagttttactctgtcacccaggccacagtacagtggcacaatcatagctcattgcaacctatactcctgagctcaagcgattctcctgcctctgcctcccaggtagctgggactacagatgcatgctaccacaccctgtttgttttaaaaattttttgtagaaatggagtctagctatgttgcaaaggctagtctcaaactcctcgccttgtgcactcctcccacctcagcctcccaaagtgctgggattataggtgtgaaccaccatgcctgcttgggatatttaatatattctctggaatatgaaagaccaaagggcaaaaaaatagctaagacacactcttgaagagaaagaacaagactattctgcaggaaaatatgaaaataagctcaactgccgggcgcggtggctcacacctgtaatcccagcactttgggaggctgaggtgggtggatcacctgaggttgggagtccgagaccagcctgaccaacatggagaaaccccatctctactaaaaatacaaaattagctgggcgtggtggcacatgcctgtaatcccagctactcgggaggctgaggcaggagaatcacttgaacctgggaggcggaggttgtggtgagccgagatcgtgccattgcactccagcctgggcaacaagagtgaaactccgtctcaaaaaaaaaaaaaagaaagaaaaaaagaagaagaaaataagcttaacattattagtaattacactgacaaaaattaaaatttgggcaataccaagttagtgaggaagcaaatcaatagcaacgcatctaggccaatgggaatgtaaatcagtgcaaccacttgggaaaaagctttgcattatctagtggagttgaacacccgcaaagttctatgactctgcaattctttactttgttatgtatcctagagaaacacacatgagcactggaaaatatgtacaagaatgttcatagggcattatttgaatttgcaacactctgaaaacgacccacgaggttaatcaacagtaaaataagttattatatattcataaaataatacactatttaccaatgaaaacaagtgaactacaactgtgtagtacatataaatatggatgaatctcaaaaacatcgtggagtaaaaccagccaattacaagaagaatcatgcagtatgcttcttatttgaacttcaagaatagacaaagctaaatatgtttaaggatgtatatgtagttcgtaaaaccacaaagagaagcaagggaataattaacccaaactgagcatcacatttacctctggattggagggacagggatataatcagaattagggggtggttggcatgcagagttgtttttttttttattttttttttttgagacagagtcacgctctgtcgcccaggagtgcaatggcgccatcttggctcactgcaacttccgcctcccaggttcaagccattctcctgcctcagcctccctaatagctgggactacaggtgtgtgtcaccaggcccggttaaatttttctgctttttaacagagatggggtttcaccatgttgcccaggctggtctcgaactcttgagctcagacaatctgcccacatcggcctcccaaagtgctgagattacaggcgtgagtcactgcacccggccgcaggggtcttttaaggcattgataatgtccaatttcttgactttactaggaggttcataggttgctttttattcattctttaaagcatacataaaaattttaggtaatcatttggagacatactggtttgcagtttttttaagaggcaaaggaagagtaaaaatccaaaaaggagttggctgggagcagtggctcatgcctgtaatccaagtactttgggaggctgaagcagaaggatcatttggagccaggagtttgagaccagcctgggcaacaaagcaagaccccatctctacaaaaaaaaactttaaaaaattagtcgggcatggtgacacatgcttgtagtcctagctacttgggaggctgaggtgggaggatcacttgagcccaggaatttgaggctacagtcagctaggattgtaccactgcacttgctccagcctgggtgacagagccgagacccagtctcttaacaaaaaaacactaaaggccaggtgtggcggctcacacctgtaatcccagcactttgggaggctgaggcaggaggatcacttgaggtcaggagttcaagaccagcctggccaacatggtgaaaccccgtctctactaaaagtacaaaaaattagccaggcatggtggggaggtacctgtaatcccagctacttgggaggctgaggcaggagaatcgcttgaacccgggaggcggaggttgcagtgagccgagatcacgccactgcactccagcctgggtgacagagtgagactccatctcaaaaacaacaacaacaaaacactaaaactaataataataataatagtataaaagggagttgatcgattccagagtaagttctaaataagactagactgcatcctagcttatccttccaagaattaagtagaatgtccccattgttctcaataatttattatacactaagcccaaataagaaagaaaaatgaggtaactactgctatcaaaataccttcaaggcaataaaattagatagaagtattcattttgttttatttttgtttttaccactatacaaatgagcaggaagcattcattttaaaatctgtatgtgttcatattcatttctaaaaaaaaaaactcttactaattacatagtgaaaacacaaatttcttcttgcaattaaacatttctaaagagtttgatgggtaaaaaaaattaagtttaaagattcatagaaaagaaatatttcttcgtaaaattttagaacagatatttttctgaaagcttccagcacaggaaaaaaaaaaattttgtttgcagtaaaaggattgacaagcagaaaggcatggaacttctcgacagcacattaggaaccagtagaaatgtagcagtgcctctacaatttagaattaaaatgacttccaacctataattctacacctagctaaactatcaaataagtgtgagaatacaggaaaaacatatatctagatagatctatatgtctgtatatgcattatatgcaactaaaagtgtgtatttcttatgcagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaagcatagtggtgcatgcctgtagtcccagctacttgggatgctgaggcaggaagaattgcttgaacctgggaggcagagtctacagtgagccgagatcatgccactgcactccagcctgggcaacacagtgagactccatctcaaaaaaaaaaaaaaaaaaattaagcagatggctataatttttttaaaaatagaaaagtgttgatgagaaatgggaaacctcatacattgttggtcaaactgtatgcttccatttagaggaaatagtcagaacaaataaatccatagacaccaattaggttggtgtatcccaggggctgggcatggagtggggtggagagagaaggagggcctgcttagtggatacagagttttctttgggggcgatgaaagtgttttggaactagatagagggggtggttgcacaacattgttgttggtgggaatttaaaatggtgcaagcactgtggaaaaaacagtttagcatttcctcaaaaagttaaaacaggccaggcgctgtggctcacgcttgtaattccagcactttgggaggccaagccaggtggatcacttgaggtcaggagtttgagaccagcctagccaacatggtgaaaccctaaaaatacaaaaaattagccgggcatggtggcagacacctgtaatcccagctactcaggagactgaggcaggaaaattgcttgaacctgggaggcggaggttgcagtgagctgagatcgcaccgctgcactccagcctgagtgacagagtgagactctgtgtgagaaaaaaaaaaaaaaagtaaaaacatagaattactatacagctagcaatatcgttgttaggtatatgccccagagacttgaatacagttacatgctccatcagatacctgtacccaaatgttcctatcggtattactcatggtagccaaaaggtagaaacaacccaaatatctacaaatagatgaatggataaataaaatgcagtgtatccatatggaatattacttggtctcaaaaggaaagaagtacttatgcaagctacaacatggataaacttcaaaacaatatgccaagtgaaagaatccaaatgcaaaaggtcaaacggtatgcttccatttagaggaaatagtcagaacaaataaatccatagacaccaattaggttggtgtatcccaggggctgggcatggagtggggtggagagaggaggggggcctgcttgatggatacagagtttcctttgggggcgatgaaagtgttttggaactagatagagggggtggttgcacaacattgtgaatgtactataataaatgccacagaattgtgtactctaaaatggtttaattgctgtgcatggtggctcacgcctataatcccagcactttgggaagccaggatgggaagactgcttgagcctagaagtctgagagcagcctgggcaacatagagagaccctgtctcttaaaaaaaaaaaaaaaaaattagctgggtgtgaagacatgtgcctgtagtcccagctacttgggaggctgagcgaggaagattgcttgagccagagaggtcaaggctgcagtgagccatgattgcaccactgcactccaacctgggcaagagagagaacctgtcacaaaaaataataaataaataaataaaatggttactacctgaattttacctcaggaaaaaaaaataagctaacataccaacaggacagttattacttcctaaaaaaataaaaggatatacaggaagggaaaaataaataaaaatttaccacaagcttcagctccacatagcatttgtatagtcatgataatgtaaacatgtaatgtgaatatatgaatctagccaaaactatgccataactataaagaggggaaggctagtacaggaagggggtcatggagcaaagggatgaaagacatgaagactcatccttcatagcctgaatccgaggagtggataaagactcaatctaaagataaaataaggcaggaaatgaggaaaaagaaaaaaactgttgaagtgcatccaaagttgcagatggttaacattcattccactcacttgggaaaacatctggtgtgatcgtctaatgggtcatcaccttcctgccatttctctaaacaccctccacaggaaaagcactggacgatgtcctttatacctaaaagtaaggaaacttgatcagtgccactggcatgggcatctgtccattaacatgcagataataaccaccagacctgtaatagtgaaagcctattcagtctccagttgggttttgtgacagtcagaagttggttaccagtgaggcaattttctatataagactctgtccaccaatggggtaactggcaagtagtcattgaatgctcctacacaccatgcactttgatgcacaccatccctctgccccattctcctttgatcaacaaacagattggcaaccagaatctggaattgaagctccatgagggggctgggcgcagtggctcatgcctgtaatcccagcactttgggaggccaaggccagcggatctcctgaggtcaggagtctgagaccagcctggccaacacggtgaaaccctgtctctactaaaaatacaaaaattagctgggcatggtggcacatgcctgtaatgccagctactcaggaggctgaggcacaagaatcgcttgaacccaggagacggaggttgcagtgaaccaagataacgccattgcactccagcctgggcaacaagagtgaaactctgtctcaaaaaataaaaataaaaataagctctatgagggtagaggtttttgctcactaatgaatgacatgaacctagaaaagtgcttgacactcatgtggcactcaattagtattcgtttaatgaatgaatcagaaagaatatatttagagctcacggaaaaaaaaataccagcaaatctagcagcccttatgtaagtgaatgcatgaagaattaattgcctcttaccacattattgccatgtttattacaccagaaataggattaagtctctttgtgaaattatatttctttggaaagaaattggtatttagctctgcaaaaggatcaaactagaaacagagcatttctcatcttccttccactctgggaaagctggggcagaggaaagcctcccagaaatatgagatcctagagcttgcaagatctgaaaacagtcagagatgattaggatttgtgtggagtggtggaggattggaaaggaagagggggagcacactggtcagaggggtcttgcggaaggctgacaagaggaagacacagtagagtagggagaaatggcaaacactctttccaaaggcttaagattgtgaggcagtcagattttttttttccaatggcacatgtctgttaggtagagtgacaactatattctgcttctctgtgttgctctatggtatttgtgacaactacttgatctctcagttaaagatctgcattaacctccactgtaacttatgcatgtgttcggtttgagcaagaccagcaaggtacctaggaacctttccctgatcatcttgtatttcaggcagagatttagctgacaggaaccagcccatcatttatagattgcagaggtgcttcctaatgaccagcagctaaagagaaaatgccacaatctggtggaaggctctacgtgtttaggaatcatgaaaattaatttcctgattttctcctgcaggcagaatgtggcaaagattgctatccatgttcctattatctcaaatccttccatactaatagaaatcccaatatttagctgggcacattgtcacccaggaaaaagattaggtttcccagctcctcttacagctaggtatggtcatctgactaataataataataataattattattattattattattattattattattattattatttttgagacagagtttcactcttgttgcccaggctggagtgcaatagcatgatcttgactccccgcaacctccacgtcccaggttcaagcgattctcctgcctcagcctcccaagtagctgggattacaggcacccgccaccatgcctggctaattctttgtatttttagtagagacagagtttcaccatattggccaggctggtctcaaactcctgacctcaggtgatccacccacctcggcctcccaaagtgctgggattacaggcgtgagccaccatgcccggcccatccaactaagttctgattaaagaaatataagcagaagtgtcctgtgacagtttctaggagcactttgtcaggggacaagaggtgaggagagtaatgtgtagaaagaaaagacatgataattatcacaaatagaatacttgtattcattgttagtccagaccttaaggtttcaaatttgaaggtttaccacctaagggaggaatagaaaactgggagaggatttatgatgcaggaaagaaaagagatgtatgccaggtgcagtggctcacacctgtaatcccagcattttgggaggccaaggcaggaggattacttgagcccaggaggttgaggctgcagtgagccatgatctcgccactgccctccagcctggatgaccatgtctcaaaaaaaatagaaagaaaagaaaacgaatctataagaaatgctgaagagaggcctggcgcgatggctcacacctgtaatcccagcatttgggaggccaaggcgggcagatcacgagatcaggagatcaagagcattctgactagcatggtgaaaccctgtctctactaaaaatacaaaaaagtagctgggcgtggtggcaggcgcctgtggttccagctactccagaggctgaggaaggagaatctcttgaacccgggaggtggaggttgcagtgagccaagatctgcattccagcctgggcaactctgtctccaagggggaaaaaaaaagaaaagaaaaagaaacgctgaagctagtggacattgctgagtgtagctaaacgtaagcccaggagcataaagtctatgtgggaattaaaggtcaagcaagcaagtgggcacaacctactgactcacctgtgtagaaaagacctgctttggccagtgctgcaactcccacagctgattcccggggccagtccttaaaagagtccagccgtagttcttcgtaagcaaagatgctgtcattgcaataagcttgaataaaaagcacaaggtgagaccagcaggctttagtcttttttttttctatatctttattgctgctgcacaaattaaagagaccagtaggctttgatattgcaagtatcagcgttcaagttgtcccttcacagttacagatggaatgatgtctagagtttgcttcaaaataaacggggcggggcgggggggacgacaaaaagagatagggacaaaaaatcaaaagaagaaataaacaagcaaagcctttggaaaatgtttgagtttttacctgatgccataggtaattctctctggacccaggaattcacaaaatgttctccctgagggaaattaaaattcaagttgttgattatctgactttttttttttttttttttttgaggcagagtctcactctgttgcccaggctgaagtgcagtggcaggttctcgtctcactgcaacctccgcctcctgggttcaagtgattctcctgcctcagcctcccgagtagtacaggcatgtgccaccacacccggctaattttttttttttttgtatttttagtagagacagacacgatgttggaggtctttttttttttttttttttttttttttgagacagagtctcgctctgtcgtccaggctggagcacagtggcacgaccttggctcactacaagctctgcctcccaggttcacgccattctcctgcctcagcctcccgagtagctgggaccacaggcgcctgccaccatgccgggctaattttttttttttttgtatttttagtagagatggggtttcaccatgttagccaggatggtctctatctcctgacctcatcatccgtccgtctcggcctcccaaagtgctgggattacagacgtgagccactgcacccggcccatgttggaggtcttgaggctggtctcgaacacctgatctcaagtgatctgcccagctcggcctcccaaagggctgggattacaggcatgagctactgcgcccagcctgattgtttgacttatgaagtatatacctatctatgaacaagaactgaaggaactttaccccagaatgaagagtttcactggatggaacggcagagtcggaggagaattattcctttaatttttatttctgttgatgttgcaattgtttttatgcagtgcaagcaaacatacacacacacacacacacacacacacacacacacgcatgcaagctgtgaatgtttatgcatactcaggaggaagccttctcagggtcactgtttccggaaactgaccttgaaaacagacctgcatttaaatatcacagatgtactttgacgaatgaggaagtaagagacatagaatggtaactaaattcatcagggtattatatattgagcaactgattcttctgggaaagctgcacccagtttctttttgaggaaacacctctcttcccccactgtcaggccatgttctctatagagttctggtctcctgagtcatgttaatcaataaattctcatttttgtttaagccagtttggattcgatttcccatcactctccactaggaaatttttactgattcaggatagttagccagctaggaagagccagctctgcagcccactgtgggtgacagcgcctaggtcaggagatcttagcaagcctgcagataggggcagcagagggaagctggggcaagtggcttcattcataaaggggaagactatcaggaaggcaagcagagcccgtcagaagccagacctggaaaaagaaaaaggctctaggtcagcaagtgaatgtgatatttttcactttgaagatgggagccaggggaatgaaaggagaaaggaagaaagaaatcaaacccatgacataaaaagaatgcctatgcccttctgagtcagacacttacaggtaatccaaaaacttgagaaaaaaattgctgttatacattaccgttatgtcaacaaatcccttgtagctttgaatatactgggtaatttcctctgaggatttcttactccgaagaaattcacatctgtaattaataaatataattaaaatttaccccagtactgtgatagagctgtcctatatcacaatgaacatttataaagacgtattgaattgttgaattttattatacttcaataaaattgccaaaaaatttaccacaaaacttaggagaattaccattattctcatataattatttgttatttctattagtgacaacatgtgtagttatttaaaattaaatcttcaggttaacttttttcttgaaataaaacatgcaatacaatcaaagagactgatttacagtaaatataggatggagcttttgttttttggaattaagcagtggtgactaaatctagtcgctagggttatatgaaagctactggcagtaaagagaactatatttaaaataataggccagacgcagtggctcacatccaggagttcaagactagcctgggcaacatggcaaaaccccatctccacaaaaaatacaaaaattagccgggcatggtgccacacctctgtagtcccagctactcaggaggctgaagggggaggatcacctgagcccggggaggtagaggctgcactgagccatgatcaggctgctacactccagcctgggcaacagactgagacccagtctcaaaagtaaatacaaaaaatctttttaagataacaatatatttatctactgaacaaaaaattaccatgcattaaaaagtaatggctattaggccaggcgtgatggctcacgcctggaatcccagcactttgggaggccgagacaggtggatcacgaggtcaggagttcgagaccagcctggccaagatggtgaaaccctgtctctactaaaagtacaaaaattagctgggtgtggtggcgggcgcctgtaatcccagctacttgggaggctgaggcaggagaatcgcttgaacctgggaggtggaggttgcagtgagctgaaatcatgccactgcactctagcctgggcaacagagcaagactcaatctcaaaaaaaaccaaaaacaaaaaaagtaacggatgttaatggataatttttgatttttttaaaaaagagcacactgaataccatttaaaaacatattcctttcccataaaagagaagcagttttaaaattaacttttaaaatttcctccaattcagctgggcatgggggatcatgcctgtaatcccagcacttttggaggctgaggcgggtggatcacttgaggcctggagtttgagaccagcctggtcaacatggtgaaaccccatctctactgaaaatacaaaaattagccaggcatggtggcgggcgcctgtaatcccagctgcttgggaggctgaggcgggaggatcacttgaacctgggaagcagagtttgcagtgagtcatgattgtaccactacactccagcctgggcaacagagagagactctgtctcaaaaaaaataaaaataaaaataaaaatccctccaattcaaatttaagttttctttctatggtgctgtagcaaagaatgggctgggaacccaaaggctggagcattagtacccgctcttccaccagtggggatgtgaccaaccttgccatgttctcttataatcacaggagaacatggatgccatcagatgatctgcatatttccccagggccatgattctatgtgataggcagccagggtccccagttttcaggtgtataaatgtttccaaggattgccgtaagtctgcacataacctacatggcacacaatgcacggggtggttccctgtcctcatgatttatatggattgaggaggaactcagtaccttaaaaagttaccataaaatcatcttacatttatggagtgccacattttaaaaagtgtaagggtatactcattttgttgacagttgataaaaagaagcaacaaattgaagtccagaaagctaaagacagagtaacccaacaagaaacttggggattcttgctctaattccagctcttagattttattgactgaccatgtgcttatgacgacaaacaaatgaaaggcaaaacagtgggtcatctgtcatcctcacattatacatggtaatttttacaaagcatttgatccatatactttgtttctcatccttacaaccaccagacaagctgtacattattatctgctgtggaagtcgcagataccaagatgaaatcacttttatcagacccacacaaaatagggctgggaaggcacgaaggagtggggttcaggctttcatgtccaagacaggaacggttccaaagactttctaagaatcccataagaaatcccttcacgcctgtcacgcatctcctgctttgcattgcttgcatgtacgcacatatttctatggcaaggtttatcactgcacattcttttggactgcagcaattcagataagataacatgagatgagatgctgtcaaaagaacacctgcccaggaacagcatctccaccaatgaacacacaagaacacacaagaaggctttgagccttcagaaccaaggaattctcttctgccctctctcctctcccctctcccccgtcccctgtcttctctctcctctcccctctcccctctctcctctctctctaaagaaactggagcctcatcacattgcccaggctggtctcaaactcctggcctccaaagaccctcccgcctcagcctcccacatagctgtgattacacgtatgagctaccatgcccagctatgaactctgtttctaagcagcttatgtgaacttctcccttttgccaagaaaaattccctttactcttccctcactgcacgtgcctgtggtttacagtagtgcattccaaatcataaccctcttttcttattcctgaataaatttgacatatttggggatatctgtctctaatttttttgttgttgttgacactgcattttacatatgagattcagacaaggtcagtcacctgcctagggtctggtagtcaggtagcagcagattcaagcctggctctatctcctaagcctctgcactaccccctgcccttgtttgctggcctgaactccttcctctctaggagtggttgctggactgctgtctcccctccctgtgcttattaccttaccctctgactatgttagagaaggcatatgaaggcccctgcagacaggatgtgcggctctagtaggtgctagtcacatgataatgtgatcatgtgtgagtggtgccactggtacttgtccagtgtataacccagcgacactaaacacagtgaccctgaggctaagtgaagcctgagctgaggctagagctgagacaggtgcccacgagcagcggcttgtgctccagccggggctgctgttccctgttacatatgcatatatggtgcactgtcagcatggacaaggactgcctgggtggctgttttgattcgtcagggagccagagtgactgtcaaatgatttctcaattctagcttcattcgtccctataaccatctcatctacttgtctaactttctctctctcctcttcctgcctttctcctctcctcccttgtttacttcctccctcctaatctcctcactttcttttcaactatgaaagtaatatatacttgtttccaaaaatttaaacaagacagcaatgaacaaaataaatgtgaaaatccatcactacttcaccccctgacaaatccagatccagaagtatctacagtttggtttacatattttcataaggttttctatatattttcaagcaactccatatatagtttgagtggttttaaacattttcaaagtctcacactgcacttattgtgcatattgctttcccacacaacgtatcaaaacataccaaagatatccattcactttttttttcttttgagatggagtctcactctgttgcccaggctgctgtgcagtggagtgatcttggctcactgcaacctccgcctcccaggttcaagcaatttcttgcctcagcctcccgagtagctggaaccataggcacgcaccaccacgctcggctcatttttgtatttttagtagagatggggtttcaccatgttggccagggaagaggggagataggagaggagagaggagagagggaagaggggagaggagagttcatcacttgaatgaactcctggcctcaagtgatttgcccgccttggcctcccaaagtgctgggatcacaggtgtgagccactgtgcccagccttttttttttttttttttttgagatggagtctcgctgtgttgaccaggctggagtgcagtggtgcgatctcagctcactgcaacctctgcctcccgggctcaagcaattctcctgcctcagcctcccaagtagctgggattacaggcgcctgccaccacgcctggccaatttttgtatttttaatagagacagggttttaccatgttagccaggctggtcttgaactactgacatcaaatgatccgcctaccttagcctcccaaagtgctgggattacaggcatgagccaccatgccgggcctccattcacttttgtgggcatggctgtccatgtgcaagatgacttataaatgtaaataactgtgtccagttttgtagttaatttagtatccaaccaacaactttgcatgtagtaggtgtgtgacaaatatttgttaaagaaaatagaatctgaggctgggcacggtggctcatgcctataatcccagcactttgggaggccgaggcaggtggactgcctgaagtcaggagttcgagaccagcctcgcaaatatggagaaaccccgtctctactaaaaatacaaaaactagtcaggtgtggcagtgcgcacctataatcccagacctgggtggggtgaggcaggagaatcgcttgaacccaggaggcagaggttgcagtgagccaagattgcaccgctgcactcaagcctgggcaacagagtgagactgtcacaaaaaaaaaaagaaagaaagaaaatagaatctgagcctgaccaaactgctagatccaagtgtcaggttcctggaaatgcagaaggtagaggaacatgttagactatgccagaggaacacattctgccaaatctagagtagagggaattttacaggacagattacatggcttctttaacaaataagtgacaagaaaaaagagatggataaagaggaaatctacgaattaaaaatcttaaggggctgagcacagtggctcatgcctgtaatcccagcactttgggaggctgaggtgggaggatcacttgagtccaggagtttgtagaaccaggagttccagaccagcctgggcaacaaagtgaaaccttgtcgctataaaagatatgaaaattagctgggcatggtggtaggcacctgtggtcccagctactcaggacgctgaggtgggaggattgcttgagtctgagaggtggaggttgcagtgagctgagattgcaccactaaactccagtctgggctccagtctgggcaacagagcaaaactcactctcaaaaaaaaaaaaaaaaaaaaagaaagaaaacaacaaatcttggtcaggcacaggtggctcatgcttgtaatcctagcactttgggaatccaaggtggatcacttgaggccaggaatttcagaccagcctgggcaacatgatgaaaccgcatctctactaaaattacaaaaattagccagatgtggtggcacatgcctgtagtcccagctactcggggagcagaggcagaaggatcacttgagcccaagaattcaaggttacagtgagccacaattatgccactcactgtacatttcatgaaatctctttcctcaacagcatccccattcagatgtcacatccattccgataatatatcagggagagatgataacaattatgcaattatattgcataattgaattatattgaaatataatccatcgggagcagtggctcatgcctgtaatctcagcactttaggaggccgaggtgggtggatcacctgaggtcaggagtttgagaccagcctggccaacatggcaaaaccccatctctactaaaaatacaaaaaaaaaaaaaaaaaaaaagaaattagtcaggtgtggtggcacgtgcttgtagtcccagctagttggggctggctgtggtggcttacacctataatcccagcactttggggggctgaggccaggagttcaagactagccttgccaacatggtgaaaccccatctctactaataatacaaaaaaaatagctgggcatggtggcgcatgcctataatctcagctactcgggaggctgaggcaggagaattgcttgaacccacgaggcagaggttgcagtgagccgagatcgcaccactgtactccagcctaggcgacaagagtgaaactccatctcaaaaaaagagaaagaaatataattcacacatcataaaattcacccatttaaaatgaacaactgagggtgcggtgactcatacctataaccccaatgctcttgaggccaaggcgggaggattgcttgagaccaggagttgagatcagcctgggcaacatagctagaccctgtctctaaaaaacttttttttaaagaaaacgaaaacttagcagggcatggtggcatgtgcctgtagtcctaactacgtgggaggctgaggtggaaggatctcttgagcccaggaatatgaagctgcggggagctatgattgcagtactatactccagcctggacaacagagtgaggctctgtctctaaaaaaagtaaataaaatgtacagttcaataaatatcagcatattcataaacatgcacaaccaccaccacaatcaattttagaacattttcatccccccagaaagaaacgctgtgcccattagcagttgctttccatgtcccccattaccctcctagccctaggcaactactatgttactttctgtctctatagatttgcctactggggacatttcatataaattgaatcatacagtacgtggtcctttgtgtctggttgctttcactttgcaaaatgttcatgttggtagaggtgcttaaaaaataaaataaaaagaacaacaaaaaaaggaagcgaaattcatccatgttgtattgttttagtacttcatattccttttcattgtcaaataatatttcattatgtggatataccacactttattatcacatataccatattttattcctcaacccagttgatggatgtgtggattgtttacgctttttggctattataaataataccgctgtgcacattagtgtgcaagtttttatatggacatttttcactttttttttttcttgagacagggtcttgctctgtcacctaggctggagtgcagtggcttgatcaccatccattgcagcctcaacctcaagggctgaagcgatcctcccacctcagcttcccaagcagctcgtacgacaggagcacaccaccattttttatagagacaagcgtgttgggggtgttggtggggggggtctcactatgttgccaagttggtctcaaacccctgggctcaagtgatcctcccacctcagcctcctaaagtgctgggattacaggcctgagccaccacacctggcccatttttcactcttaaacttacagttgtattgtcatactaaactaagttaattgccgtttaattttttattagcaggtataacaatacattatgcaccatggtccaacaatgacaataaagtttttcaccactccgggcattttatccacaccaatgtaaatgtccttgggtcccatagcaccaagagactctgccacccttttctttacatcacactgctttaaagtgactgtagattctgcttttgcatcatcctaaaggtttatttgtttaattcatcaagactaggatacattagaatcttgactgggcacagtggctcacacctgtaatcccagcactttgggaggctaaggtgggaggattgcttgagcccaggaatttgaaaccagtctgggcaacaaagtgagatggagtcttgctctgttcacccaggctggagtgcagtggcacaattttgactcaccgcaacctctgcttcccaggttcaagcaattctcctgcctcagcctcctgagtagctgggattacaggcatgtgccaccatgcccggctaatttttttatttttagtagagacagggtttcaccatgttggccaggctggtctcgaactcctgacctcaggtgatccacccgcctcggcctcccaatgtgctaggattacaggtgtgagccaccatgcccagccctttccttttttttttttttttttaaataggagacaagggctcactctgttgccaaggctgtagtacaagtgcagtggcatgattctagctcactgtagcctcagattcctgggcttaagcaatcctcttgcctcagcctctcaaagtgctgggattacaggtgtaagccaggacacccggcctcctttcttttgaatgatattaatctgttcatcattcagcacaatttggagcaaaggaactagtaagtcttcaacaggctttcacttcatcctgctcccccagtagtagggtcatacaaaaagtctacgaaggtagaggccctcttatcacagcaacaatcatcacttaagtcaaagacataaaattaagggataccttagtttcatcacagaaccagtccaaatgtgtttgtttgcattctcaacatttcagtaacctctagggagtatttcttctaacaattatgggtggaattgggcagttcccctttacaagatatgttttatgtactgccacctttgtgcagctcaaccgatttggaatttgcccagctaaccacattccggcaaaagctgcagctaattgaagatcttcaacgaattcagctaattaagaccaaacacaccctttcatttgaaggtacatttgacagtacctaatacaaggaaaagagctcctttgtcattcatgtatatccaacccagcagtggttctgcaggaagctctgtcagtccacaggcaacttcactcttgtgtagttccctgtttcagttgtctcttgatgccctcccactgtagtttcgttggtgattatctacccgatgagggtcacattcccatcagaagaaatatctgcccaactcctctttggcatcatgttccttccctttacagaaggaaattggtggacttggcaacacaggctcttttttagttactttcatttttgccaaagcagcctaaccagccagggaactgtattcttggctgacttcctctgtgtctggatttctttttaaatctatttagcgatttcctcttgctctgcatcaaccaccttcaagttccattgtcatccctttcttcccattgagagttgtagcacttcagcaaattcaaacagggattccccagcaactagcctggcaccagtggctctaaatctttccccacttttcatctttctcccaaacaaagccttagctatcatttaaattataaagtaaaaaactggggggccaggcgcagtggctcacacctgtaatcccagaacttcgggaggctgggacgggcggatcacttgagttcaggagttcaagaccagcctggccaacatggcgaaaccccatctctactaaaaatacaaacaaattagccgggcgtggtggtgcatgcctgtaatcccagctactcgggtggctgaggcacaagaactgtttgaacccaggaggcagaggtttcaggcttcagtgccactgcactacagcctgggcaacagtgtgagaccctgtctcgaaaaaaaaaaagaaaaaaaaaaacctggggccaggcgcagttgctcacacctgtaatcccaccactttgggaggccaaggcaggcaaatcacttgagcccaggagttcgagaccagcctgggcaacatggtaagactccagctctacaaaataatttttttaaaagttaggcagccgtgatggtgtgcgcctatagacccagctactcgggaggctgaggtgggaggatctcttgagcccaggaggttgaggctatagtgagctgtgatcaagatactgcactcaacttgggtgacagagtgagagagaccctgtctcaaaaacaaaaaaaaagtaatgatcctattcacagtaccctcttcatcaattacacaggtttggatcattgaaaagacttagaagactccgcatagtatcctcacataaggctttaataaaggtaaaggatagatacaaaaaaaaaaaaaacccaacaaaccaaaaggcaagtgaaacaccacacccagttcctagggtccttttgcagccacagaggatgtggaagatgtgcttcatctttaagcaatgaaccagctagatgatacatgcaagacaccttggtctcaagagaactgtaacctcatctgaggctcttttatactcctctgatcaggtagccaacactagcttgcataccagggctcaaaaccagaaacaagctggtatagtcaagctggggcagtggcatgcacctgtaatcccagctacttgggaggctgaagtgggaggatcacttgagcccagaagttcaaagccaatgagatttcatctccaaaaagaaagaaagaagcaagaaacaggctgctccctggtctgtctcccaccccagcacaggactctattaatcactggctagtacatttcatttaggtttggccaaggaacagcaccaaggcttcaggcctccccagagataaatgagtacagagttgcagcagaccagcagacattgatcctgtctgacacaacgaagtttggtggtcaatcatgccagtctagaggctgtttctgggggaggagaagtaatttccaaggccctttccaggtctaatattctttgactacagtgctaagagtgccattgaggcaactgtgccatggagctaggatttaaacccaagtctgtgtgactccagtgtctgtcctctttcctccataccatcctgcctccaaagagagaaacaatagcaagacaaagaagggaccataggtttaggtgtggaagaaaagcacctttgccagggatagtaatttacttacctgaggtttatccacagttctagtctaatagaggagaatgctggccagtggaaggaaagtatgtggctgaagaacaaatgctctgtccgtcctttagtaggaagcagtgagaaaatatttaaggaactaaaatgcaaaaaaaaatcgcgcagtcagagactttaccagtaaatgctctaaggtcttgagtcaacaggatttaatcaggacccaaaaggagtaatgaaacctacagagtctcacaccagaagtattttattctagtttttttgtttctgttgtttttgagacagtgtctcactctgtcgcccaggctggagtacagtggcacgatcctagctcactgcagcctcaagcttccaggctgaagcgatcctcccatctcgacctcccaaagtgctaggattataggcatgaaccaccacatccggcctttattctagtttgttaagattggttaatagttaaggtgctagtgtcttatttctgttatagtaacagtttctatctttctggtagcttttaggatcttttctcctaagtgtagacctctctacattcattgggctgggtattcaatgggcattttcaatctgagctcttgggtctcccatcaagcctgggaaattaccttctattatttatttgataacttcctactgtctgttactctctttttactcttttggtattcccactattcaggtgagtaattaattgatcacttatttttttttcatatattcttttcctactttctaagggtctcgctctgtcatccaggctggagtgcaatggcacaatcacagctcactgcagccaccacctcctggactcaagtgatcctcccacctagcctcccaagttttgggactacagacgtgtgctaccatgcacagctgattttatattttattttgtgtagagatgggggtctcaccttgttgcccaggctggtctcaaactcccgggctcaagtgatctgccggcctcagcctcccaaaatgctgggatgacaggtgtgagccaccgcacccagctgtcctctcctttatattccggctctccaatctagtttaaaatttcagcaattataatttcccacagctctttcttttctctgtgccttattttcatagtgtcaatttttttaaccagtgccatcttcctgaatctgctgtacgatactaatgtttaagttcctgtttcctgaattatgtttcctcaaaggtttttaccacttaccttggtgtttacttttcatattatcaactttcctcaaatgtgtagtgatcctgggttttcaactcatgtttaaaaattaagtcatttaaaaacacattggtcaaactaatcattaaaaaatcaggagccacaggagtgggacttgaacctgagcctttcactctatggagaacaagaattaccctaatgtcagaatgtcagagaaagatttcagaaaatgatttcaagttacttggggttttttttgttttgttttgtttttggagatggggtctcactttgtcacccagactggagtgcagtggcacaatctcggttcactgcagcctctacctcccaggctcaagtgatcctctcatctcagccccacaatagctgggactacaggcatgcaccaccacacctggctaatttttgtatttctagtagagacagggtttcgccatgttgcccaagctggtcttgaactcttgacctcaagccatttgcccacctcagtcccccaaaatgctgggattacagtcatgagccactgggcctggcccgttacttgtaaagacaaagctagcagccgaaaacttacttggaacgttccttggacataaaatcaccatttcttaaaaggattcttagttttggggtgccagtgcccacactggttctctaggtcagctaagagaaagcaatgtgttcaattttgggggaagcagggaagactcctgtaattttttgccccagggtaaacacttgtgtgtcaaatattctgatcatggggtagagagagctgactgtcccgtgcacgggcttccaattagtccctcaattttcagcccttcatgtcactccagccctccttcctatctggcatcctgtgtccgcagttactccaagcttctccatagggcagatagtctctcataggagactccatattcaggaagcggtttccttgagctgcttccttcctgactactagtccatatagtttctactttccaagaatgtgttaaaatattctatgtgctactggtcccatttctgttctattttatttttttttacctttaaactctgttggacttgacattcttgttttcttaattttcctgggtttatacttttaagaatcagtaatattgtgtatttattaccaaaaacatgaactaaaatttacatagagcctatcaaggaaaaaccatttctctactcacatttctgacatcaaatatatgggttttccaccaaccaattctccaattctccacagacagcagctgagtgtcttacaattttactcaattctgatgctaattaaccagagttagtgcagaccccacgggttaggggctcagcccccaagactgccccctacttcagatgccagccacaactattaggacctcagggtacccacacttctgtctgagttcactacaaatcatgggtatctgcaaccccctcaggttcgataatttctttcttgggggttgggggagtttaggagcagaggtttaataggcaaaagaaagaaaaacgagaacagatctctcccttgtgaggggcttccgaaaggaaaatccggcctgcggtggactgcaccagattttataggtaggcctgaggaggcggcgtctgatttgcgcagagcccacaggttggtttgaacaggtgtgacgtttacatagcacgcggggaaggttgggcgccccaccctaatcttactatgacaaagggcagagtgaccttgacatgccatgtgctttccagagcaagggcagagagtgacgctcactgtggtgggagaggagaccctctgttcctagaaaatcacaacagcatgcccctgtgctatatccctggttactacagcagtctttgttcttgcctaacaagattacttccctgaactgtaaaactccctcagtactgcatacagagagaggttaggagacatggtggtcgtggataggaaatgagggaattatgataggaaagttggaggtcctgttgccgacaccccttagggtggccggaggctggggtcagtccagaagccttcggatggcaccaggaggtagccccagccagaaatcctcagttgctccaggacctcttccagccccacacgacagcttggtcctccgtgaaaggaaactggttcaaacatggccaatatgcccagcagcccgtgggtattggggggttctccatgttctccccagcaagcctgtcccccaaaacttgtaaggctggcagccacgctcataatttttaaatggctaattggtgaaggcagagttttctcattcacagaagcagaagggggcccagtatttggtttggtttgattctaaaatggaggccaagagcctcgaaatcaaaggacagagttgaggtccgcccctttactcacctttgcaatgaatgcaccttggaatcccagacgaagtccccaatatgaagtggcattgttgtctggggtcaatacccggggttcgtcgtctcgcaccaacaaggttaaggacacgatacacacgaagagtgggtttaggagcggaggtttaacacgcaaaagaaaaaggagaacagctctctcccttgtgagagagagcggcttccgaaaggaaaatcccaggttcgatcgtttcttataatggctcacagaactcagaaactttacttatgtttactgctttattataaaggatacagatgaacaggcagtcgaagaggtacacagggcaacgtccagaagggtcccaggtgagcacaggaccttttgtcttcatgcagtttgaggtgcatcgccttcttggtatgtggttggggttaaccaaaccgaaagctctccaaacctgtggtttattttttaatggaggtgccatcacttaggcatgattggctaaatcactggcaactggtggttaatcaatcgccagcccttttaccctctctggaggtcgaggcgtggggctgcaaatcccagacctctaatcatgccttagtctttcacgggatagcccccatcctgaagttgtctaaaggatcccagccaccagttagctcactgtcatacactcttatcacttggagattccaaaggtcttagaagctcttgtgtcaggaaccaagaccaagtattctaataaaagatgtttctatcacccctgtcactcaggaaattacaagggtttctggagatctgtgccaggaactggatgaagatcaaatatatatatttattatatcacaatattgcagcctactacttgccaggcacaattctaagcactttacatgtgtccacttaattcctttaacagtccaaaatcagctattgctatatcatctccatattacagataaggaaactcaagcacataggggttaaggttaaccagtgatctggctagtctgtacttttacctgatgttgtgctgccatacagactagatttttttttttttttttagactgagtcttgctctgttgccaggctggagtgcaatggcgtgatctcagctcactgcaaaccccgcctcccgggttcaagtgattctccttcctcagcctccccagcagctgggactacaggcacatgccacctcgcccagctaatttttgtattttcagtagagacagggtttcaccatgttgaccaggatggtctcgatctcttgacctcgtgatccgcccacttcggcctcaccaaatgctgggattacaggcgtgaaccacagcacccagccaagactagatttttaagaaaaggcaatccagatgtcctagaaggttcatttcctctttttggtggtttagtaaatttcttagtaaggcttctagctgttatagcagcattagtatgtgaaccacagttaagctctagtccaacaaggccatttcttcagcagagaagcaattgttaaataatcgaccaagtattcattggctccctctttttgtatcaacatacacaattgttacagtgccagtgtttattggaaccactttccatggtgcatccagctgtgcctagaccagcaggtctttttccagaagtccagatggcaggggaacctcttcacgttgttgacccttctccctgtaattttttccccaataaaccttttcattatgttgctgtatttatacccaaatacacattacatttattttagtaccttgtacattttgttgcccttataaattggaggggttttaaaaactattttttattctcaatattcattgatgatgtataggactccttctggactgtttaatatatgactgtaaatccccctgaattttcttagatgtttgtagtatctgattatgacagttttgtcttttatttattgccttgttgcattgattagggcctctaatataatgttgcttaataatgaagatagatatcctatcttattcttgacttttggtataaattcttctaaagtttgagcattaaacatgatgtttgttgtagattcttagtggatactctttagcagttaaagtaacttctcttttacttccagtgacactactacctaatttgaagagaggatttggaattttgagtttcaaaataatactgttttcaaacacttttttagctaaaaagtacacacacatagggcagtgttttaaagtttagctacttcagggcatatgtgtatactcactgaagttttaatttaatggcttattggtcattcatgtatcttctttggtaaggtaattaaatttttttctttttttttaaaagacagagtctcgctctgtcgcccaggctggagtgcagtggcacaatctcagctcactgcaacctccgcctcctgggttcaagcgattcccctgcctcagcctcccgagtagctgggattacaggcgcccaccaccatgcccagctaatttttgtatttttagtagagacagggtttcaccatgttagccaggctggtctcgaacccctgacctcgtgatccacccacctcggcctcccaaagtgctgagattacaggtgtgagccactgcacctggccgtaattaaattcttgacccatttaaaaagtgcgtgttttcctttttattactaaattataaggattctttatatattttgcatactagtcctttgttagatatttacattgcacatatattctctcagtctgttaaccatcttttcattttcttaatggtgtctttcaaaaagaagtttttaattttgatgaagtccaattttaatttttgttatgattgatagtttttgtgtcctaagaaatcactatctactctaaagttgtgaagatattctaaaagttaacatttgtattgtacaatatcaactgttagttgaggatatggagcaactggaagctcatacattagttgtgggaatgtaaaatggtattaatacaatgtctttggaaaaacagttcactggtgtcatggaaagctaagtatactcttgccatacaatctagcaattccattcctacatatttacccaagaaaaatgaaaacacatgaacacacaaagatttatacaataatgttcatagcaactttattcataataataaccaaaaaatcagaaacaacccaatgtccattggggataaacacatggataaacaacgtatccataaatgaagtacaggtggtaaaaagaagcaaagtattgatatatgcaacaaatgaataagctcaaaaacattatgctaagcaaaagaagccatacatatcatttaatttttaaaaattgtatataacagacaaatctcatctacagtgacagaaaacagatcaatgtcaccggccgctggaactcctagggagtactcactgcaaaggagcccttctggagtgatgaagatgttctctctcgattgtggtggtcgtggcatgggtacagaacacttgtcaaaaggcatggaattactcaagatgggagcatttttactgtatgttaattataactcaataaaattgattttttaaaattctaagtacatatataaatacattaatgtttacagagcattaagagaagtgaaaaaggtcgggcgcagtggctcacgcctgtaatcccagcactttgggaggccgaggcgggcggatcacgaggtcaggagatcgagaccatcctggctaacacggtgaaaccccgtctctactaaaaatacaaaaaaacaattagccgggcgtggtggcgggcgcctgtagtcccagctactcgggaggctgaggcaggagaatggtgtgaacccgggaggcagaaattgcagtgtgagccgagatcgcgccactgcactccagcctgggtgacagagcgagactctgtctcaaaaaaaaaaaaaaaaaaaacaaaagagagaagtgaaaaaataattccatgtttgagatttgttttttttgtttgtttgttttcagacggagtcttgctctgtcacccaggctggagtgcagtggcgtgatctcggctcactgcaatttctgcctcccgggttcacgccattctcctgcctcagcctcccgagtagctgggactacaggcgcccgccaccacacccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgagatttgtttgtttataaagttacctgaatttgttttttaagtttagtagaattcttttatcaggacctgtttttaagttacctatgtacctctctaaatgggattacaggcagtagctctcacacttcaacatttatggtaaccacctggaggatttgttaaagcggactgctagacccatcctcagagtttctgattcaacaggcctgtgatggggctcaagaatttgctttttttttttttttttgagatggagtctcattctgttgcccaggctgcagtgcagtggtgcgatcttggctcacagcaacctccgcctcctggattcaagtgattctcctgcctcatcctcctgagtagctgggattacagatgcccttcaccacggccggctaatttttgtatttttagtagagacagggtttcaccatgttggtcaagctggtctcgaactcctgacctcgtgatctacccacctcagcctcccaaagtgctgggattacaggcatgaggcaccgcgcctggccaagaatttgcatttctaatgacttcttgggtgatgctaatgctacttactggtccaaacactacatttagagtcactgactgtagagatccttaaaagatccctattcctccaaagagtcaattcttaatgcttaaaacttgaactaggctgggtacagtggctaacgtctgtaatcccagcactttggaaggcctaggagagaggatcatttgaggccaggagttgacacgagcctggacagcacagcaagagtccatctcttaaaaaaaaaattcagccaggcatggtggtgcacacctgtagtcctagctacttgagaagctgaattgggaggatcacttgtgcccaggaattcaaggctgcagtgagttgattgtgccattgcactccagcctgagagacagagtgatactgcctcaaaaaaataaaaatttaaatttaaaacagaaacacaaaaaacctaaattatcccctaaggctggccacggtggctcacacctgtaatcccagcactttggaaggccaaggtgggtggatcacttgaggtcaggagttccgagaccagcctggtcaacatggtgtgaaaccacgtcactactaaaaatacaaaaatcagccaggcatggtggcacatgactgtagtcccagctactcgggaggctgaggcaggagaatcacttgaacccgggaggcagatgttgcagtgatccaagatcatgccactgcactctagcctggttgacagagcaagactctgtcacaaaaacaaaaacaaaaagtaaataaattatcccctaagaggagtatatcccaggaaagtgtaacacctgaaacttaaaagattatctgccctgatgataaacgatagaaaagagacaggccaggccaaagtttgtcaactggtggactgaagataagttttatttagcctctgtgtttttctaaattagaggctaacatctcaaacttgggagaattcactttaaaaatccagtttttacggctgggcatggtggctcacgcttgtgattccaatactttggaagactgaggtgtgcagattacttaagctcaggagttcaagaccagcctaggcaacataggaagacactgtctctacaaaaaaaaactttttaaaaattagccaggcacaatggcacacacctgtggtcccagctactagggagtctgaagtgggaccatcacttgagtctggaaggtcgagactgcagtgagccatgattgcaccaatgcactccagcctggggaacagagcaaggctttgtctcaaaaaaaaaaaaaaaaaaaaaaaaaaaaatccagatttagtttctctttaagtatcattcccagaagaaaaaaataggctggggccaaataatggttacctcactttatttttacatttttttgaattaagtaacaaaatttaaaaaatacaaaaggatgtacagtgaaaagtacatctcccttctatccctgatccccagactctcagaggctgcctcctttagatggggcgggtgctttccagatgtccccactctgcatcaactggccctctttcacttatctgcattgtctgcctgacccctttagacatctgagctgcctcccaacccattttaccacgcctctcctgcatccccttaacacttggcatgtctgtcgttagcactttcacacaagcttctttacaaggctgtgtctttttagatggggagattcacagatgcatgaggttaggtttacatcttcttttgactatctacatccctgataactaggatggtgtcagacttatggcagatgtacaagtttgttgagtgaattaataaattaatgaatgggcaaattgtgtattgtttccagggtcctgaggtgtgacgcaaatagcaattcagtcaggtgaaatcaataatttagatcccatcaggatcccagccgagtccccagtccatcttgtaacacttctccccagaacatacttaaattacctggaaataatgaatcctctgcccttacagaactggatccaaagcaggcactagggcactctaagactacttctcagaagtgtgacaacctcctgtaccctttttctccttactacagggcccaaggactgaaacttcttaccttttctcctaaactctgccacccactaatggcctcaggactgggattccactaacccactccccaagggctgattgcaccctttctttgtcaccactcatgaaatcatttcatgctatgaattggccaaccgttctagagatatagctgaacacagacatgaccagaaacatgaggaagttataaagtattgagaaatccttctagaagtagatgcaatgccacaccactgagcacgagatctggcttcctgagcagttaccaaaggacgagatgacacagccctgtgggcaaactaggatcaacgggaaatggaagaacttaggaaactaagttacttctccttcctcccttcaatggactgctcagaggggcagtttctccttataaaccttctggagaagccccacactctaagtgaacacacttgctggaaggctcctgtatctcgtcacagcttgtcatgaagcctggtcactgcagtaacacaatgcatcacgtttttccttgctttgctttcccttttcttccacactctcacccccctagatctgtccctccctaataaagtaacaatactttcatctttgcctcaggttctacttcctaggggacctaagttaagaaattcttgttgttgaccaggcgtggtggctcacgcctgtaatcccagcactttgggaggccaaggcagatggatcatgaggtcaggagatcgagaccatcctggctaacacagtgaaaccccgtctccagtaaaaatacaaaaaattagccaggcgtggtggcaggcacctgcagtcccagctactcgggaggctgaggcaggagaatggcatgaacccgggaggtggagcttgcagtgagctgagatcgcgccactgcactccagcctgggcgacagagcgagactctgtctcaaaaaaaaaaaaaaaaattcttcttgttgtaatttattgttgttgcaatttttgtttgttgtaatttctagggtaaccactgaaagaataaaaacaaagtatacaattttcaaactagtgacgaaaaacatagaatggtagaaagtaagtaatcaaaaagaaggcaagaaggaaaagatcgtatcaaatatgtagttaaaaaaatttaaaaaaacgaaagatggaattgttggaaccaataacacaaagataatagacttaaacccaaatatatcagtggtaatcttttaataaatatttatatttattatatatatttatatattttaatatataatatattaaaatatatattatatataaatatatataaatatataaatataaatataaataatatatttataaatataatatttataataaaatatatcagtggtaatcttttaataagtaaatatatttattaaatataaaaggtacacagtaaatataaatgaactaaatgctttagttaaaagacaataaaaattatgaaataaaaatgtatacacttgaaagtatttaaaataaatctaattttcataatgaattttaagcattaaggagttttgtaactgaatagtggaactcagaaagacatcctattcagaaggatctctcatgataatagtttccttcactattgtagtatactgtagagtttcaagaaaaaaattaaaggccaaaactgtcttacattaccattgctgtttctgcaatcttcaacaaaccaaaattttctctgtaattgtgaaaaaagaactcctccttaagcataactaaaattttgccttaaccttatcaaatacccaaaactgtagaaagagataaagctgttaatagagacatgggtatccctttttatcaggtcaggagggtaagtctctaatagagagttctagtaacttctcaaaaggtaactaatgaaggccttccttctaaaccagatagggggagatagaatgctctgagtattaaaggcatctcctgcaagccactgatacctttgttgacagagcacacagaagaaaatagcagttaccaggttacctataggtgaaatttgtttccacataaagaaccactgggtccaggctcatggagtatgactcctgagagaaactcccgttactctgatcagtgtgtgtgtgtgtgtgtgtgtgtgtgtgtgtgtgtgtgtgtattaaaaatgaatattcctgggctcccaataaactctccagggtgggattacgttgtctttactgataatgttcttaactaaaaattcttagttataaaatcacaaatttcggccgggcacggtggcggaggtgggtggatgacctgaggtcaggagttggagatcagcctgatcaacaaggtgaaaccccgtctctaccaaaaatgcaaaaattagccaggcgtggtggcaggcgcctgtagtcccagctactcaggaggctgagacaggagaatggcttgagcctgggaggcggaggttgcagtgagccaacagcaggccactgcactccagcctgggcgatggagcaagactccatctcaaaaaaaaaaaaaaaaaaatcacaaatttcatagtgaaactcaagttagagtacctgaagtttatatacataaaatagacatacctttgctatgaaagcctgatttactcttttttttttttttttttttttttttcttgagacagagtctagctctgtcgcccaggctggagtgcagtggagcgatctcggttcactgcaagctccgcctcctgggttcacaccattctcctgccccagccttccgaatagctgggactacaggcgcccgccaccaggcccagctaattttttgtatgtttagtagagacggggtttcaccgtgttagccaggatggtctcgatctcctgacctcgtgatctgcccgcctcggcctcccaaagtgctaggattacaggcgtgagccaccgcgcccggctgaaagcctgatttactcttaactggatataaccagaaagagttctgcccacaatgatatatctgcattgaatctaaaacacagacttcatcatacattctcacctaaatttctctgatgacccagagtaaggcaaaaggtttagcatatgagagtgaaaggatttgaatctcactttctgtcaaactttagagctctgttaaccatggttagtatcaactatgattttaggcaactttgcttatagtaaaaataactcgttaattgttacgtatctggattgggatgcactataaataaatggagtcttcaagctttaggctttcctgagtgtagtgactcttgaaattgacacatcccttgtggatacctggaagctgtgtttatggaattgttaagagatattggttccttgatgcctgtggaggatcttatctccttgcacccaaattgtactagtggactgctacaaggacttccactgctaatgaggactgcttgatgctgtgctggcaggctgttgtttctgtttaatatccttctgagtaagcgggtaccaagtatggccatggcagtcttgtgagtttgaatgtttaatgtaaagtgacttctgttggtcatagccacaaataatttcagatgtactaacttgataaacatattccagatgtttggttaaacctaaaaagacctctctggtggatgtagcagtacatcatttcatatgtattaatttcataactttttttttttttgagagggagtcttactctagggtggagtgcagtggcacaatctcggctcactgcaacctccgcctcctgggttcaagcgattctcctgcctcagcctcccaagtagctgggactccaggcgtgaaccaccatgcccggctaattattttttgtatttttagtagtgacggggtttcaccatgttggccaggctggtctcgaactcctgacctcaagtgatctgcccacctcagcctcccaaagtgttgggattacaggtgtgagccacagcgcccagcctaatttcataagtattgataaattttcatcttacactgaatttacattcagacttaactttcttcttacactaaattaatgaattaacataaatcataaagattctatatttaattataaaaacataaaattatcacatcaatttaattcttataagtttatacatactgcataatgactttgaaaacagtataactcaaaataatagaaaacaaaattaattgaatgaagtactactgaatttcaggtatttctgtgacaacacaaatttaaaatttaataaaatattaccttttcttagcaaaaagtttcttaagtcagattatcctttcatgttttaaatgaagcttcttctaaagaagtccttttattcacagttgcaaatttctttttaacacatacaatgtatactacatgctggaatcaaacacctgaaggagctggaatcttatgaatacagccagggcaacagtgtagagaatcatgaacaaaaacatcacagtccacacagaaaacattttggcacacagcacaaacataaacctgtagtgaaaagaagaaaagtgataaactagtttccaaaagttaattacagcacagctagatgacattcaaggtgtgctttgctcttttatatctctaccaattttttcccactacctactttattacttccaatgtactctatattctcaaatctaaggcaattaattttttccccaaaactatcccttagaaatgagggaatggttttgtttttgagtctttaaagtctattctattacagttcgctctcaattatttcattctaaggtttaggaaagacatatgagcttcaaaccagcgctacttttgaatgcttagcaagaccacctgattgattcaattaaaaagagaagcataaaaatttaacatcgatttaattattcttagggaatgacctcacaattgcaaacatatttccctttcaagtaaacctttaaaaaaatatgtcaaatgacacagataagacaagcagaaaggaaaaaactacatttgttctttcagcattacatatatgagtacttgctccttgggataaaatttccagggcagcttcatacacagattcaaaaatcactaaatctcagaagtatttggctttgaataaaaaaaaaaaaaaagaatgaataaataaatttcaaacaacacagacaatgacctattcttaaaaactcaaatgaggccgggtgtagtgactcacgcctgtaatcccagcactttgggaggccaaggcgggtggattgcttgagcccaggagttcaggaccagctggtcaacatggtgaaacccagtctctactaaaaatacaaaaattggctgggcatggtggtgcacgcctataatcccagctgcttgggaggctaggcatgagaatcacttgaacttgggaggcagaggttgcagtgagccaagattgcatcactgcactacaacctgggtgacagagcaagagtctgtctcagaaaataaaaccaaaaaactgtcaaatgattcaaaaagtggttccagttaagagtaaactactgatgtcaaagaggtatataaaatttaataaaattactttataaattgtgacagtggaagagcaatacttctaattattattttatataatatatatagttttaaatatgaacatgtaactaaattaaaaattaaagctagacagtgatccatattatttacatctatacaaatttatttattaaagttggccctcttcaaaatttaaaaaagtattttctcattggcataatggaagaatcacctattatctgtggccaccttaaacaatttcaatgtgttatcacacagcttaaagtataatatgaagaaaatattttaaatactttcagactaaatgcagtttagcttgaaagctaaagacaaattacatgttttacaagggtgtaccaaagtagacaaaacaatcaaagaatttaaaaaaagaggaaaaaaattaaaaaatttttaataaaaagttttaaaaagatgaattacaaaatactttatagcaaaaattagaatgcagaataacaaaactactatttaaactattttgttcctattttaccttcacctattgtcattatctttacaagaaataaactgatatgagcctggtctttaacaacctgttgaaaacttatagtaccattgatttcaatatttcttgtacattacttaatatttagaaagccaaagaacttacatgttggtctttcaattccccctgacatccataacaaaatctgaaaaaaaagtttaacaatgttttttcttagaatttactcattaaaatagttcaacaaaatctcactaactagaatcctttaattaatatgtacttgtctttacacatgactttcaggaaaaagagttaagaataccaataggccaggcacagtggctcacgcctataatcccagcactttgggaggccgaggcgggtggatcacctcaggtcaggagttcgtgaccagcctggccaacgtggcgaaaccccgtctctactaaaaatacaaaaattagctgggcgtgatggcaggcgcctataatcccagctactcaggaggctgacgcaggagaatcgcttgaacccaggacacggaggttgcagtgagccgagatggtgtcattgcactccacactgagcaacgggagcaaaactctgactcacaaaaaaaaaaaaaaaaaaaaaaaagaatagcaataatttaaaaaaaaattccacagtatatacaaggtcatctgacagcccaaaatttagtttttattttcattaaggttaactgtgagcatgctttatttttctttgttttcgagtcagggtcttgctttgtctcaaaggctggagtgctgaggtgctatcacagctcactgcagcctcaacctcctgggctcaagtgatcctcctgcctcagcctcctgagtagctgggactacaggcatgtatctccatgcctggctaattttttattgaggcagggtctcgctatattgcccaggctggtctcgaatgcctgggctcaagcaatcctcctatcttggcttcccaaagtgttaggattacaggcatgagccaccatgcccagccagaagcactttctaacgtttgtttgatagtcacttattctaataagtgctactttgtgattcttcacagttattggctataaatctccaactatgaaagaagagaatttaattatctttcaatcatcttgaacccagtaatgcataaatatttaactagtgtcattctcaattctttctacatagtgaagtcttccttttggatagaacaataatcaatgtttagtttactatgcctataaaaatattctcagctaagccataagttttcccctatttaaaacattttttttttcctggaaatactgtgttgctattcccaaggttagtttcctatataattgacactaattcaggcccaatcttctccggaatagtctaactgtcctctcgatatgttcaaatacatcaggagttctgcagttttcatccccttggtgatctctctcctggagcatcctgactgtctccaaactggacggttccccatatgtgacacacaggtatcattctggaatttctccttaccatcatcctaggccgttcttcagcctgttttgaattagatacatattactagatcccatgtcattctccttctcagttcctttgaatcacctacctcttccagaccttccccagaaaaatctctttttgagaccttacaagtctgaaaatgtctttattctacctacacttaactgatagtttggctgggtatctaagttggtaacaattttcaccacaaactttgaaggtgactgctccctctctgcatccggtgttgctaatgagaagccaaacaattttaattccagatcctttgtgtgtgacctagtttttcctctctggaaatgtttagggttaatggtttattgtgtattctgaaatttcacaattatggggtctgccttccttcaatacgttaggcacttggcagtccctttcttttatcttcgttgcagagatgaggtcttgctgtgtgacccaggctggcctggaactcctggcctccagttatcccccagtctcagcctcccaaagtgcaaggattagagctatgagccacccttcccagccaacaggccctttcaatctagaaagttctgtccttcaatataaaatttctttgaactatgtctttgatgattttctatcctactttttttctttttttctcgtatcattctcatattggaccttctggataattccaccagtattcttatctttactctcctatttgaacctctttattttactccttttattgtactttctggaatatttcttcaactctatcttctatagtactgggtttttcatttttactacatttaacctcaaccataagcaaataaataccaagctaaaacaatgagacttttttctttttcttttgcctgtgagttttggccaatataaaaaagtttcataatacctaatgttggctaaatgtgggaaaacaataaatgaaacttctttgaagaacaactttacaatatctatcaaaattcacaaaacatgtaaaactcttgactcagtaattttacctctaggaatttaccatgcatttatacttgtacaaatgttcaaaaatatagatataagcattatttgttaatagcaaaaaaagaaaatcttaaatatccaacaggaagcaattgattatataaaccataattatacctgaaatatgcaacaatttcaaaaacaacattgatctagatatggtgatattgaatgacttctaaatgacttaagtgtgaaaagcaagatggatacataattgtttttggctagccagtaagtgtttaatgtgattcctaaatcctggatgttctttttttttttgatggagtttcgctcttgtcgcccagctggagtgcaatggtgtgatcttggctcactgcaacctccacctcccaggttcaagggattctcctgcctcagcctcctgagtagctggggattacaggcacctcccaccacacccggctaatttttatattgttagtagagacggtgtttcaccatgttgaccaggctggtctcgaactgctgacctcaggtgacccacctgcctcggtctcccaaagtgctgggattacaggcgtcagccaccgtgccagccgatcctagatgttcttaaaagtagtaaatctttattttctgaaaactattctctaaaggattgactacctctatttcagaccttatttgttgtatttcacacaaatagcattcgtaaaaatacttaaagattttagataaattatgttatgccagatttttttttttttgagacgaagtttcgctcttgttacccaggctggagtgcagtggtgcgatcttggctcaccgcaacctctgcctctcgagttcaagcgattctcctgcctcagcctcccgagtagctgggattacaggtatgcaccaccatactaggctaattttgtatttttagtagagatggggtttctccatgtcattcaggctggtgttgaactcctgacctcaggtgatctgcctgccttggcctccaaaagtgctgggattacaggtatgagccaccatgtccagctttttttttcttttttaagagacagtgtctcactatgttgccccagctagtcttcaactcctggcctcaagtgatcctcccacctcagcctcccaaagtgctgaatgagcctcttattttcagtagtgtgctaggactggattgtactggatcaaaaggatatattgttaaatatgtattcaagaaagctggttgttaattgtagctaaaaattggccatggtgggagtattcaaaccatggaaatcagcaaatactaccaatcagggctttttttcttttccttctggaaaactgatttagtagtacaatcatcacccctatttatacataggtgggtttagtgaaattatttggtttctggagattcagatctatttagcaacgagtcatttcaatcataactatggcattctttatctcatcttccatattagaagtactcttgtccaagttaatcagattattttttaaggtagtaacaatctattcaaacattagcttaccacttataacagatataaattagtccaaactgaaatacctttctccattatattcttctaggggaatttcttgaaaagcatccaaaggaaacaaatgatggtaagaccgtgccaagtggggagcagacaccaaagtaagacctaacacattaagcagagagacatgttgagtagtccaaacctcatgaagacaacggctgaaaagccaaaagatgtaacttcagcagaatatgttcagtttcttttaggatggcagttattaattttacctgtggctataacagaagattgtaggatggagtcttagttctgtcactaagtgtgtaaccaacctgtctcggtctatttgcttacttatattataaatgaaataaaattcgacaattctattagtttaattcttcattcttatatatatttactttataaaggtaagagatggaaaaatgtctactacatctactgcactgcctttaaagaatatacttttttcagaaagaggatcaggaaactagaatgctacatttatacgtggaagtggagtactgggcactcaatttaaaaagtaatctatttttctttgcacagattaaatccagaaacataggaataacttaacatttacattaattttagcagcaatacagattaagaagtcattcaagatttactgaataatgaatagttgttttcttaccacagattttacattcaacaggtagctcacagtactttgcccgacactgtgggcagaaatagcctcctaatgtaagccctggctcagtattgccatccaaatgcctgtagggggaaaaagggtaatatataatgatctgaaaagttagagcgggaaagcatgctatcttgaccttaaaatcttgacactatttaaaaatctatttaaaagtctgtatttttggccgggcgcagaggctcacacctgtaatcccagcactttgggaggccaaggcgggtggatcacctgaggtcaggagttcaagaccagcctggccaacacggtgaagccccatctctactaaaaaatacaaaaattagccaggcgcctgtaatcccagctacttgggaggctgaagtagaattgcttgaacccaggaggcagaggttgcagtgagctgagattgcaccactgcactccagcccgggtgccaagagtgaaactccatctcaaaaaaaaaacaaaagaagtctatatttaaaaaaaaaatttataactttttgtagagatgggggtctctcactatattgctggtcttgaattcctagcctcaagtgatccacctgccttagcttcccaaagtgctgggattataggtgtgagccaccatgcctggtctaaaagtctattttaaaatctgtgagtatgtcttataactcaattatgctacattcatttttttccccctcttcatttttttttttttttttttgagacggattctcactctgttgcccaagctggagtgcagtggcacaatctcaactcactacaatctccgcctcccaggttcaagcaattctcgtgccttggcttcctgagtagctgggattacaggcacgtgctaccacacccagctaatttttgtatttttagtagagatggggtttcatcatgttggccaggctggtctcaaactcctggtctcaagtgatctgcctgcctcggcctcccaaagtgctgggattacagatgtgagccactacacccagcccttctcttcatttttaaagtctctattactatctttgaattcactaattttttcttctgcagtgtctaatctgctgttaatcccagccaatatatttttcatctaaaacactgtattcttcatcactagaagtttgatttgggtcttttttataccttccatatctcttcttaccattctcatgttctctaacatcctgaacatacagagtacatttataattgttgtcctaacatctttgtctactaattcttttttttcttttttgataagagtctcgctctgtcacccaggctgtagtgaaatggcacgatctcagctcgctgcaacctttacctcctgggttcaagtcattcttgtacctcagcctcccaagtagctgggattacaggcgtgtgccaccaggcctggctaatttttgtgtttttagtagagatgggtttcgccatgttggctgtgctgatctcgaactcctgggctcaagtgatctgcccacctgagcctcccaaagtgctagcattacaggcatgagctaccgcacccaaccctttgtctattaattctaccaactgggttatttctgggtatgtttccattctgtgatttttctccattttatgggtcatattttcctttgcatccctggtaatttctgccagggactatgaattttgctttgccagacattgtgaattttgctttgttttgggggctggattttttctttttctttttttttgtattccctcaaatatttaagggtttgttctgaaatatacttcattaacttggaaatagtttaatctcttcaaaatttgcttttaaactttggtaggctggtctagaacagctgttagtctagatttttcttttcttttcttttctttttgcctctggttccagttcttgtgatagaattaatttgatcccattactgtggactctattcaatgcctgtcatgttaagaggtatttccatacagactggtgagaacatgaatgttctctgtgtgagctctggaaactgttctgtctgctgctttccagtgattttttccctgacttccagtagtctcctcacacaaaagggctgatcaacgctcagctgctgactcatgagcaagtctatgcagctccccagagagttctctctgtgcagatctttcctctccagtactctgacctgcaaaattatcgccatctcagcctccttgaaagatgaactttgtttcttcaactcaacaacatctccagcctctgtgtgcagcctggaaattccatccaggcagtaaggtggagtgctcttagggcccatctcatttgtttcctttctttcagggatcattatcagcaaggcttgctgtccaacgtctgaaaaccactgttttatatattttgtctgctttttttgacaggagggtaaatctagtccctgttacagctttttggctggaggcagaaatcttgtttgtgatttttaagaattactctcttaaatttaattttgttttataattatgtaaaatacaaagctctgaagttaaaacaaggtacagtaatattctatataacattttggtcagtgatgaaccacatatatgacagtggtcccataaaataatacattttagttgtaccttttctgtgtttagttaaacaaacactaggtgttacattacaactgcctacattattcagtacacaatatgctgtacaggtgtgcggcctaggagcaataggctatactatataactgcgatgttagtaggctacactatctaggtttgtgtaagtgcactctgtgatgtttgcacaatgatggtatcacctaatgacgcatttctcagaatgtgtccctatcattaagtgatgcattcagaaaagtctagggtctaaccctttgcttttccctacacactcactgaggtaaacattaaaaaaaaaaatttccccctccaccccttttaagtttttattatttccatactattgtttttattattaacataaacaagtatatacatccacttacatctctactttcttcttaggtgattagcagcatactacaaaattctctcaaactactgttttacttagtaatttatcctgaagatcactccatacaagtatatagagatagtcttcattgcctatcttttgaatttataacttaaaagaaggaattaaaaatgtaaaaacattattactgatattttcaaggtctttacttacgccatgctgaaagagggttttgcatcctggtcagataaagaagcaatggtgtgctgaggaaatccttcatagaagaaaatgtattactttctttttccaagcaaacagcagaattctaggactaagaacctaaaaatgttcttctcaaaaagccaatgaagttgtacaaaatatcactttactgcctttcagataagcttattatagcatgatgaaactgactaattccaagctacaagaaaaagtagaggaaacgggggaaagacctgtctatatatgacctcagattctgaagttcatatatatatttttcttttttttttttcttgagatggagtcttgttctgtcacccaggctggggtgcagtggcatgatcttggctcactgcatcctccactgcctgggttcaagcgattctcccacctcaccttcccatgtagctgggattacaggcatctgccaccatgcccagctatatattttctaacttaatgattaacactactttttaaagaggttgtaatttttacatcatttctgataaaactgaagatatcatagtacaccttcattttatctacgtttatgcttttatgtttaaaattttgaaatgctcaaatctttcatgtaatttgttttccatatacaattttaaattctgaaaacatgttcaggaaaagcagaaaccatttttaaaaagatatattacataaaaaatgtaaatgtatctacatatcaaaacaaataaataaaagtaaaggcaaataaccaacaagaaaaatatttgcatcgggtgactgagaagggttaacattcctaaaggactctaataaataaattataaatttaaataactttaaaatgaaataagaaaatatatcagtaaatcaaaaagattagccaaacataagatctaaaatatattgaatgtttacatcaagcattattctaaacgcatcatctgtattaactcaatccttgaaacacacaataaggttgatagttactgacatcattaaacacatgagaagaccgtggaaaagagaggtcgactggtaatataaaaggccaaaagtagaaaagcattttatttcattaacatttaaaaacatacatattaaataaggagattatttttctattaaaagttatacttttttcaatctaaatgtaataaattttcattgtaacatttttgtaaaatagaagaaaataacattttaaaaaagtgatccaaggccgggcacagtggctcaagcctgtaatcccagcactctgggaggccgaggcgggcggatcatgaggtcagaagttcaagacaagcctggccaacatggtgaaaccccgtctctactaaaaatacaaaaattagctgggcatggtggtgcccgcctgtaatcccagctactcgggaggctgaggcaggagaattgcttgaacctgggaagcggaggttgcagtgtgagctgagatcgcaccactgcacttccagcctaggaaatagaatgagactccatctcaaaaaaaaaaagaaaaaaaaaagtgatccaaaaccaataatttcccctcctttgagcaatttggtgtacttccctgcaagctttgtctttgcacagtttgtattacacagctttgatcatccagtacagagaattttgtagcttattttatttttattttattttatttttttgagacagagtcttgctctgtcacccagactggagtgcagtggcgcaatctcagctcatggcaacctccgtttcctgagttcaggcaattctcctgtctcaacctcctgagtagctgggattacagatgtctgccaccatgcccagccattttttggtaatttttagtagagacagggtttcgccatgttggctagggtggtctcaaactcctgacctcaggtgatccgctagcctcggcctcccaaagtgctaggattacaggcatgagccaccacgcccggcctttgtagcttattttaaaaaatttttaatataagtgtttttcttttgttttcttttttgagacagagtctcgctctgtcgcccaggctagagtgcagtggtgtgatctcggctcattgccagctctgcctcccgggttcatgccattctcctgcctcagcctcccgaggagctgggattacaggcgcccgccaccacgcctggctaattttttgtatttttagtagagatggggtttcaccgtgttagccaggatggtctcgatctcctgacctcaagatccgcccacctcggcctcccaaagtgctgggattacaggtgtgagccaccgagcccggcttaatataagtatttttctataaacacagtttatacctttctagccttaaaaataaagaaagccaacagtattttctgggtgacaggactactggtagttttaattttttttttccacttctctgtactttccaaaattgcttcaacaagcatattttttctttaaaaattcttaaatattaaaataacttgtgcaaatgaaaatagagagcctagatatgtattttttaaaaacataaaaacacttacccatacgaataagtgagcattcagaacttgagctagcaggaggaggactaagatgatgtgtgagcaactctttgtaatggctttcatctaaaataacatggtacgtgcctaacaagatgaaaagggaaaaaaaaacaccttcatagacataacgaactgtacgttctatgtaattctgtaaaagttgtatcatctgaaaatgtacatttttaaaataatgattttagctaaattatcacttttaaaaccttatttaagtaatatatctaaatcaacttctctaggaataactataattacaattgattattattactattattattattttaacatataaatagagacaggtctcactatgttaaccagactgatctcaaacttctggcctcaagtgattctcctgccttggcctaccaaaatgttgagattacaggcatgagctatcatgcctggcctgtaattacaatttaattaaagacaagttataaaatctttataaagaattacatacagtaaaatttccagctttccaagagttataatacctcctctaaatactgacataagtactgaaaactctttgcatttggagatgatttcttatggaatcaatgatatatttaagatgactgcccatattttagactactttaagtttagtagctcagaacagattaaaacatcctaatttaattaataaattatttcctacacagtaattataagcaaatattaaataaattatatatataccaccagtttcacgagcaagtacagtgcaaacgcgaacttctgcagacaatccaataacagatactctaattttagctgcctttagggtcttcataaaatccaagtagatagatagttttaggaaagaagaaaaacatttaagatttaatgtatttgaaaaataaagaatgctctgaaaactagtaataaattcaatacatctaacacaaagatgaatcacacatacaaaaatacatatatatataaatcaatttgctacagaattctctttacagttataactttggttttgattttttggtctaccttgattagatcataaatattagatggatcgcaagttgtaaggctgctaaagatgattagtacttctcgacttgtatgtccaggcatgtgtcttaaaagaaagataaaatacactccaattaggtacaacaaattatactaccaaaaaatttacccagaaagaacagtaaacataggattacacatttagactatagaatatctcatttgtttcaacaatgcaaagaaaggttgtgagtatattttaaacactttaatgcaaatttttctaaaatgagctatgcacttcaaaaaattgttaattgattcatttaatatttaccaagtactctcaagttctgggggtagagtgataaacaagactgacaatgttcccgacatcattaagcttacattctagtaggtttgtttcatacaaagtctagagtatacaataaaaaatacaacaatatatggataaactttaaactaaaatgtggcaatatcatatggatcagctttaaagtgcagagatgtggcttcaaaacagtaacacacacttctttctcaaagactatagtagtcccctcttatctgcagaggatacattccaagacccccagtggatacctgaaatcaaggatagtactgaaccctatatatacagtcgttcttcggtatccttgggggattgatttcaggccctcctatggataccaaaatctgcagatgttcaagtcccagatacaaaagggcgtagtatttgcatataacctatgtacatcctcccatatattttaagtcatctctagattattgataatacctaatacaatgtatactatgtaagtaattgttatcctctattatttaggggataatggcaagaaaaaatgtctatttgttcagtacaggtacaatttttttccaaaaatttttgatgcgtggttgatcgaattcccaggattcagagggctgattataccatgtttttccctatacaggcataccttggagatactgcagggttggattccagaccgcagcaataaagcaaatatcacaataaatatttgcaataaagcaagtcacatgaactttcaggtttcctagtgtatataaaagttctgtttacggccagggatggtgactcacgcctgtattcccagcactttgggaggctgaagcgggcacatcacgaggtcaggagatcgagaccatcctggctaacacggtgaaaccccgtctctactaaaaatacaaaaaaatgagccggacgtggtggcaggagaatggtgtgaacccaggaggcggagcttacagtgagccaagattgcgccactgcactccagcctgggcgacagagcgagactccgtctcaaaaaaaaaaaaagaaagaaaaagaaaagttctgtttacactatactgtagtctagtaagtgtgcaacagcattatatctaaaaaaaaaagtacacacctttatgaaaaatactttattgctaaaaatcgactgaactgtcagtgaataatatctttttgttgaaggagagtcttgccttgatattgatggctgctgactgatcagagtggtgctttctgaagggtgaggtggctatggcaatttcttaaaataagacaaagtagtttgttacatgggtcaactcttcctttcatgaaaggaatgcaaatgctgtttggtagcattttattcatagtagtacctctttcaaaatgggagtcattcctttgaaaccccactgatgctttaccaactaagtttatgggctattctttttttgttttgagactgattcttgctctgacacccaggctggagtgcagtggtgcgatctcggctcactgcaacctctgcctcctgggttcaagcaattctcctgccttagcctccccagtagctgggattacaggcatgcaccaccatgcccagataatttttgtatttttagtgaggacgggtttcaccatgttggccagactagtcttgaactcctgacctcaagtgatccatccgcctcggcctcccaatgtgctgggattacaggcatgagccaccatgcccagccagtgtagatattttgacctctttctatgaatggcatttagaatggtgaattctttccagaaggttttcaatgtactttgctcagatccatctatggcagtcacagccttatgatatgtatttcttaaataatcaagacgtgaaagttcaaagtattcctttatccaagggttgcagaatgagtgctatgttagtagatatgaaaataacattaatcttcttgtacatctcaattagagctcttgggtgactgggtgcattgtcaatgagcaataatattttgaaataaatcttttttctgagatatatctcaacaatgggcttaaaatattcagtaagcccatgctgtaaacagatgtgctgttatctgggctttgttattccatttgcagagcacagactgaatagatttagaataattcttaaggactctaggattttcagaatggtaacaaacattggtgccaacatcaagtcaccagctgtattagcccctaacaagagaagaagcctatcccatgaagctctgaaaccaggcattcacttcttctagctatgaaaatcctagatggcatctccttccaacagaaggctgtttcatttacattgaaaatatgaggccaggtgcagtggctcatgcttgtaatcccagcactttgggaggcagaggcggaggactgcttgagcccaggagttcaagaccagctgggcaatgtggcgaaaccctacctctacaacaacaacaacaacaaaaattagctgggtgtggtggcacatgcctgtagtccctgctacttgtggggctgggagaatagcttgagcctgggagtttgaggctgcagtgatccatgattgcaccactgcactctaacctgggtgacagagcgagaccctctctcaaaaacaaaaaagaaaaagaaaatttgatatttagtgtagtcaccttcatcaattattttagctagatcttctggataacttgctgcagcttctacatcagcacttgctgcttcctcttgcactttttttttttttattttgagacggagtctcacagtgtcgtctgggctaaagtgcaatggcgcgatctcggctcactgcaacctctgcctcctgggttcatgcgattctcctgcctcagcctcccgagtagctgggattataggcgcacaccaccacacctggctaattttttgtatttttagtagagacagcgtttcactatgttggccagactggtcttgaactcctgacctcatgatctgcccaccttggcctcccaaagtgctgggatgacaggcgtgagccaccgcgcccagcccctcttacacttttatgttttggagatggcttctttcattaacctcatgagctcagctctgttagcttcaaacttttcttctgcagcttcctcactgctctcagccttcatagaattgaagagaattagagccttgctttggattaggatttgacttaatggactgttgtggctactttaatcttctatctagaccattaaaactttgtctgtatcagcaataaagctgtttcactttcttatcattcatgtgtccactgaagcagcactttgaatttccattatttttttcttattttgagacaggatcttgctctatcatacaagctggagtacagtagcacaatcgtagctcactgcagcctcaaactactgggctcaatcctcctgcctcagcctcctgagaagttagggactacatacaggtgctcgccactgtgcctggctaattttttttttttttttttttttgtagagatggaggtcttgctatgttaccaggactggtctcaaactcatggcctcaggtgatcctcccatcttagcctcccaaagtgttgcagttacaggtaagagccaccacgcacagcccagcactttcaatttccttcaagaactttacctttgcattcacaatgtgactaagtgtttagcacaagagacctagccttcagccagtcttgcattttgacatgccttcctcactaagctcaatcatttctagcttttgatttaaagtgagacatgcgactcctccttactcttgaacactcagaggccactggagggttattattggtgtaacttgaatatttttgtgtcttaggagatgggggggccgaacagagggagagagactggaaaacagccagttggtggagcagtcagaacacacgtaacacttatcaattaagtctgttgtcttatatgggcgcagtttgtggtgccctaaaataattacaatagtaacatcaaagatcactgatcacagatcaccataacagatataacaataatttacaaagcttgaaatattgcaagaactaccaaagtgtgatatagaggcaagaagtgagcacatgctgttaaaaaaaaatggcaccaacagacttgctcaacagagttgccataaactgtcagtttgtaaaaaaaaaagttatctgaaaagtgcaataaaagtgcaacaaaatgaggtgtgccttacatacacacctatgatcaataatgtataaattaggcacaataagagattaacaacaataactaataatggaacatttataacaacgtgccggcatcactactcctgcactttgaggtcattattaagtaaaataacacaaacactgcaatagttttgacagtcaataacaacagttaatctgatgacttaggccattacatgggtgggcagcatatactgtgaggatctacaggaccaagggatgattcacgtcctgggcaggacagagagggaaggtgtaggatctcatcacgctacccagaatggcacacaacttaaatcttatgaattatttattactgaagttttcaatttaatattttcagaccaagagtaactaaaactggaaagtgaaactgcagataaggggggattactataatttaacctcacagtaattcagagtcataataatcatgaacattaatattgcataccatttaattaaaatgatagcttgtagagttttaagttgtggtgaccagttttcacctacactaaatagacgtttttatgctttctgcagcaattttatcaattagttatagctttcctgcttatattttcattgttatcgtctcagctctcactggtagaccctactactgtacttacctctattacatgtgttgcctccttctcatccacttcaaaactagaaaaatatctattatataaaggtataagtctgagccagggcagactatccagagataaaatatataagctttagggaggctgaggtgggcggatcgcttgaggccaggagttcaagaccagcctggctaacatgatgaaaccccatctgtactaaaaatacaaaaattggctgggcatggtggcacacacctgtaatcccagcactagggaggctgaggcacaagaatcacttgaacccagaggtggaggttgtagtgagctgagatcacgccactgcatgccagcctgggtgacagagcaagactctgtctcgaaaaaatatatatatatacgtgtgtgtgtgtgtgtgtgtgtgtgtgtgtgtgtgtgtatatataatagatatataagctttaacttatatatgtaagtttaacatatatataagctttatatatatgtataataaattatatatataatatgtatataaagcttatatatatatataagctttaactataccaagtatttcctttggggtcttagctctattccatatagctgaacttgccatatctattaatttacagatatatgacattggtgcaaaaggaattgtggttttggccattactttcaaaataaaataataaatgttaataaaggtacaaccaacttacaattattatactatattaaatctcattttaataaaatattttttcatcaacctatttttgtactattgatactgccgacagttttaaattatatttttataaaacctttaacaatatcttactaaaatgtaaaataaaaattactaaccaacaccacactaaacatcataaataacactacataattctcgtacttaacaattttgttatagctgggtttatgggccccatattaacacatcacttcaacttaactcatttaaaaaacttctaattcaattatacataatgtataatactaactttagagtctgcatagccatgcttagggaattataaagagatggctctccatggcaggtcatatccacagcttccttcaaagacgttatatgttttcttgggtttcctaaaatagaaataaggtctttaaataaaatcctatatattaaaaaagtttatgtttctctcaaaatttacatatctatgatgttaaagaacagaatcctttcaatgtatatttctgttggaattttatctgcaatattttgtaaacactctcacttcatactgaaaaacagaatacaaataatctccttatagactagcatacatattttaaaataatgctaacctagagtgcatttttttactcttaatatttccatatttcatcatttttaagaccaatacattttcacatttaacatctctgaaatcagcatgtgtttaataattactggtagccagcagcacttgtaacatagtctttgcctgttcatatgtgaacctacaaataggtcttcatatgttgttgcttcaattgcattatgtacattgtcctcttcatggtgagtttaactgccatttaaaatgtttttaaggccaggcgcggtggctcacgcctgtaatcccagcactctgggagaccacggcaggcagataacctgaggtcaggagtttaagacacacctggtcaacatggtgtaaatcccatctgtagtaaaaatgcaaaaattagctgggtatggtggcatacacctgtaatcccagccactagggaggctgaggcacaagaatcacttaaacccagaaggtggaggttgcagtgagctgagattgcaccaccgcactccagcctgggcaacaacagcgaaactccatctcaaaaaacaaacaataaaatgtttttagaaatgttgttaatacaaaaggctatatttttatgtagaaaggtgtggaacacagcagtgaggcataaatttattataatgaatcaaatattgatggaagaatgcatgcaattccgtatttttcttgagggaagaaatcaagaactttacaagacctaagaaacgaatattcccacaaacagacgaggctgtgttatcttaccaaatagcatctgaaaagattgtctatcttatgctaagcaattcaaatgaaggggggagaagctgccaaatccttttttttctttttaatataatatttttttatattatttatatttagattatatatatatctgttgccaggctggagtgcaatggggcaattttggctcaatgcaacttccacctcccaggctcaaaccatcctcccacctcaacctcccaagtagctgggactacaagtgcccagcaccacacttggctaaatttttttgtatatttttggtagagacagggtttcaccatgttgtccaggctagtcctgaactcctggattcaagcaatcctcccgcctcagcctctcaaagtgctgggagtacaggtgtaagtcaccacacctggcccccaaatttgagatgtctgtacatgtcaaattaccaagaagctagtatagccaactcatatatcatttgatactgtgtcaaagtttaactactaggacttttccttcttaatggcttataaaagtatcttgtaattgatggaatctgagtttcaatgaaatatagtattccgtaaacattttccatttcagcactgtcttcgtatcaatcaataacctaagtatcattaaattgattttgtcataaaatataatccatcaaagcatactattaaacatttaatttttaatctgtcactattatacataatgttacaaagagtatctttgtagagtgatcattctccttccataacattccctaaatataatttcaggaacaatttttatgcttttctaaaaaatattgaactaatttgtaagactatcagcactataaataacagtttctctgtggttccacaagcaacatattgctttggaaacttaattttgctcatttaaaatatattaaaaaataaaatgttatgtaattgggtagagtgtttttggattactagtttccctgatttaatttctgggttttttctgtgtgaatcatgtcttctttgtctattcatcaacttggagctcccttgagtttttactcatctgagtaagttttaaaatattaaccatttgtaatatttaatatttactgcaagtattttagattcataaattttagagatgaaaagtacctcgctaagcagtccaaatccctcacttcataagtgagaaaattaatctaaacaagtgaaatgacttgcccaaagacatatgcctgcttaactgcaggaccagcagcacccaaacctagatctcctggctctctatccacttctcttcctaccctacaaaattatttttaatctcccactgtgttatgggtataggaaaaaagcatactacaatagtgtcagtgtggtttacagcagtggtctgattggagggaaaaaaaggtggcttcaagaggcctgtcagaatctccagaatatttttcatctttatacatgacttcactaacatccatagaaaactgctggggccgggcatggtggctgatgcctgtaatcccaacactttgggaggctgaggtgggtagatcacctgaggtcaggagttcgagatcagcctggccagcatggtgaaatcctgtctctactaaaaataaaattagccaggtgtggcagcgcacacctgtaatcccagctactcgggagggggaggcaggagaatctcttgaacccgggaggcggaggttgcagtgagccaagacagcaccgcctgggcgacagagtgagagactccttctcaaaaaaaaaaaaaagaagcaatagaaaactgctggtaactcggggtgggtaaagtgagaggaaaatattgaccttatattcctaccttggaggaaccatccttcttccactatataataatcctgcttagttcatgtggtgctgaccctacttctatcctgctctgggcatcagcaggcaatcgaagcgtacaaacaaaatacttcatttcctggccactttgttcatggatgggcagatcgtaactcaggccaatcagagttctccctagacgtgtgctgaagctataggctacgggtacaatgtagaactgggacaattaagagacatcttttcaacttccagaaaatctatcagagaatgaagccagacaaagccaggaccccaacatatgcagcaactatatatggaattggcccacctttgaacatagcccaaaattttccttctgcacttaagctagtgtgacattcttttggttactcacaactgagtttcttgaatcactccaggccaatgtacatttcactcctcactgcatttaatgaaaaactactaatgaagaaagtatgtcatttcccttatgtgtgccggcaaggataaaaggttgaaaaccagatttaagggagagtgtatttcacagaaaataaaatagaatcagtgatgcaaatttgtaacagcatatatatcaaagcaaataaaaaatgccattactacgttttgaaactaaaattcagttaggtatgtcatggaagcagaaaaattgattcattagcaatagctacagtttaatttttatactttttcccttttaaattagatgcttaactttttaagaatttaattttaagattaactggattttataaatgattacaataactgtattttaatatcttcaggataaggccggatgcggtggctcaagcctgtaatcccagcactttgagaggctgaggcgggctgatcacaaggtcaagagattgagaccatactggccaacatggtgaaaccccgtatctactaaaatacaaaaaattagcagggcgtggtggcgggcatctgtagttccagctactcaggaggctgaggcagggaatcgcttgaacccgtgaggcggactttgcagtgatccgaaattgtgccactgcactctagcctggcgacagagcaagactccatctccaaaaaaaaaaaaaaaaaaaaaaaaggaaagaaaaaaaaatttcaggataagcacatatagaatttaaataaaaacatttatattcaatgtagtattatttaccactatgatgcagaactcaatttagaatagttaaccttgtatcctaagaatataatggtgggggagatgttattaaattgtttcacctagagaagacagaggaaccacccttcacgttacttattaagcagccatataaacagggctacgaggttgggtaaataaagcaaagtccttgagtcatgtaaaggtaattttatgcatacctgaaagttcagtcaatttttcagctcttttactcttagttacaattattccaatcttgaaataaaaacaaaaattattattaatataacaagttatttcctcccattaagaatatatataactattcctgtagatgatattggagcagaaaaaaaaataatttatatagctaaaataaactagtaattacaaaagaaagaagcaacaggtgagaaactttttctcatgctgtttttggcaaataaatttagctatgagttcacattacgtttaacttttagagttattacgcttttcatttttaagtataccagaaactggttaaacaatttgggtaattcacaaaatacatgtccaatttttaaaaataaattacatttggaagcaaaataggaatctaattctgaattctatcacttagatacgtacctgactaataggattttgatcaaaatattcctctacaaagtattccaacaactgtttaaacaaaaaaagacatactagataaaggcaaaataacaatcataaagaacatgtccaactgatgtttgtgaaacctgttaatcaagcgtcacttctcatgacttttaaacttacagattttcaaaaactgttaagtaataaaaatattaaacagtaaaaacgttaatttgaaatggtgggtgatgagataggtttgagctaggttttaaaagatggaaccatttggatgtgtcagaagaaatttcaatgaggaaaagatccaatgaagagagatgggagaacgagcagaattgagaataggttttgataaattaggaatacgaacatatttgtaatctgaggagacagagttaagtaaggcaaaggagaatgaagattcaagaaagaaaagggataactgataaaccaagatcctgatgtggggtgggaggatagaaattaaaaacacaaataattagctatgttggtttaaaatttccctaaataacctggcagtacttctacttagctatcattagcattaactaaaaatacaaggcaaaaaataaaaaatattgcattctttaaaaatatcctttagaatccagtgttcttccccacttttttagtaaaagtttaagtgattttggtacaaatttaaatgatttagtataaacttaaattttacctttaaagtacacgtcagtctattaggctttaaatcttggtcttccattgttcttgatccatctactaccacataaaggtggcgcatctatcggaaaaaagaaagggccaatttcaagtacttgttttgttttgtagaaactgggtctcgttctgttgcccaggttggtctcaaactcctgggctcaagcaatcctcctgccttggcctcccaaagtgctgggattataggcatgagccactgtgcccagcctcaagtgccattttgactagtaaaaatggcatttaataattacatattctatgcacgtatttttaacatattcttttaaaaactttgttgttttgctattgttttttctagcaagacagaatgtttctctaacctaaactagttctgtactagtaaaagaaaaaataatgacataccattccaagtcgaacttgtccatggtgctcaaatactctgttaaaattatacaaacattttaatgtaattccatatactatccccccccacaaaaaaaaatacaactttccaattgacctcctttgtttttctttttttctaattctgattaagaatgtcataacgtgcatttttagtggagtaaataattaacttatggaatacaatacacataattataggtattgtagacagtctctaaagaccatttcctgctggggcaagggtaggtggctagttctttccccatagtcagaaggcaataggtcagtttccctgaaacacagctaaaatgaagtactgaggagtatttatagatagaaaggcttaaaatgaatatattttacctttttaagatacgtaggaaggttacatacctttttctctttgccttgaatagaatgtcttctattgtagctttaagtgatccagattcatcttctttaagaatctccctataagtcataattatttgtttgaaaagacaagctaaaatgattactagcccaaatgaaatgaaaatatatgtccacacaaagatttgcatgtaagtgttcatggctgcattttcctaacagtcaaaaactgtaaagaacctaaatatccacagactagtgaatggataaacaataatgtggcataaccatagatgggaatactattcagcaataaaaaaggaatgaagtattaatacacactgcaacatggatgagtcttaaaaataagtgaaagccagccacaacagaccaactattatagtcatgcatcgcttactgacagggatacattctgagaaatgcattgttaggcaatttcattattgtgtgaatatcacagggtatacttacacaaacctagatggtatagcctatcccacgcctaggttacaaacctgtacagcacgttactatactgaatatcttaagacaactgtaacacaatgttcagtatttgtatatctaaacatacatagaaaaggtagagtaaaaatacagtattataatattatgggaccattgtcatatatgcagtctgtctttgaccaaaacatcattatgtggcacatgattgtatatgatcacatttttgtgaaatgtccagaaaaggttaaaatttggagacaaaaagtagactaatgattgcccacaggtggaattaaattaagatttaaattaattgtaaatgaatgtgaaggatcttactggagtggttacaatattctaaaactggtttatgataatggctgcacagctcagtaaattattaataaaacatcactgaattgtacattggaaatgggtgaattttaacatatgtaaaatatactttaataaagttgtaaagaaaaaaaaagacattgtctaaaagaaaagacagggcaataaagctctccttaccatgttctttcatagcctccttcccatcgcttagttctttcaggttcttcatccatttttttcaaaactgtattttattattcaataatctgtaaaaaccattagaatgtaagttatctaaagatgtttgttacaaaattcatccaattaaatttgaaaattagacacatatataaagtaaaaaaaatggaatgccaggtcatcttattctttgtattttactcaataattgtcttaaaaatcttcatagaactccatttctcatttccaagaaataatatgaacttatacacaaacttggtaccaataaaaataagtgtctttttacaatttgtaaaagaacaaaaatgctttatagatgtgtcacatgacaaactgtagacttgtgaggagtcagtatgggcgtagttgaactattatagctgagtgacatgtgattcattgtactatctctctgtgtatgtctcaattttctcataatcaaaagtttttaaatcacatttattatttataaatgggtaaatgctatagctcataattcaaaaaaaaaggacacaaaattaaacatagttctttgagacatctccaaactgctttccatagtggctgaactaatttacattcctaccaacagtggataagcattcccttttcttcacaaccttgccaacatctgttattttttgactttttaataatatccattctaactggtggtgagatgggtttgtggttttgatttacattgtggttttggtttgcatttctctaatgatcagtgatgttgaacattttttcatacatttattggacacatgtatgtcgatccaacaatcccaatactgggtataaacccaaaggaaaataaaaccattctaccaaaagtacaagagcactcatattaatcacagcactatccaaaatagcaaagacatcacatcaacttagatgctcataaatggtggactggataaagaaaatgtggtacgtaatatatcatggaatactagcagccaaaaaaacaacgaaaaaaaaacacaatgaaatcctgtcttttgcagcaacatggatacagctggaggccattatcctcatcgaattaacacgaacagaggcccaacgcaatggctcacgcctgtaatcctagcacttgggaggccaaggcaagtggatcacctgaggtcaggagtttgaaaccagcctggccaacatggtgaaaccctgtctctactaaaaatagaaaaaaattagccagatgtggtggcgagcacctgtaatcccatctactcaggaggctgaggcaggagaattgcttgaacccggaaggcagagaggttgcagtgagccgagatcgtgccactgcactctggcctaaaaaaaacagcaacagaaaaccaaagacggcatgttctcatttacgagtggaaactaaacactgagtacacgtggacataacgatgagaacaacagacattggagactattagacagggaaggatgggaaagagtgagggttgaaaaactgcctatcaggtactatgtttactaccagggtgacgggatcatttgtataccaaacctcaacaacaagcaatttatccatgtaaccaacatgcacacgtactctgtgaaaataaaagttgaaaacaaaacaaaacaaacaaacacaggccagggccaggtgcagtggctccatccctgtaatccctgcacttttgagaggacaaggtgcggatcacctgaggtcaggagttcgagaccagtcaggccaacatggcaacacccgtctctactaaaaatacataaattagttgggcatggtggcaggtgcctgtaatcccagctactagggaggctgaggcaggagaattccttgaacctggagggcagaagctgcaatgagccaaggtcacaccacttcactccagcctgggtgacagagcaagactccgtctcaaaaaaaaaaaaaaaaaaaaaaaaccaggccgggtatgatggctgacatctgtaattctagcactttgggagactaaagcaggtgatcacttgaggtcaggagtttgaaaattagctaggaggttggtgggagcgggcccctgtaatcccagctactggggaggctgagacaagaggactgcttgaacccaggaggcacggaggctgcagtgagccgagatcaggtcactgcactccagcctgggcaacagaatgagaccctgcctcaaaaaagaaagaaaagaaaggaaagaaagagagagagagaaacgggcacggtggctcatcctgtaatcccagcactttgggaggccgaggccagcagatcatttcaggtcaggagttcaagaccaggctggccaacatagtgaaatgccgtctccactagaaatacaaaaatcagcagggcctagtggtgcacacctgtaatcccagctactcgggaggctgaggcaggagaatcacttgaacctgggaggtagacactggagcgagccaaggttgtgccactgcactccagcctgggtgagagagcgagactctgtcattcattcattcatgcacaaataaatgtcctcatcacacctccatcctccccaatgcaatctccctcccaactccaccacctcgtggctcactgcaacctccacctcccgggttcaagtgattctcctgtctcagcctcccaaggagctgggattgcaggcgcgtgccaccatgcccagctaatttttgtatttttagtacagtcagggttttgccatgttttatatttttgtagagccagggtttcgcctgacttgccaggctgatctcaaactcctgacctcaagtgatctgcctgtaaacagaatatttttgtttctttttttgttttaaggcggagtttcactcaccacccaggctggagtgcaatggcgcgatctcggctcactgcaacctccgcctccgagttcaagtgatcctcctgcctcagcctcccgagtagctgggattacaagagcccaccaccacacctggctaacttttgtgtttttagtagaaatggggttttgccatggtggccaggctggtctcgaactcctgacctcaggtgacccactcacctcggcctcccaaagtgctgggattacaggcgtgagtcaccacacccagcctcaactgaacattttgctcctccctgttttctgttacgtattgtgaactttaaaaatgaaaaactcgcataacgttctcaacgtttttaaactcaaattcttcgcagggcacagtggctcaaacctgtaatcccagcactttgagaggccaaggcaaaaggattgcttgagttcaggcgctcagatcagcctgggcaataaccttgtctctacaaaacatcaaaaaattagctgggcgaggtggcgagtacttgagtcccagctacttgggaagcaaaagtgggaggatggcttgagcccaggagagtcgaggctactatgttcactactgcactccagactgggtgacagagtgagaccctatctcaaaataaataaaataattacaaatatataataaatattataaatataaaagtaaatagcaactgagagacttttggctgaccatatcaaaggaattcttttttttcttttttttctgagacaagagtcttgctctgtcgcccaagcttggagtgcagtgacgcaatctcggctcactgcaacctccgcctccagggttcaagcgattctactgtctcttctgtctcccgaatagctgagattaaggcacacgccaccacagctaacctttttatttttagtagagacggggtttcaccagcctgttggccaggcctggtctcgaattcctgaccacaactggtccgcccacctcggtcctccaaagtgttgggattacaggcatgagtcaccacgcccggctaaaaggacttcttaattagagctgcctgcaatgggaaatccgactggacaggaggtattaaggtccctaaaactgcagacgttcaatgggaagtctgattgtaaacatgcatgctgtttaaaggattcatgcatcctgaagatggactttgtaaagatctccaatggcctgtcacttcccaacagtccattttcttcttaaaaatatcaccgaggccaggtgggtggctcacacctgtaatcccagcactgtgggaggccgaggcgggaggatcacgaggtcaagaaatcaagaccatcctagccaacatggtgaaaccccgtctctactgaaaatacaaaaattagctgggcgtggtggcacgcgcctgtagttccagctactcgggaggctgaggaaggagaatcgcttgaacccgggaggtggaggttgcagtgagccgagatcgcgccgctgcactccagcctggcgacagggcgagactccgtctcgaagaaaaaaaaatttttttaagtgatctgtttcctggaatccaaccccaaacaatccacgttcctcagcataagcctactggtgtgattcccgttacatgagctcggaatgctatctgccaacaaatgagagcaccaaacatcccaatttaagaagcttttcttcacaccttaccaagctatgtgaaactggcaagggtgattactgtccttgtttttcaggtatgggattcaggctcagaggttggtcactttctcaagcgggtcacaaactcgaaccctgaaccatcatttctaaaagtcgcgcttttacttagggagagacggcctgcagcttccctccctactctgcggctccccagacgaaagttaccttcctctgccttcacaagctccttcacatcctccttccctatgagcccaggcagggcaattcaacctccgttccccgccacgaaaacgctcccagccgcctagctagtcagacggcctgccccacctctgcgcctcacagacttccacacgcggactcaccggcgccgctagaaggactctcagccggaaactcagcccgacactcctctccgccgctttaggggcgccccggaagtcattccgccgcgccctgcggccacgccgaaacgttccggatgctgcagagtgcagctgccggagcggggcgctcaggtgcagggcatggcctccgctgagttggggcgcggaaagggacggtgttccagctggaattcgcagagaaccggaaagagtgatcgccattcgctctcggaaggtcgaaggctctgcagccatcgacctgggttctgaggagctcgatcttgtctttctacttctaaaaggttgggatgaaggaccctggccacagaagtaaagccagaattatccttgcttcttgctgtgtatttcaggactcctccattgctcttgctgttcattcaacaaacattgagcatctactttgagcctgatgcatgtctaagcactgaggaaataacaatgaaaaactgacaaaaatccttgctctcgtggagttttccttctccaaggggagtcagtatgaagaaaaacatatactatatgaaatggtgataatgctgtggagaaaaactaagcactgaaggggagaagtttgcagtttaaaatagggtggccaggccgggtgcgatggttcacgcctgtaatcccaggcatggtgatttgggaggccgagcgggggtggatcatcggagggcaggacttcgagaccagcctggccaacatagtgaattccgtctctactaaaaatacaaaaacattagccgggcgtgctggcaggcgcctgtaatcccagctactcgggaggctgaggcaggagaatcgcttgaatccaggaggcacaggttgcagtgagccaaccttgcactccagcctgggtgacagagacttcatctcaaaaaataaaatagggtggccagaggagtcctcgctgggaagacagttaagccatgacctgaatgaggaagggtgttaaccctgctgatacctaggggaaaagctcttcagacaaagagagctgcaagtgcaaaggccctgaggtagaagtgcattggggtctttgacgactgcaggagtgagcaggggatgagtggtggaagctgcaatcagaagggtaaggtggggaggagaggctgtgagcactgttaagaactttgggggaattgtgatggcttggaccagcagctggtgagaagtgactgaattctaaatcttaccaatacactggatgtgtgttatgagaaaagaatcaaggatacctccatagtctttagctgagcaactgaaaggttggggttgcaattattaaaatgttggcggggtgggtaagatcaattcagttttggacaagttgtatgactgccaattaacacaagtggaattactggcatttcccatacttgagaaatggagaggcagtgcacccccagatgagaaaagggttaggaataacacaaaggaactgcagaagctagggcctctttccttccccatcagcatactcatcccctccattgcctttattttattgttaaaaatttttcccatctctgttgtctccctcaaaaatataaacagaaggtatcttgcatagcagtggaaagaacagccctggatttaaaatcaggctctgacacactggctgggtgacctcaagcaagtcacaacccaagtctatgaactaatgtgtaaaatggggttgtctccaccaaccctgcagggcttagtgggaactccataatcagtctcatttcctcccagaagacaggattttaaaagggagaggaggggaaattagtatcgcagtgccaggaagcttccatgcttgcctccctcccacctttgacctcattagaggactcacacacaaattccacacttttccttttgtgcccttccttcctatccacacttttgcttccttccatcttaattgaccatcctatttgcaagacgggatgcattcctctaggacaaacagcctagaggaatcccaagccccaagtttcttgcatatgtttgttatccatcagcctgggaaggctttaaggaaaaccaggaaaaagatagaggactccccaataaatataaagcatatttgcgaagagaggagactgaaacagttttcccaactgtaatatttgttctgtatagattttagacatggatgttaagattcaactaggaatggtactacagcaaaacaaaatatgcataaatccataatctcttggcatgattatgactgacatattctaatcatttacaaagtggtagaataaattatctaacctactcagatgttttttcaacttgtaaaactaaaagacaactataaagaatggataatctgttctttgcccatgagtggccagacacaatcaacagggttaggacattcacaatcagctcagccagtggaatcagatataaaaagcatgcaacttgaaagactgggagaagtgaacctgtctattccaatagacaggctcccttacagggaaactaaatcattccagaaagcctcatctaaaacctctgtaattgacaacagtatctaacaattgtgatcttgataagtaaactatttgctctaacctaaagaagcatttgtttatcatgtacaaatatttagaatgccaatcctgcattctctgcctagaattcaaaagaatttacattctaaggctgcacccagcacagatcaatcatatgggattggatgacacatgcacttttaaaaaacacaatttgcttttagaaaacttgttaaagtttcaccttctggctttggaagatgggggtagctaggcatatttacttttagacaaggactgagtcacacattaactaccttcttaactatgagattattacaaatatattttacaaatacaaaaaactgaagtacagagaggctaagttaatttctccaaggtcccacagcaagtaactgcagaagggcaaagcaaaaataggacaacacatgtaggcaataccaagcagttcttgtggcagcaattggaaaccttttggagacaccattctgcatttcgttgtagtcatacacaaaaccctagttatgtatccatgcttctttctcataatgccaaagtggcactattctaatttactaacaaggttttctaaaaactacccaaattattgaggtgtttttgctcacttcttcccattagaataaatgtagacaataagaaacgcatgagggatgacatagtcctccatcaaatctgtcctttcacacaagagatggcatggtgtagtgtagcagaatcatgagctgccaggaaattatgaattctgattcctccagctgagtctttgaaaaagtccagatgagaaacacttccatcctgatgctgaagcaaggagaatgtccttgtgtgaggaattctcacaacaccaactgaagctaaggtccccggagccatgataaaagcacttttctgccctgattcttctttacacacatgtacccattcaggtctttacagatatttcacaggaagcatttatgttacaagtacttaaaatgcactcgaaattaatataggatactttatttacatcagagtgatctcacattatccaatccattaacaaagtcaacacaggatggaagtatagaatctaacagttgaagagactaagatcctaatcccttgttttgccacttgctagtgtgacaacagccagttaatctatcatatcattagttccttgtctataaaagaagaataagaaatggtcacatgtcaaaagatcgttgtgaggattaaatatcatatatgtacttatgtgtatgtaacttatttactataaatactagttgacttcactttatttcaaaaaatataaagcacatatgacaaaacattaacacatgttatttctgggcggatggtacttatattttatacttttctgtatttaaatttttcaaaataaaataatgatcctatatacttttaatacaaaatcacatatgtagggcatcactttatacgcagggaatctttacaaaatgaactatgtgctatcacaacaaactccttagaacaatagtttataacaaagcagaattccagacaagaactacaggtcagaaatggaagggatgtcggaaatctaatctaaacctctgactttctagactaggaagctgcttgagtggcttttcaaatttacatccagctagttaatgccaacgccaacagaaacaccctgatcctagtttcctaaaacggtatttagtataaatacacatgaaaatttttcttatttttgaaatttcaaagtccaattttataacacaattttacaatgcaaattcttgctgtttcactttctggattcagctgaatagttttgtgaaaatactgacaaacttgccttcacgaactgacttccaagaacaaattgttaaaactttaacagaaaaatcagttaaaggtgctcatcaagagaatccttttcatttggtataaatccaaaactatgaaaataccttttgtattatgtgcatgcagaaaattaagaatttattcaatttgcagaaataaatcagtgatataatggaaacatttaaaattttatctctggaaaataattcaaaatcatctatcaaaaattataggccgggcacagtggctcacgcctctaatcccagcactttgggaggccgaggtggatggatcacctgaggtcaggagttcgagaccagcctgaccaacatggagaaaccccatctctactaaaaatacaaaaaaaaaattagccaggtgtggtggcgcatgcctgtaatcccagctactcgggaggccgaggcaggagaattgtttgaacctgggaggcggaggttgtggtgagctgagatcgcgacattgcactccagcctgttcaacaagagcaaaactccatctcaaaaaaaaaaaaaaaaaaatacacacacacacacacacacacacttaggccaggcatggtggctcacgcctgtaatcccagcactttgggaggccgaggcaggcagaccacaaggtcaggagttcaagaccaacctggccactatggtaaaaccccgtctctattaaaaatacaaaaattagccacgcatggtgatgggcacctgtagtctcaactactcgagaggctgaggcaggagaattgcttgaacccgggaggtggaggttgcagtgagccaagatagcaccactgcattccagcctgggtgagagtgagactctgtctcaaaaaaaaaaaaaaattatatacctaaatatctgaaatgcatactaaagttcagtttatagattattctaaaaaaaagtttttagaaaagtctaagctgggatgatcacaatcaacttggtcagcacagtgctatcaactaattttactaataagaatctgaatttttaaaaaagtgatacaatttaagggcaccatttgaaattatttggtatttcgtggtatagcattctattcccagacatatcagcattcttacagccaaaggaatgggaaacgactaaccagcacagcatccaaaggagtataaacaacaacagatacaactcctgagtgtggttttccattgctgtatgttaacagcactaataacatcaaacaggttattatggaaagaaaacaccaggtttaataccttataaaatatgtatagaaattgaacattcctgtaagatacagttcaagtcacaattgaattataaatgtaatcagatattctgatataatgaaaagttctagttggttttttaaaaaaggcatgcaaaaagataaaaagtatttaaaaacacacaaaattctaaccacggggtttaaactttgatcttaaaaaagtaaatatatatttacaatctttaaatttcacacatttgttacttttacatgatctttattatttaagaaaaacctcttttaaccatttatataacagaaaaaaaatagggaggctggtagatcatcacatatatagtagctaaaatatgaaaggccagggaatttattattaatgaagtcataaaacagacttaaccaaaagtgtgtgctaggaaacaagcagtttcacttcagagacttcattgcaggaacccagtttccttatgtggaaaaaagtgattataaataacagttatctgaaaggtggttgagaggattaaatgagatcacctatgcaaacaaatacatgtaggtatgaagacatcgtctggggtgtgaaagtttagttcacaccagaaccttcctttaaggcttaaaaacctcaaacagtatttcattcttaatacaagaaccaatgtttaaagcataaaatccttaattggagtgttcagcccagttgattatcaaaagcgatttataaaatgcttcaatactgatgatgttaaagcaaccaaaactttgtgatgctcacagaggtttggcttccggggttatggtccaaagtcatttgccttctgagaagattgcagagatgtcagatacttaatttctcaaacaacttggcatcagccttctatgttttctgtctatcatagtctccaaccatcttcttgatgtgtgacaatttgctctttaactgcttgcaatgattcttcttacttttgtaatctgcagactaaaaagggagaaaatgaatcacataaattcaacaaaatgaaaacaggtctgctgggaaggcagaattgaacacagaaatggaatatttagtcaagagaattgctgggagtgttaattgaagtaaaatacgcaaggtgcctggcagtatcactaaccacacaggcagctgattctatttgctcagttctgtcttctaacctgggtttttccaaaggataccctcatttctaaaaatctgtaaaatgaccaagaaaacttaccagcctttttgctaacacatcatctaaaactgtaagtaaaacaagagactggtgatctcatttgactggggaaagggaagctgaataggggataagagagatgggaaattttactgtataccctttaaactcttatttcaaatcatgatgcctgtaatttataatttttttttcttattttagaaagggtctcatcctattgcccaggctggagtgaagtggtacaattatagctccctgcagctttgaactcctgggttcaagggatccttttgcctcagtctccctagtagctaggactacaggcatgtaaccacagcacctggataagtaatttacaaaaattttaatataatttttttttaatgttttaagtcaataatgactgtcatgccaagtgttagcaaggatatagggcaacaggagtctgtagtggttggtgggaatgtaaactggtacaagtactttggaaggccatttgacagtatctactaaggctggatagacaaatgcccatcacttctacgctcaaacatttacaaatatgtatgaagctgcaatatttttaaatgccaaaaattgggaacaacccaaacgttcattgacaatagaatggatgaataaagttgcattttatatacaacactacaaagcaataaaaattaatcaaccggccaggcgtggtggctcacgcctgtaatcccagcactttcggaggcggaggcaggtggatcacttgaggccaggaatttgagacctgcctggccaacatggtaaaaccccatctctactaaaaataggaaaattagccaggtgtggtggtgcttgcctgtaatcccagtggctcgggaggctgaggcaggagaattgcttgaacccaggaggcagaggttgcagtgagccgagattgtgccactgcactccagcctgggcgacagagcgagacactgtctcaggaaaaaaaaaaaaattaatgaaccatggccgggcatggtggctcatgcatgtaatcccagcactttgtgaggccaaggcagggggatcacctgaggttgggagttcaagaccagcctggccaatgtggtgaaaccatgtctttactaaaaatacaaaaattagccaggcatggtggtgcgtgcttgcaatcccagctaggctgaggcaggagaattgcttgaacctgggaggcggaagttgcagtgagctgagactgcgccactgcactccatcctgggcaacagagcaagactccgtctaaaaaaaataatagtaatgaactacaaatggacccttacaaacactatactgagcaaaagaaatcacacacaaaatacatactgtgtggttccatttatgtaatgtgcaagatagacaaaactctatgatgttagaagtgagcatgatggacccctctggagagagtgtaaacactggaaagtagtacaagtgagggtgggggtgctgggggtggggaggtactgggaaatatatttcttgatctgcatacgcaggtatgtggtcacattgtgaaaattcaccatgttatacactttgatttatacacttttctgtatgtatacttcaacttttaaaaaatatataaaataaaaaatgaaaaacatgtaatagaaaagctcttcctccagatgagtaggtatgggaattaaaataaaaagaagaagaaagaaagttcttcctaaaagaacaatctcggatacttactcccttcacttgcttcagtctattgtattcatcagcagcagcctattaacgacagacacaaaggaatatgtttactggggcattttctcttttaaaagtaacattcctgatgttatactttggagctaaaaatgacagcttatgacaaaaatataagcaattaaaagaatgaagtcgtaaagctcttaaaactcatgatcagcaggaaggtctgaaggaattcagtgaagagacatttatgatactgtatctttcacatttcactcacataggcaggtaactatctgttctgctacttctcatctctcctcatgccagtccccatgctacattgacaccaggaagatcttttataacacagagcgctcgctgatcaggtaatatcccactacacaactggtctgagcttcccattaacttctcccctcatccagtttcctacctttccagtctcagtacccatcatcagcaactcctttaaaaactgagacatgttaaatgcttcaggatttcaatcatgttttccttatggctgtaatcatgcacctccccgcacccttctgtctggaaagctcttaacgattccctcactgtgaagcctccaaagactttatttcttctatgagcagttagttatagtgctttctacacatgatgcaaatacagcattaatcatactgtctaaattgtttagatgtcaggttttttttcttaaaatataagctcttttagggtggggacaagattttatgtctctagctccagcatttccacatcatcaaagaaaaataagtgatcaataaatgttcactaaattaagaaagatctataacaccctatagaaaccataaaagaaatacataaatctaactatataaagatgtgaatacgtcaaaactaaaaagtagatcacctcaactgaaaaatggcagaatatttaatgagatgtgcatcaaatgagtcctgtattgtatcaagagggagacacagttggtgcagtctctctggagggcaattttgcaactttgcaaaggtacgtaccctctgactctcagcaatttcacattctggaattagttttagttagataagcaggctgggcactgtggctcacacacgtaattccagcactttgggaggccaaggcaggcagatcacctgaggtcaggagttcgaggctagcctgaccaacatggcaaaaccccgtctctactaaaaatacaaaaattagtcaggtgtggtgccacatgcctgtaatcccagctactcgggaggctgaggcgggagaatcacttgaacctaggaggcgaaggttgcagtgagccaagatagcgccactgcactccagcctgggcgacagagcaagactccgtctcaaaaaaaaaaaaaaaaaaaaattagataagtagacaagagtgcaaaaacagagaggttcaccagtatatactggtactactggagtagggggagacatacttaaatgtctatccatagaaaatgactcttaaattatgatacaaccataaatttgaaagttgtttacctaattttacacataaaaaacttaaaagtaagtaggtctttattattgatataaaaaaaaaaacttgctgttaagaaaagccagaaataagcagtgcaaggaagtttttttgtttgttttttttttaaagataaaaccccacaataagagtatgtcaaagggacacgggaagcaactgaaagttcccaaccgtcaaagcgagaacaattagagctacaaaataaagcagccttggattataattcacagtataaaacaggtatctgtaaagtccatacttacgtaagtgattgactgatcaataaaggaacaaataaacaagaagagattaatctccctctaaaaggtggtgtaactacattaatttcagtatgtatacaaaatacagtatgaaaaggatggattgaaaaaaaaatccagtaactttacatggacaaattctatctcagccaggtgatcaagggagggaaaaaaaaaacccataaactgttgatttaaaagacaggaagaaaataagtgaaacatggaagatgatgtttccttaaagaaaggtgtatgtgccttggtgactcctgcttggagagattgttttaactaatattttggtgataaggatttcttgatggtaggatttaagatgatttctttttctgtatacagttctgtgttacttaagttctttttttttttttttttttttttgagatggagtctcactctgtcactcaggctggagtgcagtggcgcgatcttggctcactgcaagctccgcctcctgggttcacaccattctcctgcctcagcctcccaagtagctgagactacaagtacccgccaccatacctggctaattttttgtattttttttttttttttagtagagacggggtttcactgtgttagccaggatggtctcgatctcctgacctcatgatccgcccacctcggcctcccaaagtgctgggattacaggcattagccaccgtgcccggccgcttaagttcttttctacagaaagaatgaatggctttataaataggaaagataataaggctattttattattattattattaatttttgagatggagtctcactctgtcgcccaggctggagtgcaatggcgcaatcttggctcactgcaacctcccccatcccaggttcaagcaattctcctgtctcagcctccccgagtagctgggattacaggtgtctgccaccatgccctgctattttttgtatttttagtagagatggggtttcaccatgttaggcacgctattctctaactcctgacctcaggtgatccacttgccttggcctcccaaagtgtggggattatagccatgagccaccatgcccagcctggctattttattttaaataggaaaggatagatgtacatagaatagtgctttgtaggggctgggcgcggtggctcacgcctgtaatcccagcactttgggaggctaagacgggcagatcacgaggtcaggagatcgagaccatcctggctaacatggtgaaaccccgtctctactaaaaaaaaaaaatacaaaaaattagccgggcgtggtggcaggcacctgtaatcccagctacttgggaggctgagtcaggagaatggcgtgaacccgggaggcagagcttgcagtgagctgagatcacgccactgcactccagcctgggcaacagaacgagactccacctcaaaaaaaaaaaaaaaacagaatagtgctttgtaattattaactattatacattagtacaatcttctattaggaaagaatttcatccaaaacccaatctcaactattcttcaatgaaactgcagtttgataactactagcacatttttatcaacattaatataaaggatgctgtacctccacagattagattcaaattctgtttaatatataaatatcaggttgaatttaccatgtactcttcactttcttctctatagtcatccaattctttatccaaacgggagagttctttattgatctcatcaagttctgattgtaagctcttgtattcctgtaggccagtgtcaaaattcctcttgtacagttgtctttgttgatctgaagtgataggtggatattccctaaaaggtgagagagaaaatgactacatatgtatccttagcagacataaaattcaatgctccttcctcaaagataataaagctggttgggtatggagaatgacattttcttgtttcgtttttgtttcttatggggaaagagagagagaatacaaataagttctattaagagtgactatatattactgctcattttttaaaaaataaaaactatgcctacgtaatttgcagaaataattttgaaaatcatttacaaaattgaaggtacaagtcataggaactcacttatttcccatacacaatatcaataatggactacttatgtttataaagtttttcttttcttttttttttttttttgagacaaagcctgctctgtcacccaggatggagtgcagtggcacaatctcggctcactgcaacctccacctcccgggttcaagcgattttcgtgcctcagtctccacagtagctgggattacaggtgcctgccaccacgcccggctaatttttgtattttagtagagacagggtttcaccatgttggccaggctagtctcaaactcctgacctcaggtgatccacctgcctcagcctcccaaagtgctgggattacaggagtgagccaccatgcctggcctgtttaaagtcttaaaactggaattctggaacacaaagtccgctttgatcaccacagtggcagcacagctgactggaagtggctgtttcctgctaccacccatagttttcagactggtttatttatttttttgctcttgtttttccgaagtggaaatagcttatctacttctttcacaataaaaatagacattaaaaatgtacatgtataaaaacatgtgctcactgttaaaataatctggcaattcattaaagtataaagaagaaaaactgaaattttgtatcacatctatttctcaatataccagccactccttacataggaagacgatgccattaacccataatccatagagaaaatactctgaatcctttcacaggactggagtttcacaatgatgtggaatttcaaattttagatctaacaatctaacatcttcattttacagaggggagaaatttaaatgatttgatcaaaagggaaacaagaatttcagattttgaaaattttcaggctgggcatggtagctcacccctgtaatcccagcactttgggaggccgaggtgggtggatcacctgaggtcaggagtttgagaccagcccagccaacatggtgaaaccctgtctctattaaaactacaaaaattagccgggtgtggtggcgcatgcctgtaatcccagctcttcgggaggctgaggcaggaggattgcttgaacctgggaggcggaggttgcagtgagccaagatcgtgccactgcactccagcctgggcaacagagtgagactctatctcaaaaaaatatataaagttttcagttaaatcttccgtgatacaagttaggtgaatattttacagatagatggctaagccaggccaaaaactcttgaggggagaggggaagataaagtatcagaatcatcagtgaataggggatctcaagctacccatgccccgcctatcattcctcactctctgagaagcgatgttttgattaccattcacattgcaaatgtttctgatgtgcgtcttagtcctcagaatacttgggcataggaaggctacacatcatacacaaatacatttggtgatggtggatggattgtaacaaaaccaccaaaacacaaagaaacttaaccacaactgtggctgaacactaaattgttacctcaattgtttacggaactctttggattaaactttaaaagaaactctcgtcttatcattttaagcttaatttaaaaaataattgccggccaggcgcggtggctcactcctgtaatcccagcactttgggaggccgaggcagggagatcatctgaggtcaggattttcaagatcagcctggccaacatggtgaaacccgtctctactaaaaatacaataattagccgggcatggtggtgggcgcctgtaatcccagctacttggtaggctgaggcaggaattgcttgaacccggaaggcagaggttgcaccgagccgagatcgtgccattgcactccagcctgggcgacagagcaagactccgtctcaaaaaaaaaaagtaatgccaaaggaaaaccatagcactggtttgggaattttataattagtaaaacaaagttcttctatacctggattttatttatttgaaaggcctttggttgttttttgagatagggtctagctctatcacccagcctggggtgcaatgatgcaattatagctcactgcagccttgaactcctgggcttaagcaatcctcctgcctcagcctcagcctcccgagtagctggaactacaggcccacaccactatgcctggctggtcttgaactcttagccttagcctcccaaagtgctaggacatctttcttccgtgactattggtataagaaagagcactggtgaagttcaccagccacactgtggaaagttcaaagtggttactgccaaagttcaaagacatggttactgccaaacattctctccacttcaaactttgtcacaaaagggtgctaaggaaaaaaccagccaacaccacacaaaaaactgtctccagtcctggttggcaaagaatgaaattacaccagtgacctcaatttgggaggcaataactccaacacctggttggtctcctttaattatcagaaggagcacgtgggccaggaaaggagagctgagtcggtacctgatccagtcctcctccagctcatcacaggactcgccgccagttgtgtagtctgtctcatagtgatcttgctctgttctctttgaccttcctgctcttccctttgcaggtgctctttttgaaggtgtctcaaagttaccaccgctgctgtaacgaggctgcctgaagtcatccacaggcgaagttaatggaagctcctgaaccacttcaggaaccctaataaaaacaggcatcattgttcagtacactacagccctttgccagtgcactgtaatcacagagcacagccataataaacaccagcagacatctgcacgcaggtgcactcacgcgaggacttcagatgttcaacactgagcagatgcctcgttttctgcattcaatttgacagcagttcagagtcctctaatacacacaagtagtaggttccaatttaaaggggagtagccatttttataccttctaagtacaatggatctcagatttcattttaaaaagttcaggctgatctataagaggtgtttacttgacctgtgccagggacttactctacaaaggctgtcaggaaaacagtgatcattcttttctacaggctcttctagttccctggaatgctgcatggggaagaatgcacacatgctctttgtaatattgatcttatactaccatatatcaattatcatattaagataaaatcttgcaaaataaactaaatatctaaactaaaaaagtaaaaagctttacattgcaataaattaaagagttcctttaggattctttttaaaattgctgttaatcctgaagccacgtagaatgaatagaagggttaccattacacacttactattttcttctaatacaattatttaaagttgcatcacaattgcatgtttcggacacaaacatgaaaataaccctaactgaggaataaaataccaaagttgaaagtgggaactacttctgagtaaaagaaatacgaagtttcattttcttgtagaaaagggcaagaacagaaatgaaaacaccaaagaatgggcctaagactttccaagcatcagccttgccattccaatcaactatttaaaatgtctgaagcgtttctttttgctgccaatttacataaactatcatactgagctcttccaggtttagtcccttttctaggtgatccacatgtgctttgctgtaactgttgtcagagtcttagatttctaagcacacaatttcttgcagactctaaactttggggtatgtgtgtgtagatgcaggtgggggtagtatttatttcttctttcaagatttatggccggaggcggtggctcacacctgtaatctcagcactttgggaggccgaggtgggcgaatcacttgaggccaggagttcaagatcggcctggccaacatggtgaaaccccatctctacaaaaaatacaaaaattagtgcactgtggcaggcatctgtaatcccagctactcgggaggctgaggcagaagaattgcttgaacccaggaggcagagaatgcagtgagctgagatcgcaccactgcactccaccctgggtaacagaatgagattctgtctaaaaaaaaaaaaaattattcaggtaatatggctttgtgtgctatgctaatgttacttctaatggagagaaaatgtgactttctccatgagtcaatgattaacaagttcctagacactctgccaaaactgccaggtactatgcctcttctttgaggtagaaaaacaaaacctttagaatgcagtggattcattttaggggtggggccaaagagggagggaactaaagggcaaaagaaattagaaaaaaacataaaaacaaaaagtaaaacatcaaagtaggcctcctgccagaatttttatgatattagatattgatatatctttaacttcgaagttttcctcccctcctcctacacccctttaaaatattaacatacttgatctagcatgaaagctaaaagcaaaatgtttcacaagaaaagtattgactacaggtgtgagcaacaccacactgggctaatttttaatttttttgtagagacagggtctcactctgttgcccaggctgagccttccacatttcccaagctgcgttgatctttccagcccagcatgaagttttctttcccaaagcttacatagcaaaaagattctgattggccctttttgggtcactgtcatccttgaagccaggagaatgttctctgattagcaagacttagatatgcctcccaataatggtagcagctctaaaatacagtgtgtacaacaaacgtcattctaatagtcatggcattgttgatcatgggttgtttctctgccttcactgatgctgtgtgtaatcagaaaagaaggattcttatgcatgtgttttcaattcagtaattgtcctgaacacctgacatgcatagagtactgagccaggtgaccctgggaagaccaggtccatgttctcacggaggctgcaaaacaggggtggaggaaagtgcacaacaattctgctgagagtcagggcaaggtaggagcaataaaggcagcgtgaaggagtgtgagagagaataaaacaaatgactgaagaataaaaagaacaagccggccaggtgcggtagctcacacttgtataatcccagcactttgggaggctgaggcagggggatcacttgaggttaggagtttgagaccgatctggccaacatgttgaaacccctgtctctactaaaaatacaaaaattagctgagcatggtggtgcaagcctgtgatcccagctactcaggaggctgaggtgggaggatcgcttgaacctgggaggtagaggttgcaatgagccaagattgcaccaacacattccagcctggatgacagagcaagactccatttcaaaaaaaccaaaaacaacaaaaaaaacccaggcatggttgcatgcacctgtagtactagctactcaggaggctgaggcagaaggatcacttgagtgcaggaatttgaggattcagtgagctatgatcacaccactggactccagcctgtgtgaaacagtgagaccctatctctaaaaagtaaaaataaataaataaataaatgtagatggctatcctgtcacaacagaagctgaactgagaagaaagccaacataccgacagatgaaagagagcacataacagccctgctatcttctgaatccttcgattatgccatgactgaagctacagacgtccttgggcctcacgtgactcagataattcctcctttcacttaagctattttttttcatgatttttttttttttaattgagacagggtctccctatgttgcccaggcaggtctcaaactcctggcctcaagcaatcttcccacctcattggcctcccaaagtgctgggattatcagcctgaaccaccatgccccatcttaaactagtttaaactgggcttctataactcctctaacttgcataaaagtcctaacatcatcctaccagcctattactaccaaacaatggtctcatttagcaatgcaaggagtcagccttctttgaaagctttgcattgcagcaacattcaacttccttgatttatgaagggtaattcaacctgggtgtggacaggatagtggagagtgtacctaatagggctctcccaagttcgtttagtaggtttggagaggcaaccatcttcagctaaattctggtgtcccctgatgcaggattaattctcagagctgactgccttaaaattctaaggtatgggacattataagcaaaaggaaccagatatgagagtaaactgcattattccattttatttaaagtccaataataacacgttcactaacagatggtgacagacatcaaaatagctgttaccttggggtgggtgtgggtgggtattgatggagaaagggcacatggggaccttatgtagggctcaaaatgtatcttggtggtgggagttaagtggtcatagatgggaaaactcatcaagctgtatactcaagattagtgctctttttatggaatgtacattacgcgttgggagaaaaaaacatcttaatactgatttacctcatccttggcacggatgggtggatggacacaatgttctccatctaattccttctctatccactagcatggtgaggaagagaggtgctcatgggttactaagcacttgcaagaatgccttaggaaagacaggctatgacttatgtgttcttattcccattcaagtgggtgtcctctgaatcctctatagcactcagtactctactatgaacaacactttacaatttctattgccccccagaggctgtaaaatccttccatcattaccatgctctgggggagatattgtgcattagtatctcttagtaccactcccattcacccattcatctgggttctaaaatgaagcatcgtgtttgcactttccagaccttcaaaaaaaattctggggcataagtttggagcagaaactagtacaatccttaagaaataaaacttttactacatctatcaaaatgaaaaaatgcacatttattttagctcagcaattctgcctccagatacattcacatatgtataaagtgataaatgtataaggttattccttatacatttgtggtctgtaataacaaaacattgggggaaagtgtgcatcatataggattaatacattaagtataccagccaggtgcggtggctcatgcctgtaatcccaacactttgggaggctaaagcaggcagatcagttgaggtcaggagttcaagaccagcctggccaacatgacaaaaccccatctctactaaaaattagccaggcgtggtggtgggtgcctgtaatcccagctactcaggaggctaaggcaggctactcgggaggcacttgaacctgggaggcagaggttgcagtgagccgagatcgcgccactgtactccagcctgggcaacggagcgagactctgcctcaaaaaataataataataaaataaataaagtatacctatttggtagaatattatacagctataaaacacaatagtgcttcttcttgattataattaaaaaaataaaacagaatcaggcaactcattgcatagtgatatggacaatatccaagataaaatatattgctaatgatacatttggtatgctaatattttctttttcttttttttgaaacagggtctcactctgtcacccagactgaagtggagtggcacggtcttggctcactgcaggcttgacctcctgggctcaatcaatcctcccacctcagcctcccaagtagctaggactagaggcatgtgccaccatacctggcaaatctttatattttttgtagagagggggtttagcaataatgcccagggtgttctcgaactcctaggctcaagcaatccacccacctcagcctcccgaagtgctggaattacaggcatgagccactatgcccagctctggtatgctagtattttaagggggggtgggggaatcaatgtactttggccagtatctttatgttttaaaatctgtggagaaatagaaagtgatgacattagttgcctctggggagaggaactagctagctggtaccttttgtcccttttaaattttccactacataaagtattcaagaataagaaagattaatacttaaggaataagactttcaaattaatttcaaatgaatttgtgaaactatcctggtttttgtgaaaagggacaacaccagggaatgctgtgtaaccacgcaggccttacaatttagaggaacagctggtgccaagatgcagtatagatatacattttgtatgtatgaaagttctgcaaattggtccttttatagttgatgagcatgatgattgggtgttcacacgcatgtgtgaaatgtcccaccctcaaatcttgttacaatattggcacattacccatctgacatgaaaaaggagaaaaaaaaagttctgcaaatcatagcttaaaaattttagaggctgaggcaggaggatcacttaaggccaggagttcaagactatcctgggcaacaaagcaagaccccttctctacaaaaataaaaataaaaaattagccagccatagtggcacatacctgtggtcctggctaaagtgagctatgaagcaagaggactgcttgagcccaggagttcaaggtcacagtgagctatgataacaccactgcactataggtctgggcgacagagtgaaacagcatctcaaacaaatgatgaaaaaaaaaaacttagaaggattgcatctctcttgcgtacccttgtccctaacactctcaagtgctttagtttttgtcaaaatccaaagagaagaacagagaaaatgtgctttctccaaatcattcacaattgaaatcaacagcaagatcaagtctgaataccaaaacaactatgcactcagagtaaatctcatatatcatggcccactaatcaggagtcgggcattggggataaaacttcaaagcaggccaggcgcggtggctcacgcctgtaatgcccgcactttgggaggccaagacaggtagatcacctgaggtcaggagttcgagaccaacctggccaacatcatgaaaccccgtctctactaaaaatacaaaaattagccaggcatggtggcgcgcacctgtaatcccagctactaggaggaggctgaggcaggagaatcacttgaacccaggagacggaggttgcagtgaactgagatcgcactactgcactccagcctgggtaacggagtgagactccgtctcaaaaacaaaacaaacaaaaaaacacttcgaagtaacaaaaaagttatttccagtagatacacctttaacatagacattcaaactagctgaaaggaaattttttgggctttttcagtctccaaaggaacttagagttctagaattacagtcacaaagtcataaagacatttcagtcaataagggactaataaaagtatacggcaaatgcaattatgtacagtatataatacttgacaataaacgactatgctactggtttatgtatttacactatattttttattagattccttcaacttattaaaaaaaaaaaagagttgaaacaggaaaaaaaagttaaaagagcctcaggcaggtgcttcaggaggtattccagaagaaggcactgtcaccatggaagatgacagctctgggtgtgttattggccctgatgaccttccagtgcaacgagatgtggaaatggaagacagtgatattgatgtaggcctaggcaaatgtgtatgtttgtatcttagttttgggtttgtgtgtgtgtgtgtgtgtgtttatttttattttttttgagatagggtctctgttgcccaggctggagggcagtggtgcaatcgcagctcactgcagcctcccaaagtggtgggattacaggcataagccactgcacccagtctgtatcttagtttttaacaataaagtgtagaaactaaaataaaatttacatggtaaaaatagaaaacagcactttgggaggccaaagtgggaggatcacttgaggtcaggagtctaagaacagcctggtggcagggcatggtggctcatgcctgtaatcccagtactttgtgaagccgaggcaggcagatcgcttgagcccaggagtttgagaccagcctggacaacatagcaagaccctgtctctacaaaaaaaaatagaaaaaaatagctgggcatggtggagcacatgtgtagtcccagctactgaggtgactaagtagtctcagctacttaggtgactaaagtgggaagatcgcttgagcctgggaggtcaaggctacagtgagctgtgaccacaccactgcaccccaggctgggtgacagattgagaccatgtctctaccaaaaaaaaaaaaaaaaaaaaaagcttatagaataaggaaaatacttctctatatctatatatctatacaatgtaggtatgggatttttggcttttcttttatttttggctggatttgagctcccgggctcaagtatgatccctcccacctcagcctcccaattagctgggactgctggtgtgcaccactgtgccagggtttgtgattgtgttttttgttgttgttcttttgtttgtttgtttttgagacggagtctcactttgtcgcccaggctagagtgcagtggcgcgatctcggctcactgggagctccacctcccgggttcacgccattctcctgcctcagcctcccgagtagctgggactacaggcacccgccaccatgcccggctaatttttcgtacttttagtagacacggggtttcaccctgttagccaggatggtctcaatttcctgacctcgtgatccacctgcctcagcctcccaaagtgctgggattacaggggtgagccaccgcgtccggccttttgtttttttttttgagacagagtttcactttgtcacgcaggctggagtgcactggtgtgatctcagctcactgtaaccgccgcctcccaggttcaagtgattctcctgcctcagctttccgagtagctgagattacaggtgtgagccaccatgcctggctaatttttgtatttttagtagagacagggttttgccattttggccaggctggtctcgaactcctgacctcaggtgatccgtccacctgggcctcccaaagtgtggggattacaggcgtgagccactgcacccagccatgtgattgtgttttaagtgttattacaaaagagtcaaaaaaattaaagttatagaaagctaagatttattatagaagaaagaaaaatgtttagtaaatttagtgtagcctaagtatagtgtttataaagtgtacagtaatgtcctaggccttcacattcactcaccacttactccctgactcacccagagcaacttccagtcctacaagcttcattcatggtaagtgccttacaagatgtaccatttatttatttatttatttatttatttagatggagcttcgctcttgttgcccaggctggagtgcaatggcacaatctccacttacaacaacctccgcctcccgggttaaaccgactctcctgcctcagccttcccaagtagctgggattacaggcatgcgccaccacgcctggctatttttagtagagatggggtttctccatgttggtcaggccggtcttgaactcctgacctcaggtgatccacctgcctcggcctcccaaagtgctgggattataggcgtgagccaccgcccccgccaagatgtaccattttttatcttttatatttactgtaccttttttgtgtttagatatacaaataccactgtattaccgctgcctagagtatttggtatattaacatgctgtctgcatttgtagcgtaaaagcaagaagctataccacatagcctaggctcgtagcaggctatccatctaggtttgtgttaagtacactgtgatgttcactcaaggatgaaattgcctaaagacacacttctcagtattcccatcgttaaacaatgcatgactatatatgtaaaaataacgacttcatcatccttaggcaaaaattacatccccgtccataccaattatctccaatagtcttctctcactagtcattaggtggaattagaattgagctttagggtaagtgtttccaccacagagataccatttcaattatcatatgacacctaccctaggccagacgttcactgaggtttcacatctcccagcaatactgaggacctagcacagcaaatgaaataccacaattcctggattcaaatgaagtcttctagtttaacagaaatgtatgtgggcagggttgattaatgtgaaatgtcctcccttctgtttatgagatccaacaattataggcaaaaggagaggctgagcacagcactgacctctgctcagtaacttcctctcaccctcacctaaacttcaaaaccagaaatagcagaaccacattcctagagtgaaagaacccaacccaacctttcaattaaacaagtaagtgaaaagaagcattttcaacttagaagggaaatagaaccccaccctcctcatcctggtcttccaagtagccgtaggcctctgtaccaacaaagcaaagattgttgtaataccaagatccagatccagcttttgtgtgcactgctggatattttttttaagcagaaaggcacaaaaaccaattatatgcaaatactcatttttacactcagtctatcaaactaagagagatgctacttacggcgtggatttataggaagactctggataaaaccgcttgtcattcactttgccattggaagagtatgccatgggactgtcaactctttccacatagtcagatgggggtgaaggcacgtcctgtgtgcctgcagacacatttttaaccttaaaaaaccccaagagatagttattatttatcttgtaatgaaaagggggaagacactgaagaaaattatcttatatacattatctaatatttatgtggcccattaaatactattaacactaataataaaaaggcaatcattacaggttaatagttaaatccacattgtaatagacatataaacagtgctactgctagtttaaacaagtatattaccaagaagaaaaatctgatcacctagttctcatcctaatgtgattaggtttcataattatctatggcaattttccacctccatattaggaagactggtctcattatctcacgcccacattagaaagaccactctcatttaacctaagccaggtctcggttaggagaattttcatttctaacaagctctcaggtaatgctatgttgctgtctgtgcaccacacttggaaaagcactaatctagaacaaagcacactggtagttcttaatccattcacctctcaacgtggaatgttaaaaccacagaagaaattaagaagttcaagctgacttctactcttttaataagagatttgtttattctcccttaatgtacgttctctatggctctattactaataacctacacaatatatcacacaacatcagtgccttcccttttcactttccttatttcattctgatgtgtaagtgaattcatcctacaaaagtaacatgcattagaaattatgccttaataggccgggcgcggtggctcacgcctgtaatcccagcacttggggaggctgaggcgggtggatcatgaggtcaggagatcgagaccatcctggctgacacagcgaaaccccgtttctactaaaaatacacacacaaaaaaaattagctgggcgtggtggcatgcacctgtagtcccagctactcgggaggctgaggcaagagaatcacttgaaccagagaggcggaggttgcagtgagcagagatagtgccattgcactctagcctggccaacagcgagactgtgtcaaaaaaaaagaaattatgccttaatgtgaaatacatatacaggttcttcttatctgaggaatgtaagccctttcttaaaagctatcaggcccggagaggcattaaaatgaaacagcaatcaagtcctacttcccccttgagctatgtagttatctccagaaaccgcgtaatctaacaatgctacacactgggcaccataaccctgctatagctcgacgatgtaacaacgttatttctgtaaaccagtgagaattcctgatgaacaactttgtttctatccactccttgtgccccgtttttgcctttaaaaacttgcttataaaaaaggttgcatggcgcactccccaaggcagcttggaagcatgtcccaggcagctgttctcaaccttggcccaaataaattttctatattaattttgcctcagcttcttcccctaggtcaatattaacatggaaggcttaccacagaacctttgggataaaaaatttaaacataaaaagcacagccaactagactcccaacactgtatgtatatatatgtgtgtgtgtgtgtgtatatatatatgtgtgtgtgtgtgtgtgtgtatatatatatatgtgtgtgtatatatatatgtatatatgtgtatatatacatgtgtgtgtgtatacacacacacacacacacacacacatacatgcatacatatatatatatattttttttgagacagagtctcaccctgtcacccaggctggagtgcagtggtgcgatctcggctcactgtaacctccgcctcctgggttcaagtgattctcctgcctcagcctcccgagtagctgggattacgggcacccaccaacatgcccggctaatttttgtatttttagtagagatggggtctaaccatgttggccaagctggtctcgaactcctgaccttaaatgatccacccacctcggcctcccaaagtgctgggattacaggcgtgagccaccacgcccggccactgttagattttatgttttatgtaacagctccaacactcttgacattttacctaatagcctttaaattattacatatcactctgtaattgagaaaaaaaattggaaaaaaaccaaagacctcaaacaagtgctaatcctagatgaatcatttagttgttttaaggcaaaggaatagaaataaagtgtgggaaaaaaatcaaaataaatctacagatatttctgtgaaaaagagctgctattcaaaagggtagaaccgctctagctttgtgataggatcaatggcattttagggtttggtacgtgtgcttgtagtgccagctactcgggaggctgagatgggaagacctcttgagactgagaggtggaggctgcagtgagctctgattgtgccactgcactccagcctgggtgtcagaatgagaccctgtctcaaatacatacaaacacaaccaatagcatcagattatctgggctcaccccaggtctgccaaccacaaattctataaagccttagttttcatctgaaaaagaaaaaaagaaaaaaaaaaggagaaaactacctagtacataaagttattttgatgattaaatgaggtgacaaggtatcacatttactacagtgcctttaaacacagtaaaaattcaaaagatgctggattttggaattaaggccacttgatctgatcaaataatttttacaagaatttggaggtggcagaagacctttatttggattattttgctattataaagccttacaattaggttcagcttcaatgcagtgtatcttctgcaatacatattccttacatcttaagtttcccattcttagtagcattacattaaaacatgagatgcactctcctgacgtatccaggcagtatcacatacagaaagatatttacctacccctcaaagtacataggggtattcttgattgtttaacattcagagacagaaaggaatagaatcatttccctctgaaagtggaatttggcagcaactgcgaaaccagtgggtgggttgccacggagtgtgctcagaccccaccacaggagggaagggagggaagcactcttggttcccacagaattccttacaacaaaagtttacaacagaagttgccaagcttcacaggcaaatgcttcaccaaaccaaagcctattcttaatccaataccttatcagaatttaaaaatccttcctttgcttaaaaacccattttatacttctctaggtcccacctcctcctcacagcgtgagctttagcagagtctgtgtatcttttcagagatttcttactggctaaaatgcccttccccttttgccagctattccttaattgggtttcaattcttggctcatgtgccaccacctcctcctcatacaagcccctcctggatgaggcaccaacctgtgctatctccctacacctgtgcatacaaacctcccaccaaatcgcttatgcactgccgaacaatggcttgctcacctatctcacttcagtaggcagcggactgggcttaagccaccactatctgactgcttacaattagccaaatattgaagtgacagatcattttgtaggcatggatttacaggcaaatatcgttccttttccagaaatgaggaagctgtggctcaggcagttagacaactttcccaagaacctagatgtagaaaatgcaagggcgggcagtttcctgctttcctcttcgagtctccaaaggaccacacagtgtctggcacaaatcgggagccccaagtttgctgcataaagtttacctcattgataactgttctatttctacactgtatacccaagtattttatcaatgaggcacactgagctgacctttctctcttagcatcagcagaactggactagcttgaccactgactccacccttcagcaaagatctctgattaaaccttttctatacacatgcataataaattccaaggcagtgctcccttcagcagcacatatataaagttgaacaatacaggaaagattagcatggcctttgggcaagaacagcacccaaattcatgaaacattccatttttttttttaaatcctgagccagctgatgccagactccaacagtctagaggcaaaggcaaaatatatttgaaaaacaaggagtacgatcattttttttcctctttacactgcaattttcctgaaaaaaggctaaaatattttttcctctaacccacttaatggtaccaatgccaagtaagtataaacccagtatctgcggcttttgaaggacagtaggaaagtagaagggggttggagggggcaatacaaagtgaacaggtgctcatttctacaaggagtccccaacctgtatttcctattatgagagaaatgacttctgaatttcactgttattactgacagaatgccccagtcagctcataaaactcaatgatgtagttaaagttctcttaaaaaggaaaagaaaaatattttaattttcacagtaagatttttttttcttaagagatgaggccttgctatgttgcccaagctggacttgaactcctggactcatgcaatcctcctaccctagcctcccgagtagctgggactacagggtcacaccactacatctcacttttaaagaatgagtacttgagaaaaccagctaggcataattctaaacagcaaagtgtctttgtaacaattttcccttaagtaacttgaggatatctctaagaaattaaggacagaagaaagcaggatgaaaacacaaatcaaagatttctctaggccaggtgcggtagctcatgcctgtaatcccagcactttgggaggctgaggcaggagggatcacctgaagtcgggagttcgagaccagcctggcaaacaaggtgaaaccccatctctactaaaaatacaaaaattagccaggcatggtgacgcacgcccgtaatcccagctacttggtggctgaggcagaagaatcacttgaacccgggagatggaggttgcagtgtgccgagattgcaccactgtactccagcctgggtgacagattccatctcaaaaaaaagaaaaaaacaacaaagtaactcagacttactcttgaaattacattcaaaaaggacaagcactcacactgaacatgcttaaggagtatgaattattaatttagggaatatgcagggaaattttattaagattcttattccaatcaagaaagaatttatttccgaaatagcaaaatgaaatattattttaaaagatcttcacaagaggtaattatgaggataaatttttattcaaagcttaattgtactcattagaagtgttctgattatgtcacttgtgaaaaaattctttgtgacaaacaacatctaacactccttggagagttaatgaaaacatcctaaacccctgtgggatgccaacaggaaaacaaacagggcagctctcctttagagcagctcaggtgctcttctccaaatacctaccgtgattcttcctcacctgagagtaagatgggtctacaccatcatgttggtcccaccttccccaccctgactccctgaagtcagagaaggaataaaaaggtcaagaaggaatgttctaggtcactttgaaagaaaatcttctctcctccaaaacaaagatcggggaaaacacttatccccacttagatcaatttcatatttcatttggagttagtaaaagcaaaatatatgcaaattatatgcaattatagctaatcctcatttttctcctcgccctaatttcatccctagttcacacatgggagagagtcaggctagacctgcacccatgtggtctagcaatgtgcaaaagccatctacctctaagaaggaaagggaagttcacctgttgagtattcagcatgtgccaggcaaacccgacttcgtttattctcaccgccacccaaggagatacaattatctctattttcagatgaggaaattgagtttctacagttaaattaacttgctcaaagtcacagagaaggtaaagtagcagaggggagatttgaaccctggtccatctagctccaaagctcagctctttctggcataaaaaactgccacctcaagaattcaaacatggcttgaagtacccatcttggatgggtattttgactggtctttgtaacaaaggagaccattctcattgtcttaaactcctccccattttgaaaagctttatttgcctattagtttaactttgtaagagcagctattgatgcaaaattattatgagtatgtttcatgcctttgtttaggtcagcgtttaggaacacctctctcaaaaaggaaagagtaggattttcccagcttggtgattaaagtggagatatacctcaggcatcagagggaggagcatcttaatcttaaggatcatctccaggtttacaacctgcccattccaccctcctcagccctatgcccttgtactacaggttctcaacagtaagtggtctaactcgtttttcctgttttttgatattttacaccctcagatactcccccaaataaaagcttcaaaatcgactggaaagttctcttagacttttctccacctttggtcacttgaaggcagacggtcccacatctactaatcccacaaataatgagatcgtggaccaggtttgaacatgtctggttattttaccttgctcagatggcatttaggatttagaaaacaaattgcccctacccaactgcacgctgtccaaagaaacagtaataatatagaccaatgagaactataaataaaatcctaagcccccaaccgagaagacccccttttggccaagagtgccccagagaaatcttaactgagttcctggccatgacagaatgggaggtcagacacaactcatttactccctcccttctgcggttcagacacagctgaccagcattcatgttaacatagagatcatcaagactgatagaaatagactctttgtggcaataaaacaccaaattataaataagacctaaggccatgccagacaagggttaaatcccacacccctacatttgtcctaaccatacactatgttctaaccaccataaggttgctctttttctccagcagccaaacaagcactggcctcaagataagcaagattaaagcaattgcgtaagcctactatgtacccacaaaaattaaaaataaaaacttacaaaaaaatacaaaaagaaaacaactgcagctcatccaccaacagatactgactgacccctgttccacaagccatacagctttgactggacaagaaactgatttcagtaactttctcctgatcagagactagcagccgtggaatggttctggccagcttgcagaggctgcacgtgagtgccttgtgttcctgcttcaccttttttttttttttgagacgaagtctcactctgttacccaggctggagtgcagtggcactgtgtcggctcactgcaaccaccgtctcctgggttcaagcaattcccctgcctcagcctcctgagtagctgggattgcaggcgcccaccaccacacccagctaatttttatatttttagaagagaaggagtttcaccatgttggccagcttgtctcgaactcctgacctcaggtgatccgcccgcctcggcctcccaaagtgctaggattacaggtgtgagccaccgcgcctggcccctgcttcaccttttgatgtacagggcctaattgtaatacatttaaatgttaagtctccaccccaaagtgaacatgggatgtatgtaacacgaatgtttgttcattacgcatgcatcaggaccccattcacggatattcatagctcctcctataacctgttgaataggaatgtatggccaacctgttcagcattaagctcttgtcccaactccatctccttctaagtgcctttcagtgtctgccagaagctacgcttccaagactgtcaaggatggccaccttacaggttgtaaccctttataataaatagtctcctttctacttttttctttcacagctggagatcctttctaaatttataattgtgtcaatctttaggttgacaccaccaaaggtaaattctgaaattccctgagagtcaataagttattagagctctggaaggggatgaggtagaaaaaccttgtactcagtgaggcttaccaatgatctcattcaaggccccttacttaaacaaaaatccctgtgaagactgttaaatatacctgtacctcatgccagagtttttcaacaggtgtgccaggatgtctttggtcgcccagcctgtgagccaatcatctgcagttccagatccccctcagtttactccagtattttgtactaagtcaccattttccaagtatgccatgatgtaatgataacttgcttacagtttaatggttgcagcttgaatctataaaatagtggttctcgaaatatggtctccagaccagctacattaatattaccgacctaggccccagccaggcctagcgcacacatcataaactccagggtgggagtgagtgggctgtttcaatgagccctccaggtgattctgttgcctgcaaaagtttgagaactactgacgtagacacaattctcttctatgttgcagaccactgtacctcgtaaagacctacaagttaagggtctcttttgcctacagtgatgctcaaacctgacagtgcctggttttctggtccaggtgtcataaaataacctagaaaaacggtgagaaggttcactcggcatgagaacagctgagggtacctacttttatcacagtggaaacattagttgattctcagccctgagaaggacctctatcataccatcaacacaatggaaaagggaaggaacacatctttccctaaaggagagaaggcactttggcttgtcatatctataaagggttagtcatttgtgaaaaggacactaatgatcacgcaatagactatacttcctcaggactatgcctcataaaaagttgacctttaccccataaaaactcttataaaaatcaagagtatcagagaaactggttgagttttgccacctcagcaattgccaaaaggtaaaaagtagaagagaaaacacattaggccaataaacatgacatgttcagaagaaatataaaccaagacaacactgatacacttttacacgtttgactggaaaatattataaagtctaacaccaccaagagttgctggtttagattatatatgaaaaataatttgacattgtcttatagaaatgtacactcacaggccaggcacggtggctcacgcctgtaatcccagcactttgggaggctgaggcgggcggatcatgaggtcaggagatcgagaccatcctggctaacatggcgaaaccccgtctagactaaaaatacaaaaaattagctgggtgtggtggcgggcacctgtagtcccagctactcaggaggctgaggcaggagaatggcgtcaacccgggaggtggagctcgcagtgagccgagatcgcaccactgcactccagcctgggtgacagagcgagaccctgtctcaaaaaaaaaaagaaaagaaaagaaagaaatgtacactcacaaacgctgcatcccagaagttccactcttaggtacatagccaagagaaatgttcacaagtataggtgatttaaaaatgttcatggggccaggcgggattcacgggattacactcacacctgtaatcccagaactttgggaggccaaggcaggtggatcacttgaggtcaggagtttgagaccagcctggccaacatggcaaaaccctgtctctactaaaaatacaaaaattagccaggtgtggtggcatacgcctataatcccagctacttgggaggctgaagtgggaaaattgcttgaacccgggaggcggaggttacagtgagccaagatcatgccactacattccagcccaggcaacagagcaagacactatcttaaaaataaataaataaaaaataaaaatgttcatggcagttgtaatggtcttaataatccaaaaccccattaaaaggaaactggataaactgctgtgaaatgtgataaaatagaggaccagacaatggcgacatcagatggacttcaactccatcaacatgtattaatctataacctaactctgcgtaaaaaggcaaatgccaagacactacatgcaggtacaccttctacaaagttaaaaaacacccaaaacaaaatcatgttgctaagttatacatgtatgcaggtaaaaacttaaaaagcaaattataataaactcaaaattctagataggctacctctgggggcaggtagaagcaagtagatgagagagtaaaaaatgtataatgtaacttagtaatgtattgtaattattaggtgggatggtagatctgcaggtgttcattatgaaacaataaatgtaccaggaatgctatgcatggactaaaggtgataatgtcataaactaagaattgaattaatctatttctgtgcacctgaagtccagtttttgtttttagagacagagtctcactttgtcacccagcctgaagtgcagtggcacatctcggctcactgcaacctccacctcccaggttcaggtgatttcccacctcagcctccagagtagctgggactacaggcatgcgccaccaggcccagctaatttttgtattttcagtagagacagggtttcaccatgttggccaggatggtctcaaactcctgacctcaactgatctacgcaccttggtctcccaaagtgctgggattacaagtgtcagccactgtgctcagccttaaagtccagtttttaaaaaggtaatcattggccgggcacggtggcttacacctgtaaccccagcactttgggaggctgaggcgggtggatcacctgaggtcaggagtttgagaccagcctggccaacgtggcaaaaccccatgtctactaaaaatacaaaaattagctgggtgtggtgacacatgcctgtaatcccagctacttaggaggctgaggcaggagaatcgcttgaacccgggaggtggaggttgcagtgagccgagatcatgccactgcactctagcctgtgtgacagagcaagacttcatctcaaaaaataattaaaaaaaaaaaaaaaggtaatcattaaggtttttcctaagaatctactggcatggaaatgctcagttagggttctaatcctggctttgtcacccatatgtgaccccaggcatgtggatgaaaatgctttctgttaatataaaaccaaatttaacgtaaacatcaattttgtctattctctaaaaatattatcatatactgttagaaaatggcttaatagcccccttttacacaattatgctggccaaaatgtgttcaaaaaaggaagaataatcaaaagactcaactttcaccaaaaattgtaaaatttcagaaaacacaatttcagtattattcaagttgaccatttgggaacaaaattaagttagtgtttatctcatactataataaaaaacaagcatctcaatatgaataaagttatgacatttggtaaatagtaaatatcaatattggtccattagtggtgacaaatgcaccacactaatgtaggatgttaacaatagggacaactagctgcactgtgggtagtggctcacacctgtaatcccagcagtttgggaggccaaggcaggagaactgcatgagttcaggagttcaagaatagcctgggcgacatagcgaactctgtctctactttaaaaaaaaaaaagtcagccaggcatagcggcacatgtctgtagtcccagctacttgggaggctgaggtgggaggactgcttgagcccagcagtcaaggctgtagtaagctatgattgcgccattgcactccagcctgggcaacagagtgagaccttgcctcaagaaaaaaaaaaataaaagggaaaactgagtgccgtggtatacagaaatccatcatactataattgcaacttttctgtaaatctattaataaaactattctaaaatgaaacatttatcttaaaaaacaaggggggtggtccagtgtatatcctggatgttaaaaacaaaaacaaaaacacaaaaactggattgggtgcacgacacttctaagtttgctaaaaatcactgtaaatttttaatgggtgatgacaatgtatggtatataaattgtacctcaataaagctgtttaaaaaaatatgtttctggtggtctaaagcttctggtgatcttaaaggtctaggttgggcgaaaataaaaacaagaaatatgagagaggaacattacaccaatcaaggatgttaaaatgtaccaaggactgacatatgtttaactcaaccctctgcacacatttagtacacatggggtaaaaaaaataaaactttaaaataccaacgaaactacaggagggtattatttaaaccttgaagggggtgtaaaactctctaggaacaaagatatgtagaggccataaagagacaggaaatataagtacataaaaaaataagaagtctgggcatggtggcaaatgcctacaatcccaacactttgggaggccaaggcacaaggatcacttgaggccaggagttcaaaacgagcctgggtaacatagtgagaccctctctcttaaaacaaacaaaaaaacactgtagacaaagatgaaagaccacaataatgtgggagaagttatcatcaataagacaaaatattaatatccataatataaaaaactctagtcaggaaagaacgaacaatcacggaaaactaagccatgctatgaagatgtcaagtgatgaagaataggaaataagcatatgcttaatcaccaaattttgaaaatgaaactttatttttacttactggattaacaaaaattaatgacagataataaccagaacagaaaaaaatgttgggaactgagcaatttcatataccatcagggttagtagaatctgcagagctttcaaaaacaatgcaacttggtaatcccttgtaaaatgctttttttcaagagataggggtcttgctctattgcctaagctggagtacagtgacacaaccatagctcactgcagcctcaactcttgagctcaagagatccttctgtctcatcctcccgagtagctgggactagagtcgagctaccatgcccagctaacctagtaaaattttaagtgtgcacactcaatgactagttctagaaatttatcttacacaaacactagcaagagtgcataaagacatgtgagagaatgttcactgcagcgttatctgtaatagtaaacaactgaacacaattaaaatgtccataaataggagaatgaatcatcgtatactcatactatgaaataccacccagctgccaagagcaattaggtctatgtgctgacagacttggaaagatgttcacaaaacaaagtttttaaaaaagcaaactgcatacaacgtgtacattatgatcctatttttggttttaaaataacaccaatttttgggtttaaaataaattggctaggcacggtggctcatgcctgtaatcccagcactttgggaggccgacgcgggtggatcgcctgaggtcaggagttcgaccaacgtggtgaaaccccatctctactaaaagtacaaaaattagctagacgtggtggcatgtgcctgtaatcccagctactcaggaggctgaggcaggagaatcacttgaatccaggaagtggagattgtagtgagctgagattgcgccattgcactccagcctgggtgacagagcgagactccatctcaaaacaaaaatcccaccaaattattaaaagtaacaacattacattatttaccatgtgcaaggtattatactaagtattttacaaatattaacaagtttgaggctgcagtgagctatgactgtaccactgcactccaacacgggtgacagagctacaccctgtctctaaataaataataacaaaagtaaaaaaaaaaatttaagggagtatgagcatacttccaatttagaataagaaataggaaaggaaaaagatgattaaagaaagtaccccaggccaggcatggtggctcacgcctgtaatcccagcactttgggaggcagaggatcacgtagtcagaagtttgaggccagcctggccaagatggtgaaaccccgtctctactaaaaatacaaaaattagccgggcacagtggcaggcgcctgtaatcccagctacttgggaggctgaggcaggagaatcgcttgaacccaggagacagaggttgcagtgagccgagatagtgccactgcgctccagcctgggcaacagagcaagactccatctcaaaaaaaaaaaaaaagtaccccatagtggtaacttaagttgacataattttctttatacaggccaggcatggtggctgacgcctataatcctagcactttgggaggccgaggcaggcagatcacctgaggtcagaagtttgagaccagcctggccaacatgacaaaaccccatctctactaaacatacaaaaagtagctgcacatggtggcaggcacctgtaatcccagatactcggaaggctgaggcaggagaatcacttgaacctggaagcgggaggctgcaatgagctgagatcgtgccatcgcactccagcctggcaacagagcgagactgtctcaaaaacaaacaaacaaacaaaaattactttatacagttggcccttgaacaaccaggtttgaactgcatgggtccacatatacgtggatttttttcaactaaacatagatggaaaacagtattggcggaatgcaaaacccaggtatccagagggccaatttttcatacacatgggttccaccgactacaggacttgaatatgcatggatttgggtatacatgggggtcccggaaccaaccacctgagtataccaaggaatgactgcacttcactgtattttccaaatcatccatacttaaccaaataaaatatttaattaaaaaaatcagatctgaaatttgagggcagaacaaaacaaagacctgcaaagtttaattaaacaaatcttaaaacatttaaaatacaaactggtatccatctgagtgactataaaagaccaggttaaaaaccaagcagcgtgcaaacatgagctgtttattttacaaggaacaagatatccagaaaaaggaagggggaaaaaaagccctaagaagggcagagaaaccactgtgttgagccaacagggacagggaattataaaactctaaattttctcacagattatacaaaagggataaaacttgttttaaacactgaaggcacagcttttgactaccctctgctctgagaggtgggagggcaggaggcgtgttataatcctgaagatgctaaaaatccaagaaggaagtcagtaagatttagtaacataataaaattctagaccgaccccaatctgtagggagggattaaactaatattgagtagctaattgttactgtagtacttttttgttttgcttttttgagacagggtctcactctgtcacccaggctggagtgcagtggcgagatcatgcctcactgcagccttgacctcccaggctccagcaatcctcccacttcagcttcccaagcagctgggactacaggcacctgtgcccacgtccggctaattttttaaattttttgtagagatagggtcttgccttcttgccccagatggtcttaaactcctgggctcaagtgatcctccttggcctcgcaagtactgggattacagacatgagtttttcttttccccccgaatcagccattattagctatatggggagtaacctgtctcagctctttgcaatcaatcaaacccaaattttaattctcctttagtgcaagtagttaattctagattctcatccactattttaagtagagattgttttgatattaatttctcatgaccaaaaggaagaaaactccctaatctactccactgtgaacagtttagatgcaggatgacacaattccacagcgatggccacattatcagggtgaaactaatcaggcagaaatgagagtaacaggctacatctgcctgttccatcaattaaggaaataatgagaacgtggtattgaattccgcgacatgaacttgggcaggtgaggggagaatagaaagaaaggcaaaatatctgtggttaaaccacctccaaataatttattttaaataggctttctgaggcatttcagttcaaaaaactgaagggcagaggaaaagaaatgaggaatttgcctctggttaagaatcacataaaacattagtttgggcaaaatcatatatctgctattcaacagacaattcttttacatacaatgaaaatacttgttactagagagaaacaatgaagtccacatgcaacaacccacaggctatcaaatttccagaggttcaaggaggaattttattaaaataataccttcttaaaagctaagtagttctttcaccttaatcatcatcacctccataagttacaacagctatcttttgccaaattatcaaaagcaactagaactgattaaaccttcatgacagtaaaatcagatgagaggccaaagttcactgggactctaatattactggcattggtctcccttgagtcgggtttgttgtttttaagcctcttgaaaccttaagtaaacaaatctaactgccaacgaaaactaacacacccagaaactctcagcgaaacatttacttcatagctcataatatagacctgtcctattccagctacaagtggccttgcctggaggtaaatgtcgaaagaaaacacttcctaacaccttcacactttaaagtgagggaaaaaaaaaacagggcttcaagtcaagggcagggacataagaactatcgtctcagtggtgaatacataccacagccttcctggctttcctaagactgcttcatttttgctccttaattaaccagaaaaaaatttcatctatcttcctagatttccttaaaaatcagacttacagaatgttagagctaagccttcaagatattgtcttgcctataatcccagcactttgggaggccaaggcaggcagatcacttgaggtcaggagttcgagaccagcctggccaacgtggtgaaaccccatctctcctaaaaatacaaaaaaattagtcaggcatggtggtatgcacctatagtcctagctactcgggaggccaaggcaggagaatctcttgaacccgggaggcggaggttgcagtgagccaatattgcaccactgtactccagcctgaacgacagagccagaagccgtctcaaaaaaaaaaaaaatatatatatatatatatattaatgtctttaccccagacctgactagcagcagccagcatccatctttagccaccccactcccagtggccaaaataaaccttcctgggaacctgtggccataccttcatgacaataaatcaatctgctcaaagaaccctgtgatgtcagtttctgaggtagcttctaacaggaccctaacaggatttcttagaaaaagtttcactccaaacatcttttcatttttatttttttccgagacagggtctcactctgccatccaggcaagagtgccagtggcagaataacagctcactgcagcttcaacctcccatgctccagtgattctatcacctcagcctcctgagtagctgggactacaggcatacatcatcatgcccagctaattttttttttattttttgtagagacagggtcccattatgttgcctaggttgttctcaaactcctggactcaagtgatccttccaccttggcctccctaagtgctgggattccaagtgtgagccaccacacctggcctctaaaaagctctaaaaacagtttactaacactcatttgggaggcatctttaaagaggaactttccaggctttcagcaaatcacatcatataggaagcttggtaagattaatagtatatatttttaaaaggaaatttttctaatctgtctttgcctcactgaagtatttcataatgttaactcagaattagtcactgtggtttgtcatgctgttatctatgtcaaaagttttgccctctccctctcccccctctccctctccccacggtctccctctccctctctttccacggtctcccactgatgccgagccgaagctggactgtactgctgccatctcggctcactgcagcctccctgcctgattctcctgcctcagcctgccgagtgcctgcgattgcaggcgcgcgccaccacgcctgactggttttcttatttttttggtggagacggggtttcgctgtgttggccgggctggtctccagctccgaactgcgactgatccgccagcctcggcctcccaaggtgccgggattgcagacggagtctggttcactcagtgctcaatggtgcccaggctggagtgcagtggcgtgatctcggctcgctacaacctccacctcccagccgcctgccttggcctcccaaagtgccaagattgcagcctctgcccggccgccaccccgtctgggaagtgaggagcgtctctgcctggccgcccatcgtctgggacgtgaggagcccctctgcctggctacccagtctggaaagtgaggagcgtctctgcccggccgccatcccatctaggaagtgaggagcgcctcttcccggcccccatgccatctaggaagtgaggagcgtctctgcccggccgcccatcgtctaagatgtggggagcgcctctgccccgccaccccgtctgggatgtgaggagcgcctctacccagccgcgaccccgtctgggaggtgaggagcgtctctgcccagccgccccgtctgagaagtgaggagaccctccgcctggcaaccgccccatatgagaagtgaggagcccctccgcccggcagccactctgtctgggaagtgaggagcgtctctgcccggcagctaccccatccgggagggaggtgggggggtcagccccccgcccggccagccgccccgtccgggagggaggtgggggggtcagccccccgcccggccagccgccccgtccgggagggaggtgggggggggtcagccccccgcccggccagccgccccgtccgggaggtgaggggcgcctctgcccggccgcccctactgggaagtgaggagcccctctgcccggccagccgccccgtctgggagggaggtaggggggtcagccccctgcccggccagccgccctgtctgggaggtgaggggcccctctgcccggccgcccctactgggaagtgaggagcccctctgcccggccagccgccccatccgggaaggaggtgggggggtcagccccccgcccggccagccgccccatccgggaggttaggggcgcctctgcccggccgcccctactgggaagtgaggagcccctctgcccggccagccgccccgtccgggagggaggtgggggggtcagccccccgcccggccagccgcccggtccaggaggtgaggggcgcctctgcccggccgcccctactgggaagtgaggagcccctctgcccagccaccaccccgtctgggaggtgtacccaacagctcattgagaaagggccatgatgacaatggcggttttgtggaatagaaaggggggaaaggcggggaaaggattgagaaatcggatggttgccatgtctgtgtagaaagtggtagacacgggagacttttcattttgttctgtactaagaaaaattcttctgccttgtgatcctgttgatcggtgaccctacccccaaccctgtgctctctgaaacatgtgctgtgtccactcagggttaaatggattaagagtggtgcaagatgtgctttgttaaacagatgcttgaaggcagtatgctcgttaagagtcatcaccactccctaatctcaagtacccagggacacaaacactgcagaaggccgcagggtcctctgcataggaaaaccagagacctttgttcacttgtttatctgctgaccctccctccactattgtcctatgaccctgccaaatccccctctgtgagaaacacccaagaatgatcaataaaaaaaaaaaaaagtttaaaaggcctgccacctgctattccaaaaacactcttgccaatcttgacccacgagagcacctttggcaatggtttctgtttatctccaaaatgataagcagaaaaataaaagggagtagagggaagaagtagtttttgttttgcaaaggccaagttctttctgcatgatttttttagaagccatttcttttcaaaaccaagattcactccttgaaaatggaaatctgattttcaccttttagtaaaaccatttccacttagcccatcctcttaaaattctgagtaaaaaccaatgcaacaacctttgcaacatatacaaacattaattctaagaataaagtttaacaaagcactaaaaattcagacacaaatttggggctttaataaaagatgtaaagttattttttaacacttacccactcctcgacattggggggctgctcatcataaatgtgttccttgtcccacaaaatattggacttgtcatacctgtccatctttcttcgagttttcacagcaaagaaaattattaaagcaaaagccacaataatcatgaaccccagtacaatggcaatggcctaaaaaggagtggaaaatattggcataattagattttaattgcttaatcacaattcaccctctacatattattaaaacccttatctaccctaaggccctactaaatccatgtggtttaattgatagaaaactgaagcaaatagttacatttcagacatatcataaaacctaacccacactaactgggctaaggccagcaaatgtacacacacgtacatactgcttgactcaatcctcagaaaatgcctaatgttaggaactatcaatcatcaccctcatttcagagctgtaaaaaactagttccaaagcttgtacacctacgggccaagctttgtgcacctacgagaatggccagtaaagtaactcaatcattggtatacttctaaagggcctgaaaaatgctactctcaaaagtattcacagctttgaaatagccaatcatgcttgtaatcttgttcaaaacatatgcttggcaagcctttttacactgaatgtaaatttctgtccatagatctctatcttaccaaaaatgatgaagacatggatctaatcaagctataaatagcaaattgactaatgattgatttggtctggcaggtttctctgtttcaggagtcttgcatactactagaaagggccctgtaacaaagaaacttcctactcttaacagttctcccagtggtgataggatattaaatggtatattggcctgggaggcacttgaagttgagggaaatatcaggcctctaccctggatgtctgctaatgggaacaagaggctctccttccagctgtcttgacagtgacatcatttttcaaagagtaagtagtaagagaactaagagggataggggtgtggtaggataggagtaccaaccctcagtccctatctaccatggacatgtctaaatggcaacaacgagcactgtgaaaacctacgtctgcagggaaaaccttcagtcttctaaataatggtagacagatactagaggtctaactccaaaggagtgactcattcaggaatgggaactcctgagttagtgtaagaaaaaaggaaaaacaagggaaaaaagatcagtaactcagaaacatttcagatattaatataatcagtatgactcatggttactaaagtaggtttctcaactccaacctgcacatttgaatcacttgcttagcttttaaacatactaacttacactctgaaaactataaaacactattaaaagaagtttaacaagacctacataaatcaaaagaatcttacgttcatgaatcagaagacttgtaattgtaaagatgacaatacatccaaaattgacctacagattcaatataacccttcaaaatcctagctggcatttttttccaaaattgacatgctgatcttaaaatccatatggaaatgcaaggaatccagaatctagccaaaacagtcttgaagaacaaagttggagaactcccactccacaatttcaaaacttactataaagttacagtaatcaagacagtatggtactggcattaggacatatgattaatgcagctgaactgagagcccagaaataaatgtccacatttatgatcaattcatttttgacaaaggcatgaagaaaacttagtggaggaacagtcctttcaacaagtaacactgagacaactgcatataaacatgcgaaagctttcagaacccttgcttccatcatgcccaaaattaacacaacatgaatcacagacctaactgtaaaagctaaaattatgaaactatagaaaaattaaataatagaaaacataggagtaaatccttgtgaccctgaattaggcaaagcattagatatgacaccaaaaatacaagcaacagaagaaaaattaaataaactggacatcatcaaaactaaaaattttttttttttttttttttttgagacagagttttgctcttgttgtctaggctggagtgcagtggcacaatttcagctcactgcaacctccacctcctgggttcaagtgattctcctgcctcagcctactgagtagctgggattacaggcacgccaccgtgtccaggtaatttttctatttttagtagagatggagtttcaccatgttggccaggctggtctcgaactcctgacctcaggtgatccgcccaccttggccttccaaagtgctgggattacaggcgtgagctaccatgcccggcccaaaactaaaagcttttatgcaaaggacaccatcaagaaagtgaaaagatgcctataatcccagcggtttggaaggccaaggcaggatcacttgagcccaggagttccagcccagaccgggcaacaaagtgagaccctgtctctacaaaaaattttttaaaaaattatccgggtgtggtggcatgcccctgtggtcctagctactcaggagactgaggtaggagggtcacttgagcccaggaggtcaaggatgcagtgagctgtgactgcaccactgcaccccagcctgggtgacagtgagactctgtctcaaaaacaaaacaacaacaaaaatagcccaattaaaacatgggcaagtctaggccgggcacagtggctcacacctgtaatcccagcactttggaggccgaggcgggcggatcacgaggtcagaagatagagaccatcgtggctaacacggtgaaaccccatctctactaaaaatacaaaaaaaaaaaaaaattagctgggcgtggtggccggtgcctgtagtcccagctattcaggaggctgaggcaggagaatggtgtgaacccaggaggcgtagctcacagtgagcaaagatcacaccactgcactccagcctgggcgatagagcaagactccgtctcaaaaagaaaaaaaaaatggacaagtctaaacagccatttctccaaagataagagagaaatggccaataagtacatgactatatagctaataacattagctataaagaaaatacgaatcaaaatcacaataaagcaccacttcacttctcacccatcagcatggctagaatcagacaataacaagtgttggtgaggatgtggagaaattggaactttcatacatttctgatgtgaatgtaaaatgatgcaaactctttggaaaaactctggtagctccccaaaagattaaagagtcaccatatgacccagcaattccacccctaggtataacccaactcaagaaatcattaaaacataggttcacacaaaaacgtatacaagaatgtctatagcatgattctttttttttgagatggagtcttgctctgtcgctcaggctggagtgcagtggcgcaatctcagctcactgcaagctccgcctcccgggttcacgccatttcttctgcctgagcctcccgagtagctgggactacaggtgcctgccaccatgcccagctaattttttttgtatttttagtagagacggggtttcaccttattagcgaggatggtcacaatctcctgacctcatgatccgcccgcctcagcctcccaaagtgctgggattacaagcatgagccaccgtgcccagtctagcatgattcttaatagccaatgtagacacaaatgtctatcaactgataaataaaatgtggtttatccacacactggaatattagcaataaaaaggaatgagagaatggcacaagctatgacatgggtaaaccttaaaaacattatgctacgtaaaagaagcccatcacaaagaccacattgtgtgattccatttatatgaaatacctagagaatagacaaatttatagatgtaggattagtggttgcctagggctaagaatggttagggaaatgaggagtgaccgctaacgggtacaagtttctttttaggatagtgaaaatgttctaaaattgattgtggtgatggtggcacaattctgtgaatatattaaaaaccactgaactgttatttaagtaatcaaattacatggtatgttaatcatatcttaatgagactcagcccctcccccagatttaattagaagtggagccttgtcatcaatattttttaagagtttccagagtgattctatcacatatctcaagttgaaggcctctgctaaggagatggagaaaaaacccaaaacaccactcatacctcctggggatccacaacacagtagtgatacaaatactgatccacgtagagtccagtagctgcaggtgtataaaattggttgcagagggcatatatttgtgaaccatatagagatccagaagactgagcagttgggttcactcccattatatagacaattgtggcaataaacaccatgatgcccaggatagcactcactattatcacacttaagtagtatcttcttgttctggacatttcagatcttataacactggtaacaaagatcaccaacgcggcaatgaaacaaaaggcagccatggccaacatgaagccctttgctgctcttgggtctgtatagcctccgtagccatagccataaccatagccatagccatagccacttccgtagctaccaaagccacttcctccataagggtagcctacactacctcctaaaagggaagttccatagcctctgtcccaggcaagcgtggaggccacacaggcaaagatggcaatgcacatcacaataatgagcatagacaggatccgaatcactcctggaggagaggtccatttgtagaagtgaagaatttcatcttctgggtaaaaagagtaggctggctgagagagcattggtcgaacatgcatctctccaccatatatgtcattgcttggtgcataatgattcggtttgctgaaatgaacatgaaaataatttcaagttagcattttttggtagtaagcagaaagaacacaacttatttggaataatttaaaccattgggtaaatgaaactaaagcttatctgtgcacaggaatcacctggagggcttgttaaaacataagattattggcctctagccacaacccattctgctcagacatttgggttatctctgtttgggggtattgtaaacagtttaactataaacatccttgaatgtgtattctggtacggaacagtacttatttttctagggtatataaccaggagaatttctggatcacatatttttatatcttcaacttcactagacagtatcaaactgttttccaaagtgattgtaccaattacctacagtggaatgggtaactgtaatatatccatacaatggaatactccatagctatactgtccaatgtggcagccactagccacttgggtctatcatacacttgaaatgtatctagtccggctgggcacggtggctcatgtctgtaatcccagcactttgggaggccaaggcgggtggatcacttgaggtcaggggttcaagaccagcctggccaacatggtgaaaccccatctctactaaaaatacaaaaattagccagacgtggtggcatgcgcctgtaatcccagctactcaggaggctgaggcacgagaattgcttgaacccgggaggtggaggttgcagtgagccgagatcgtgccattgcactctaccctgagtgacagagcaagactccgtctcaaaaaaaaagaaatgtggctagtccaaactgagatacgctgttaaaatgcacagtggagagtctgaggtgggcagatcacttgaggccaggagtttgagaccagcctggagaacatggtaaaaccctatctctactaaaaatacaaaaattagccaggcatggtgacacatgcctgtaatcccacttacttgggaggctgaggcacgaaaatcaagaatcccttgaacccaggaggcagaggttgcagtgagctgcgatcacacccactgcactccagcctgggtgacagggcaaaaaaatttaaaaatgcacaatggatttcaaagatataatatgaagaaagaatgtaaaatatttcctgaatcattcattttttacatcaatcacgtgatgaagtaatgttttagatatacaagattaagtgaaatatattaaaattaatttcttcttttggccaggcacggtggctcacgcctgtaatcccagcactctgggaggccgaggcgggtggatcacctgaggtcaggagttcgagaccggcctggctatcctggtgaaaccccatctctactgaaaatacaaaaactagttgggcgtggtggtgtgtgcttgtaatcccagctacttgggaggctgaggcaggagaatcacttgaacccaggaggtggaggttgcagtaagccgagaccgtgccattgcactccagcctgggcaaaaagagcaaaactctgtcttaaaaaaaaaaaattatctttttatttttaatgaaagtataaaattacatatatggctcatgttatatttctacagtgctatgaagccaaaactgatgaactatgaatacatgcagttacaggtaatgctgaaaaaaatgaaaaaatacatatcgcattattatatttacataaagttttaaaacaggtaaaactggccagatgtggtggctcacacctataatcccagcactttaggaggtgggcgggtcacctgaggtcaggaatttgagaccagcctggccaacatggcgaaaccccgtctctactaaaagcataaaaattggttgtgcattgtggtggttacctgtaatcccatctacttgggaggctgaggcaggagaattgcttgaatccaggaagtggaggttgcagtgagccaagattgtgccactgcactccagcctgggcaacaaagtgagagtctgtctcaaaaataaataaataaaacaggtaaaactaaactgaaatgtttaggatatacaagatgataaaatgataaaagcaggtaatgatcatacgtcaggacagtggtctccagagaaaaggagaggacacagggaaggactttgaagtgttctgtttcttgacctgggtgatgagtatgtatgtttgcttggtctttcctcatgatctcctacatatgttctgtgtccttttctttatgtatgttgcagttcaccattatttacaaaagcaacacaaaataagtgtcagattagtggtgcattactcaattactatattctctagtatgttttaaaaactgtattgtcataaacaacttgtgtccccaccatgttttaggcactagtaaggaggttaaagaactggaacacaaccttcacgtgatattgtaaaatatgtatttagtcttcatctccattttctggcatacaactcctaaaatctttggactctccaaagtgataagtatcccttatatgctaatgagatgataggttcctggcagccctaggaagcttcaggatgggagctaggattagagggttggaacttttcagccccaaccctctctggacaggaaagaggggctgaagcttaaactgctcaccaatggccaatgatttagtcaatcatgcctatgtcataaagcttccataaaaacccaaaaggaccgaattcacagaacttctggacagctgaacatgtgcaagttcctggagggtggcacaaccagggagggctgcttcccacatacctcgccctgtccacctcttcatctggtgtttgttggcatccattgtaatatcatttgtttgttcattcattcattcattcttaaaagacagggtttccctatgttgcccaggctggcctcaaactcctgggctcaagcaatcctcctgcctcagccttctgagtagctgggataacaggcatgcaccaccacacctggcttttgtaataccctttataataaaccagtaatggtaagtactgtttccctgagttctgcaagccactttagcaaattaattgcacccaaggagacaactgtgggaatcctgatttactgtaggtgggtcagaaacacaggccacaacctgagcttgtggctgctacgtgaagtgggggcagtcttgtgggaatgagccctgaacctgtgatctgatgctatctctgacagtgtcagaattgaactgataattagaggacacacagctattgtccactgtagaactgattacttggttgctggtggggaaatatccccacaaattctggtgatcagaggtcacagatgtgttgtgacagaacagcaggagaaactgtttgtttttgcctatatcacactccactacacttatcatggttaaagctgcaaactacttagaggaggaaatccctatcaatgtttgatagcaaatttggaattcaaaaattcactgataagtcttcacatgaccaaggagcccaaaacccctcaacactgcttgttttagatcatggcaggaatcactcttaaaactgacagtatggaaagtattatgctaagtgaaagaagccagttacaaaaggccacatattacgtgatttctccatttatacaaaatatgcagaatagacaaatctatagagacagaaagtagaccaatagttgcttagggctgatggaactgggaggtgactgccaatggataggtttctttggagagtaatgaaatgttctaaaattaattgtggtgatggttctacaactctgtgaatatactaaaaaccattaaactatccattctaaatgggtaaattgtaaagtatgttaattatatctcaataaagctgttatttttatttatttatttattttttgagacggagttttgctcttgtcacccagtctagagtgcaatggcgccatctcagctcacctcaacctccgcctcctgggttcaagcgattctcctgtctcagcctcccaaatagctgcaattataggcatgcatcaccatgcccggctaattttgtattttcagtagagatgggggtttctccacgttggtcaggatggtcttaaactcccgacctcaggtgatccacccgcctcggcctcccaaagtgctgggattacaggcatgagccaccaggcctggccttttttctttttttcagacggagtctcgctctgtctctaggctggagtgcagtggcgtgatctcggctcactgcaacctccacctcctgggttcaagtgaatctcctgcctcagcctcccaagtagctgggattacaggcaagtagctgggattagaggtgcgcgccaccacagccagctaatttttgtatttttagtagagacgggagttcaccatgttggccaggatggtctcgatctcttgaccttgtgatccgccagcctcggcctcccaaggtgctgggattacaggcgtgagccaccgcacccggcctaaagctgttatttttaaaaactgacaatatgttcccaatggccacctaaatgaggcatttaaatggaagcttcattatcatttgtacaaaacaaaaaggaacatacaaatataaaccttggcaatctcttgaaacaaacattaggaataggtgacagcagttgtcctagcagagacaaactgtcattctgaaagttgagagaaattcagttttcagtgcagaccctttgatacaatttaaatttacaagtacacatatcgttttatttttaaaagcaaacacttaaagtttcaaccatacttattgtttacatgtgatagactttttaaaagagaataactaaagaattatttacttacaattcatcaggcctgtaaggaggtggactttcaagaggcctggatgacatggctgattgtcaatggtcagctgatcttcaggatgagcaatgccctttagcttccaagataaaccaatctaagcaacaaaagtagagttatggcattactactaagctcacagtttctttcttttcttcatcccacccccaccccgagacagggtctcaccctgtcacccaggctggagtgcagtggtccaatcacagctcactgcagccttgatctaccaggctcaagtactcctcctacctcagcctcccaagtagctaggactacagacctgcaccaccatgcctggctaattcctgtattttttgtacaaaaatttgaaatatatataatttcatattacttttgaaagttcatattaaatgagaatgtataagaaagtgcacatatagccgcactagcacatactagctcctcaatgcaaagtaaccatctaatgggttaaatgcctttatcattaaaaatgataataaaatgcatctataaatggtggaattgtagatatttttcccttatctccttttccaagtcttcgaaactgagcacaatttttatacaaggggagaaaaaacaatatgcatggtattaattggtcattttctgaaattttgtcctaaaattcttcagcacaagttcctaaacatctgaggagaaatttcactcaacaagcatttattaagtgcctacactagaccaggagagcctgtgggagtgacgtatgacagccagcgctggggtcctggctcttccaggctggtgtggtgctgataacacaggtggctagcttatggaacagtgaagtgggagcatggtggaatggtgtcatcttttaaaataaggttacagtaagaatatagtggatggaggatgagtaagaaaagggagggctttgaaagtctagtgggagtgtctcacttccttcaggtaggaaacagggagccagttcgtgattctcggcaagggaggtgtaagtttgatttgaaccagatttgaaagacaaagtcaacagtaaaaaggagcacctacagtcagcagcagcaaacctaggtgtgaggcaacaatgaaggactagcttaggagacagaagataggaaggaaactaacattcatcagacacctaccgacgtgctgggtgctttacataaaacctcctttcatcctcaaaacgaccctccatggttgattagtcactttacagatgcaaagagggtcagaaagagatgtgaagtaatatgctcaaggttatatggatgtcagtgagtcactcagatgtaacttgaacccagatgatttcatgtgcttttcactatgctagtttgaaacaatgagttccatttgggaaacaccagtttttgtggggagtgcacatctggtgttagcatccatgaggaagtgaagatggaggtcatctgcctacgtccgtaggtggatccatgggcactgagagctctccaggaaaaagacaagtctcagcaagatgtggtaaacacacaaccccctaacctataaagcttgaggattattctagaaaacccagtgctggagacactggcaaggtacttcccacatcagctacagaacttcatgccactccttagctatgttgaaccaacaataaattctttccaggttataccagtgattagtagagtagggaactttgagatctactggaaggtaaattccatgtgagcaggaatttttgcatgttttgttcactgattaaatcaatgcctggcacatagtagacgtccagataatttgttgaatgtttacaggaaccagattggaccatggatatctctgcctgcaaaacctcttgtgctttcaagttgaaggtaacggaaaagtatcagagtaactttaaaaggtatgatccctgaatgacacttgagtaacatctataatgagtacattaaagtatctgattttttttccttttctaatacggtctgtacaatcatacattaatatattaacaacagtacatcaattcagactcttaaaacttttttttaaattaatggcaactcttttttttttttttgagccgagtctcgctctgtcaccaggatggaatgcaatggcatgatctcagctcactgcaatctccgcctcccggcttcaagcgattctcctgcctcagcctcccgagtagctgggactacaggcgcacgctgccacgcccggctaattgtttgtatttttagtaaagatggggtttcaccatgttgcacagtctggtgtcaaactcctgagctcaggcaatctgccctccttggcctcccaaagtgctgggattacaggcatgagccaccacgccccacctggcaactctcttctataccctttaggacagtgtatttcaaatctctcagaattaaaccctgcccaactatgtattagataaatcctcaaagatggaaatatatagaatgttaataacaccaacacaattagcataattttccaaagacatgaaggaagatgacttttctacatttttaaaagccacttttaaagtataccatagagaaaagtgcacaaatcataagtgtacacagccctgtaactagcactcaagtcaatttctctatactttttttttttttcttttgagacaaggtctcattctgttgcccaggatgaaatgcagtgccatcatctcagctcactacaacctgcctcccaggctcaagcaatcctcctgcctcagcctcacaagtagctggactacaggcacatgccaccacgcctggctaatttttgtatttttagtagagataaggtttcaccatgttgcccaggctggtctcaaacccctgagctcaagctatccacctgccttggcctcccaaagtactgggattacaggcatgagccaatacacctggccaatttctctatattctagtaatggtgaaacacacatacaaatgagcaatttaggcgaaaatgttatggtactataaaaaggcaaaagtccagattgtcttcagaaaaagaacattaaggaatactgaatttaggccaggtgaggtggctcacacctgtaattccagcacttgggaggtggagacaggtggatcaccctaggtcaggagttcgagaccagcctggccatcatggcaaaaccccgtctctactaaaaatacaaaaattagctgggcatggtggcacgtgcctgtaatcccagctacttgagaaactgaggcatgagaatcgcttgagcccgaggtggaggttgcagtgagccaagattgtgccactgcactccagcgtgggtgacagagcaagactcctttaaaaaaaaaaagtaaaacagaaaatctgaagttaagcactattaaatgtgggatcctagttctgaagctgaatgtcaaatatccccaaattctaggttcagtggtagttttggaaactctaaattaatccagactcagtcttaagttgtcaaaaattcaaacaagatcccttttcaaactgctatttccaggattcagagttgtcacgtctccccaaaagcacggattttaaattgtgaaccaaatcatgtggctcatgcctgtaatcccagcactttgggaggccgaggcaggtggatcacatgaggtctggagttcaagaccagctgaccaatgtggtgaaaccctatctctactaaaaatacaaaaaattagaggggcgtggtggtgcatgcctgtaaacccagctacttgggaggctgaggtagcagaattgcttgaacctgggaggcggagttcgcagtgagccagtattgcgccattgcactccagcctgggcaaaaagagcaaaactccgtctcaaaaaaaaaaaaaagaaaagaaagctcgttaagaacaagtcatgccacaccaacttcatttccttttctgggaaggttaccaaactggtggattttattttctcctttattatttcctcttcagggaatgcagagagaaagaatcctgaaaatcttgagcacatccttgtgtgggtgggcagattcccaaggggctggattacggcacccaattagcacaaaagaatgaaccatttatgtccacctggtgggaggtctccactggtaaacacagacaaagtggaggagacacgcttatccagatttgcagctgaccaaacacactggaaaggataactaacccattggctagggccatcaacactaagcaagatctctgtaatgtcagaatgatgagtttgaaacaacctagtggttttaacagcccccatttactggctcgcaatctgagacaaattccttatctcctctaagtgcactcaaatgcgggaataatcctgacctctgcactgggataagaaaaagtcttaaagagctgggcgcagtggttcacgcctgtgatcccagcactttgggaggccgaggcgggtggatcacgaggtcaagagatcaagaccatcctggtcaacatagtgaaaccctgtctctactaaaaaaatacaaaaattagctgggcttggtggcgcgcgcctgtagccccagctactcaggaggctgaggcaggagaatcgcttgaatccaggaggaggaggttgcagtgagctgaggtcacgccactgcactccagcctggcgacggagcgagactccggctcaaaaaaaaaagaaagaaaaaaaccacaagaaaaagtcttcaagaaaatgggcaactgcattcatcataaggtggttatcctgaaagtaagaaatttcagtgcttaggcacttaggtatattgtatccattttcaaatacagctgaccctccacatccatgggttttaaattctgattcaaccaacctcagacagaaaatattcaggggaaaaaaaaattaaaaattacagggcaggtacagtggctcacacctgtaatcccaacactctaggaagctgaagcaggaagatcacttgaacccaggagtccaagactgaccacagcaacatagtaagaccccatctccacaaaaaatttttcttaaaattagccaggcatggtggcacatccctgtaagttccagctactcaagagactgagatgggaggatctcttgagcagaggaagttgaggctggagtgatcatgccactatactccagcctgagtaacagtaataccctgtctaaaaaaataataaacaataaaacaaaaaatagatttttaaaactacaatatcacaattctacatagtatttacattgtatacggtattataactagagattatttaaagtctacaagaggtctgggtgcagtggctcacacctgtaattccagctctttgggagcccaagacgggcggatcacttgaggtcaggagttcgagaccagcctggccaacatggtgaaaccctgtctctactaaaaatacaaaaattaactgggattgtgccgggtgcctgtaatcccagctactcaggaggctgaggcaggagaatcgcttgagcccaggaggcagagtttgcagtgggccaaaattgcatcactgcactccagcctagatgatggagtgagattctgtctcaaaaaaacaattaaaaaaaaaagtatacaagagcatttaggccatatgcaaatacaaagctattttataacaaggacttcagcatcctcagattttagtatcatgggggtcctggaagcaacctctcacagatactgaagggtgactatattggtggcataaatgagtcatttttaaaatgtaaactgattttttttttttttgagacaggagtcttgctctgtcatccagcctggaatgcaatggcgtgatctcggctcaatgcaacctccacctcccaggttcaagcaattctcccacctcagcctcctgagtagctgagattactggcacatgccaccaggccaggctaatttttgcatttttagtagaaacggggtttcaccatgttaaccaagctggtgtcaaactcctgacctcaggtgatccacccacctcagcctcccaaagtgctgggattacaggcatgagccaccatgcccagccataaactgaatttttaaaaagtcaattccatagtacagtatagaggagaactaatttaataatcgttcttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtggttcatttttaaaggtgcatttctttggtaagaatttcaacaaaagctaacaacctatcccaaactttattcacagaaatagtgctcatatctaggaataatatgctattaaaaagaacaaacaaaacctgatttgtacatcacattctaaactatgtgcctctccaggagggtgactaagatcattaaagatctagaaaagctggccaggcaccgtggctcacgcctgtaatcccagcactttgggaggacgaggcgggtggatcacaaggagatcgagaccatcttggccaacacggtgaaacctcgtctctactaaaaatacaaaaattagttgggcatggtggtgtgtgcttgtaatcccagctacttgggaggctgaggcaggagaattgcttgaacccaggaggcagaggttgcagtgagccaagattgtgccaccgcactccagcctggcgacacagtgagactctggctcaaaaaaaaaaaaaaaaaaaaatctagaaaaaccatgtcttaagacaaatgattggaaaaacaggaaatgtttggcctggagaacttaacgtcagaagaatcgctttagcagccctgaaatatatgaagagctgtctttgttatcctagaaatggttaaaaaaaaaaaattccaaaaaccacaggctgatttcatctcaatgttaggaagcctctccctcaccctgaccccacaccctctccgaaaataactaacaacaatttgagctcatgcaatttatgcaaagcttaagttatttgatatttttttggagaccagactggaagacttctaaggtctctttcaaagtgaatctgtgactgtgctttaaggccagcagccaaaggtgaaagaggaccaatgcccagcacagcaacattaacaatctgtacatgtgttgagtgaaggaaaaaatgagaatgaagaggccacttatcacctacaggaacttatgtcaggagagtgacaaggacagaagtcagacagctaaattagagtcgggggcaaaagggaagcagcagatagatccttgtcaaatatgttaatctgaaaaccagcatcttgggctaatgataaaatataaagtgttctccccttgacaatgtttactgaccaaaagctgtcttaatggaaaactaagctaagatgaaaaaaacaggctgaggctgggcaaggtggctcacacttgtaatcccagtactttgggaagccaaggcagagggattgtttgagcccagaacttcaagatcaggctgggcaacagagtaagactccgttatctatcttaaaaaaaaaaaaaaaaaaaaagtataaaaaaagaaaaaatagtctgaaaatgctttggcctcaaattattctttaaagaaaactgtcaataagtgaaaaataaactttattgtatttaagagaagtctgttccttttagagcacatgcagtaactgtcaatttgcctttaaaaagtttaagttgtggccgggcgcggtggctcacgcctgtaatcccagcactttggggggccgagacgggaggatcacgaggtcaggagatcgagaccatccccgctaacacagtgaaaccccgcctctattaaaaatacaaaaaattagctgggcatggtggcaggcgcctgtagtcccaactactcgggaggccgaggcaggagaatggtgtgaacccgggaggcggagcttgcagtaagccaagatcgtgccactgcactccagcctgggagacagcgagactctgtctcaaaaaaaaaaaaaaaagtttaagttgtgccttatattaaatgatttagactacaggcacatcattagtaaattgtctaaaaatttgaagttaggcagattttgtaatagactctgtgtcagaaattgtatttttaataaatcttccaggtgatttttaaacacatcacatattttgagaattgctgtctacaataaaggtgtcaatccaaaaaggacattgatcttgcaatttcctgtctagaaagcccagatcttttacacaacagacacctgctgttcaggtctcagctcagacgtcaccttctgggagatgccctccctgtccctcactccatcacacaaaacttgttttttttttcagagcaaactcccctctgccctcatacctaaaatataggtatcatctccaccgcatctggaatgcccatatcccagacatcaaatgtctattttgaccatcatttatatccctggtcgctggaactagccctggcacaaagtgattgtcaatgagtactcaattaataaaaccaacagtcaattattagagttgggatttcaatccagcagtgaatgccttgaagttcttcacacaacactcaataaacgttattttttccaacttcagtttgtcaaatgtaattaagtgcgtagagtctaagagaaagggagaaaaagaagacagaacagtctgagaatcacctgtgagcctgttagaaaggcagaatcccaggccccactcctgacctcccaatcagaatctgtgttttaataggatccctaagtgattcataccacagccaagactggaatcactgggttacggaacagcggcaagcctaggggttaaaacaaaaagcctaacataaatctgcatggtctgtttactctcttatttccataaatagtaatttgatgaaaaagatccattaatattccaatcaaataagccttaaaatgcaactgaagaaaacttccttctgggaggttcctaggaagatgaaagatattacatcagatcatttatgtggttaaaagtaatatactattttgaaaaggtagtaattccaacactacctttagaagaaaacaagaattttaccttgatatcaagcaaaatgcgggaaatcttgtatcaggctacagttactagtcaatggtagaaaagtccagaaaaattccccaaatctggttctggaatatcaaggaccgctgcttctgatactccttcccatattagctgaagcagtttgcaagcaagcccacctgcaacgtttcccccacggcatttgcccacttttaaaatggagttctactaaggcctgccttttagagttgttgggataattaaatgagaaaatacagaatgcttttaccacagtgcctcacgtgcaggaggcactgctgcccactatttcccgaaatggcctggaaactgccaaaaggtggagaatcatgtcttaccgatctccctatcctctgctccgtcacctaacaaaggaggcccctaataactaaataaattgcaaaacgaccaaaaaaaaagtgttgctttgtttgaggaaatatctctgcctcccacacacacttaagatgtctattttaaagcaccactaagaaaatattcataaaggctgggtgtggtggcttacgcctgtaatcccagcactttgggaggccaaggcgggcgaatcacctgaggtcaggagttcgagaccagcctgaccaaatggcaaaaccctgtctctactaaaaatacaaaaattagctgtgcatactagtgggtgcctgtaatcccagctattcgggaggctgagcaggagaatcgcttgaacccgggaggcagaggttgcagtgagcccagatgatgccactgcactgggggacagagccagactccgtctcggaaaaacacacacacacacacacacaagcacctcatatgtacagtgcaaaagaactactgttactattgttacacttgggaacgcctagttttctatcacaccaagaatcaccaaaaaacaccataagtgccttcatgggaaacgtttctcttttccaggtatcccaataatacacctgttgcctaagggccacacactgactggcctggaaagccgccgcctcctcctcgagcagggtaattccccaagcgggcagtgtggccagcgagccccgggtccggcctaaggatgccgcggcttttccctcgggcccggtggcttcccgaggagcgcgaggggctcggcgccgctcccaacccctaggcgcagaggccatcttggccctcgacccctgctccccgcacgcttcctccgacgcaggcaacatggctggcgcgcggggccggcccagtcccggaggtccccaaactccgtggcccggctgggcgcgggtcccggcttccgtgcgcaccgaggcgctcccaggcagcgcgcgcccacgttcgccgggcaggcaccgcccggaggcagttccgcccccctgggggcagcccttttggtcacggatgagaatccgaagcgtgagcagcttccctcgaagtccagcctcactcgaaattaactccccgccccccagcttaaatcgacgcgggttcacacaactcgcaacaagtggattcgaagtagccagtgtggcccacaccgtgactcctggaatatttcacagattgaatccagcccccgtctccccgggatatccaaaggggtggggtgggagcggaaggaatgaaattccccccgggatctaagccgcccgggccgccgaacagccgcctcgctgcagcctcaggcttaggacccccaaggagctgggcgcaggatccctctccatgaaggccgcccccccaaactgcagccccagagcggatgcaggatcgtcgctgttcaggaatgtcgtgccccataaaagtgaaaagttgcccgcgccgctgaggcactgctagctttcagcgtttccgcggaataaagcttgatcggcggctccaagccacccctcgccccaggaggcagcctcccaagttggccggtgctgctctctccgcagacccgcgcctctctggttcccacgagtcccagctcggggacgaaactgccaccgaaaccagcgcggagcgtcctccccccggcacctcccctaacatagtcgccgcggtccccccacggggaccctcgggctcccgtgcgcccctgacgccgcgcccaacactcacccgctcgccgcaactgggcccgaccctccgggggccaacggtgccagggagcgcgctcacctggcgggcgcacctgacgccgcaccgaccgccagcgctcagccggggactgggctggggacgtctcctcccccttctccctctcctttccctcctccctacaaccggccctgcccccgggcatgcgcaccaacgtggaagggggtgcgggaagcctgcgggccagcgccgcgagtcccacctgctgcgtcctagaccggctcctcggcgctctggacctggctctcggttcctgccgcctccgccagaggaagcagggagggagaggtggacgcgggagtgtaggtgtggtgtgtcggcctcctccctcggtgaccaattcacctgaaactcggatgggagggggcgggaggacgcggtcctgcttcccacaccctgccagcgcgctgttaaaggaaccgcgcgacgttgcggcccgagaggcggggcgcagaggagaggcgcgggctcctagggggcagcacggatgggggtccctgaccaccccggggtgcgttcggtgctccgcctgcttcggatggaaccttggggtgtctgatggagagaggccgaacgaggtccagaggggactgtttcctccggaaagagggtccaggcactcagcactttgataggaaaggcacgtcctcacaggacacttttctgcttccagaatttgattaaactgttgctggaaaaaggcatctagatgtattgctccaacgaaagactcctgggaaaatttcaaaagtcgtgtgtaaacattggcgctgtttctgaatctctagattcagaataagagacaattacttagaggggttaaaatgagggtgaactactgtaggtgttagttgccatccagcaggctaaagtgcataatacagtttacacatcaccaccccagggtcctctcctgcccacccggtccgctcttgaggaccgggaaatttaaactattatggctctttggcctgagaaaaagcaccttatacgttgtttaccaacctgtagtgctttaagaacaacactacttaaaaagcaaaataaacttggtttactttttttttttttttaagaaaacgaaaaagcaccttagttccgggtgctgtattctatttcttgatctggattctgtttccaagggaaatttcatagtctgcacttaacactgtgtatatttttatgtatgttggttgtttttcaacatattttttaattgtactccaggatgtggcaattatagttcttggcatttaactatctgcattgaaagcgaacttttaggtttcttacatcctgcttgtctttgtgttccaatctggaatgtcagcattgctaataaatttctatccaatcccacccacttctctacctttaattaaatggttagagatgtgactctcccatacattagatcttaaggcacaattcatacttgaggaagtaaaagcactatataaatatgaggtatttcagatgatggcagctttaatgggtaattaatttaattggtatttttttcgtggaagtcattgctacaaatgctttaatatgactatgtagtttttgaatgatgcagtttaaattggtattgttaacactggggaagtcaggttaatccccttaatgttccctgtcagattactgaaatctccaaacattccatttggtttataattaaacaagggaacatttcctaatactctcagatttgtaaacacatgtctattattttataatgtattttgacatgttctgaagagatcttaggagtttttttccactttataaaagagagttcacataccataaaattcacccttttaaagggcacgtacaattcagtgggttttagtatactcaccagattgtacaaccatcaccaccatctaattccattttaatcgcccccaaaagaaaccccatgcccattaatagtcactccccatttcccctctcccctcatccctcggcaaccactaatgtactttctgtctctattaatttgcctattctggacattttatatgaatggataatacaatatgtgccctttgtgtctgtcttctttcacttagcataatattttaaaggttcatccatgatgtagtatgtattggtacttcattcctttttataactgaataatattccattgtatcgatgtatcacatttcgtttaatcattcatctgttgatgaacatttgggttgtttctcctttggggatgttatgaataatgttactatgaacatttgtgtacaagtttttgtgtggacatatgttttcggttctcttggtaaattaggtttttaaattaaactttttatcattttaagataacttatgcatatcatgttatttttcttattcccaccctaaacctaaactcaaagacatgttgtgttgggtagaaggctttcatattctatttgctttcccaattcattccttcaactattttctgagtgcctaatctgtacacacacgagtgaacaaaactcaaaaatctctgtgaaacttactttctagttagttctgagttcatccatatggaataataggattcattaattgtatgaattctattttattcgcttgagattaattttctaaacaacaacatcaaaagaacggttaactattgtccaatattgtgtatatttcatagttgaaagtgtctagaaagaaaatccagccttaaaacttaaacacatcattcttcaataccaaaacaaaatttgttggatgttaaatgatgccatgctcaatttaatcatgttacataatcataaattatagcaaaatttaattactatattttttaccaaatattccttcttggcaactcacagtagtattgagtagtatccactattgaatattatttgatgaaaatccccgtgactcagagcaatgtaaatattattttcagaaccccatgattagaaacttgttgactttacctgcagtcaaatggataagatgaaaagacaatttgtttctccttttctatgtgtaaaagagaaacttaagagctcagattatggtgtcagaaatctcagttcaaattccagtgttgctacttggtagctgggtaggactaaaggaaattaaactatgtaaggttcatttttttccaccgtaaatttgagatgataataaacaatactgtctttataagtctgttggtgggaatgtggagcattcaccaagacagactatatgctgagccacgaaacaagtctcaataaattgagcaagccattgctgtatcctatatgcctgaaatagttcctgtcacataggaattacataactatgtgttggatgaatgaatgaatgactatagccctgcttcccaaatccaacatgcctgtggagtcttgtcctcctctcagatggcctcctgctattgtgaaacccgcacgttccttagtagcatttcaaggcttacatctctagtactagggtttagaggagaaaagacgggagattaacatagttccactgtttccactctgccttgcctgcttagtaaatgaattcaaagactggtatgtgtccaaggcaactcagtttggagttgctgagggcctggcctgaaaggcctctagtttctctgcccagtcatgaggagggggaggcttctggtccacacaggacagtttccttggacaggtgtatggaagaatttatggggaagccactaggaagacaatttctaaaaggatgattacactagatgagtaaacctttatcttctctattcctatgtgttaagcaagatcctcctgggaggaatccatatttaaacaaagagactcagcacctgaacaggaacttcaacaggtggaagaataataatagcaccatttactcagggaaaaacatgttctaagtactatgctaagtgtttttttggttttctgtttgtttgttttgaaacagagtctcctccgtagcccaggctggagtgcaatggtgtgatcagctctctgcaacctccgcctcctgggttcaaatgattctcctatgtcagcctcctgaatagttgggactacaggcacctgccaccacgcctggctaatttttgtattttcagtagagatgggatttcaccttgttggtcaggctggtctcgaactcctgacctcaggtgatactaacgccttggcctctcaaagcgctaggattacagaggtgagccaccatgcccggcagttttatgtttttttttatttttttctggtttttgggtttttttttttttttttttttttttttgagacggagtctcgctccgttgcccaagctggagtgcaatggcgcaatctcagctcactgcaacctctgcctcccaggttcaagcgattctcctgcctcagcctcctgagtagctaggattacaggtgcccgccaccacgcccagttaatttttgcatttttagtagacacggggtttcactgtgttggtcaggctggtctcaaactcctgacctcaagcaattcacccgcctcagcctccaaaatgctgggattacaggcttgagccaccgtgcccggctgggttgtttgtttgtttgtttgtttttgagatggagtttcactcttgttgcccaggctggagtgcaatggcgcgatcttggctcactgcaacccccacctcccaggttcgagcgattctcctgcctcagcttcccgagtaagtgggattacaagcatgagccaccatgcccagctaattttgtattttcagtagagacgggctttctccatgttggtcaggctggtctcaaactcctgacctcaggtgatctgcctgcctcagactcccaaagtgctgggattacaggcgtgagccaccacgcccggccccggctgggtttttatttttatttttttggtctttacaagaactttatgatgtactattattttccccattttacacataggaaaactaaagctcagaaagtattgatcatttactcaagttgtctactaagttgtagagtcaggattcaaatacaggtcatctgattcctgaaccaatgttctgaacagttttactatattttaggactactttttgtctataggcaatataggcaatattctgtttcttcccgagtccaagttacacggctgttagccttacaacaatttatcaagctgtgcatatgttttatatacatttttgtaggaattttgtatttcataatttaaaaaaattattttgagtcacctctgtcacccaggctggagtgtagtagcatgatcatggctcactgcagcctctatctcctgggctcaagcgatcttcccacctcagcctcctgggtagctgagactacaggcacgcacccacaactggctgatttttgttttgttttgtttttaaataaagatgagatcagaccgggtgcagtggctcacgcctgtaatcccagcactttgggaggcggaggcgggtggatcacttgaggtcaggagttccagaccagcttggccaacatggtgaaaccccgtctctactaaaaatacaaaaaacattagcccagcgtggtggaagcacctgtaatcccagttacttcggaggctagggcaggagaatcgcttgaaaccaggaggtggaaactgcagtgagtcgagatagcgccactgcactccagcctgggtgacagagcgagactctgtcttaaaaaatatataaatataaatacaaataaataaacagaaatgaggtctctcaatgttgcccaggctggtctcaaattcttgggctcaagcagtcctcccatctcggcctcccaaagtgctgggattacgggtgttagccaccacacccggccaaaatttgctaagaatagggtttagagacagtcttagaaaatagttggagatccacatctaggatttttgttttgtgaataacatttttcaaataccagcagaaaatacattcataggatcagagtaagttgagatcagcatctaaagagagagtaaatgggtttggtgtgggacagaatattggcacaattataaggataatacagagaaagagatttgggactgcttttttttaattgtatcagtcatctattgcagtggaaaactggccttgcaggctttttcaggaactagccttcctgaatcttttaagctcaaaaaaggaaagaggaaaaagtaaacattaaccaaatattgtcttcgcttacctacttttaacttcatggggctctttacctcctgtgtccccaaactgaaaaagataataataattatctcgtaatttagcataaggaatcctaaccctagaaaaatctcttgaactgggtcagtgtgaaaccaatacactttaagcagatcacaaatttctcttgttattctttggttttgaggtacgggactccttttattcgatacaggggtttccaaatagcagcttttcttgtttttttgtttttgttttgtttttgtttgagacagagtgtcggagtctcactctgtcgcccaggctggagtgcagtggcacagtttcggctcactgcaacctccacctgctgggttcaagcgattctcccacctcagcctcccaagtagctgggattacagacgcgcaccaccacgcctggctaattgttgtatttttagtagagatggggtttcaccatgttacccaggttggtcttgaactcctgacctcaagtgatctgccctcctcagcctcccaaagtgctgggattacaggcgtgagccactgcacctggccccatatggcagcttttctgattttacttggagtttctttaggataaactcaaggagcctacaagcaaaaactcactacagttcctgaaatgttgttgttggctgacacggtacagcgtaagtgggacatatgagaattgtatgtgaaaaggaatatttattcagtcaagaaatatttacctcagtacctgctgtataccagaccctgttctaagccctggaaataacagtggcctcaagacagacaaggtcctttatggaagtttagggaggaaatagttaggagaggaaatacaacaaagatgatgaaactgaaaataaacaagataatgataaatgacttggagaaactaaaccagctaaggggacagagaaggctaggagaggcaggtggaggaagagctgccttgtagagtggtcacaggtggctgctctgaagaggtgacatttgagccaagacttttagtgagaaggaaccagccatgcaaagatctgtgacaagaacattctagggctagaatctaggaccactttggacattcaaagcaaaggaaggaagaggaaggggagcatgggggagatgaaacgcaaggaaggcagaggtcagatcttggatgctgtgccataaagtgtctgggtttctttttctttctctttgttttgaggcagggtctcactttcccctgggctgcggtacagtggcacagtcatggctcactgcagcctcaatctcctgggctcaagtgatcccctctgctcagcctcctgagtagctgggactacaggtgcacgccaccgcatccggcaaactttttattttatttatttatttattttgtagagacgggtctcactttgttgcccaggctggtcttgaactcttgggctcgagcaattctcccacctccgcatcccaaagtgctgggattataggcatgagccaccgcacccagccaactgtctgttttcttctaactgcaacaggaaggctttgaagggtgatgaattatgtttggaatgttgtgaaattctgcatgttaacctaagtattttcctgtttttagaataatgttttgtaatgcttgagcattttatctttaaagtttgtggcttctgaatagaaaggactaaacttgagaaagagagtctgggtgatctgaaacccagttgataggatctggagaaatgcagacgactcctattcatcttcctacatgtatcttaattagaaagattggcctttgtgcctgagaggtctggtgacagtgccaggggtggaatgagacatggtaggagaagctctaccataatcgcatgatgttttaaaacgctttttctgtattttctaaaatttctcaatgaataggcatctattatttccaacaattaggaaaaaaaacattttattttattttatttatttatttttgagacaaggtctcactctgttgcccagactggagtgcagtggcacaatctcggctcactgcaacctccacctcccaggttcaagcgattctcctgcctcagcctccctagtagctgggattacaaatgccagccaccacacctggctaattttttgtatttttagtagagatggggtttcaccatgttggccaggctggtctcaaactcctgacctcaaatgacctacctgcctcagcctcccaaagtgctgggattacaggcatgagccatcatgcctggccatattttaattttttccctaacttatactgtgttgaaaatttcaaacccatagaaatgttgactgggcatggtggctcacacctgtaatcccaacactttgggaggccgagacgggaagattgcttgagccaagaaatttgagatcagcctgggcaatatagggagaccccgtctctacaagaagtttaaaaattagctgggcctggtgtcacatccctatagtcccagctactcaaaaactgaggtgggaggatcgcttgatcgcccgagacagaggcagcagtgagctgcaattgtgccactgcactcctgcctgggcaacagagcaagacaatgtctcaaaaagaaacaaacaaacaaacaaaagttgagaaatagtacaatgaattatatccttcacctaaattcaccaatcgttaacactgcccacatttgttttttctctcacacatatacataaaaagtatacatagtatgttttattttttacatttttattatttattttgagaccgggttatgatattggctaatttttgtatttttggtagagacagggttttgccatgttgcccaagctggtcttgaactcctgggctcaagcaatctacccacctcggcctcacaaagtgctgggattacaggcgtgagccaccgctcctggcccatggtatactttttttgcccaaccatttatactctaacatttatacttttttgttcagctttctaaaattaacttttaggtataataataccttaccctaaatacttcagcatgtatctcctaagaatcaagacatacttctgtacaactaccatatcatgaacacatctccaagcaaacattaatatagattatatttacattgttctaattgttccaaaaatatcttctatatcttctatacatatatatatgtgttcttttttaaaatccaggaaccaatcaaggatcatcctcacatctcaccatcatgcctttgttttttctttttttgagactgggtcttgctctgtcgcccaggctgggatgcagtggcacaatctcagctcactgcaacctctgtctccccggttcaagcaattcttgcacctcagccccctgaggagctgggactacaggcacctgccaccaggtccggctaatttttgtatttttagtagagacagggttttaccatgttggcctgacctcatggctagtcccaaactcctgacgtcaagtgatctgcccacctcaacctcccaaaatgtaagtctccttaaatcttgaacagttccattgccatttttgtctttcatgacactgccatttttaaagaatctggtccagttgtcctgttgcatgtctcacaaccaggatttgtattttccttcctcattattagatttaaaggaaacattttggcaaaaatactacacaggtgatgttgtggacctcatagagcattacatcaggaggctatcactatcaaattgtcccaggatgggtgatgataagtttgaatgcttggttcagggtgtactctccagatctctcttttctctttgtaatttgtaagtattccatggagccgtgctttgattctgtgtgactctcttattccccaacaacctttcatccaatgaaagctttcagtgtccattgctgatccatcattgcattggttgttgcattatggttattttccaatactatcaactattaacatcaatactatttaatactatcaggggaatttttaaaaatttttaagtgtaggccgggcatggtggctcacgcctgtaatcccagcactttgggaggccgaggcaggtggatcacgaggtcaggagattgagaccatcctggctaacatggtgaaaccccgtctctactaaaaatacaaaaattagccaggcgtggtggcgcgtgcctgtagtcccagctactcaggaggctgaggcaggagaatcgcttgagcccaggaggcggaggctgcagtgagccgagatcgcacccctgcactccagcctgggcaacagagtgagactgtctcaaaaaaaaaattgtaagtgtgagtaaaagaagttggaacagactctaaatcattaaaatattgacttttcatgacataattttccttcttgtgatatatgttctttctattttgcctttaatgagtcaaccaatgccctcccctccataatagatgtgttacttttttatttactaaggacagtagatgatacaggaagaaatcaaagcatactttttgtttttttgttttttaagacagagtcttgctcagttgcccaggctggagcgcagtgccgcaatcatagctcactgcaaccttgaaatcctaagctcaagcaatcctcccatctcaccatgtccagctaagttttaaaatgttttgtagagatgaggtctccctaagttgcccaggctggtctcaaactcctgggctcaagcagtcctctctcctcagtctcccaaagcactgggattacaggtgtgagccatcacaacgggcttaaagcatatgtttttgtacagcactcttccttcacatagtctaggacaggggtccccaactcccaggccacggaccatggcctcttaggaatcgagcctctcacctcctgccatggactggcacagtggaaatagctaattcaggaaccgggctatacagcaggatgtaagtggctggcgagtgtgttagagatcagcagcagcattagattctcatagaatcatgaaccctatggtgaactggggatgcaaaggatctaggttgcagcttcttctgataatctaatgcctgatgatatgtcactttctcccatcacccccatttgggaccatctagttgtaggaaaataagctcagggctctcactgattctatattatcgtgaattaaataattatttcactaaatataaaaatgtaataataatacgaataaagtgcacaataaatgtaatgcactggaatcatcctgaaaccatccccctctgccctgatccatggaagaattatcttccacgaaaccgattcctaggccaaaaaggttggggaccactcgtctagaagatgaggcatacactcataaaaattaaaaataaaatgaaaaggccgggtgtggtggctcacgcctggtaatctcagcactttgggatgccaaggcggagagatctcgaggtcatgagatcaagaccatcctggctaacacggtgaaaccccgtctctactaaaaatacaaaaaaattagccgggcatggtggcaagcgcctgtagtcccagctcctcgggacgctgaggcaggagaatggtgtgaacctgggaggtggagcttgcagtgagccgagatcatgccactgccctccagcctgggtgacagagcgaaactccatctaaaaaaaataaataaataaaataaaaggacacataagtggcagatgagtggcagagataaggccactctctcttctttttttttttttttttttttttgagatggagtcgctctgtcacccaggcgcgatctcggctcactgcaacctccgcctcccgggttcaaacaattctcctgcctcagcctctggagtaactggaattacaggcgcccaccactacgcccagctaatttttgtacttttagtagagacgggatttcaccatgttggccaggctggtcccgaactcctgacctcaggtgctccgcccgcctcggcctcccaaagtgctgggattacaggcgtgagccaccgcacccggcacactctctgttctaagtggaactgctcacctggctgcccatctgtccctcccactctagtctctgtgacttgccttttgagcacactaattcctctacctggaacattctcttcccaactttgcatctggaggttcatattctaaaatattgccagtgcttcaagactgagctgagatactatctctttcatttattattattttttaaaagctccttaaggccgggcgcggtggttcacacctgtaatcccagcattttgggaggccgaggcaggcagatcacctgaggtcaggagtttgagaccagcctggccaacacagtaaaaccccgtctctactaaaaatacaaaaactagtctggtgtggtggcacacgtctgttatcccagctactcaggaggctgtgaggcaggagaatggctcagacccaggaggcggatgttgcagtgaacccgatatcacgccattgcactccagcctgggcaacagagcaagactccatctcaaaaacaaacaaacaaacaaaaaaactgggccaggcctggtggcttatgcctgtaatcccagcactttgggagaccgaggtgggcagatcaggaggtcaggagatcgagaccatcctggctaacatggtgaaaccccatctctactaaaaatacaaaaaattagctgggcgtggtggcatgcacctatagtcccagctactagggaggctgaggcaggagaatcacttgaacccaggaggcagaggtcacagtgagccgagatcacgccactgcactccagcctgggtgacagagcaagactccttctcaaaacaacaacaacaacaacaaaacacataaaaaaacaaaaaaaaactcctttaatttctctttgggaggccaaagtgggcagactgcttgagtccaggagttggagaccaacccgggcaatgtggcaaaacccggtctctacaaaaaaattagccaggcatggtggtgggtgcctgtggtcccagctactcaagagggctgctgaggtgggaggataacctgagcctggggaggtcaaggctgtggtaagccatgatggtgccactgcactccagagcctgggcaacagagtgagaccctgcctcaaaaaaaaaaaaaaaaaaaaaaaagcatcacagcacagagtgagcaccttcaccttcttcccttcatcagtatagtgggtaagggagccagggtatcaaaagattctactttgattcccaaattcagtatttaccagctctatgacactttaaataaataacttaaacttctgaggcttaatttccttatttataaagtggaggtgatgccaggcccagtggtgcctatgtgggggtaccggtagtcccatctactaggaaggctgagtgaggcaggaggatcgcttgagcctaggctgattgggtgtcctcactaagttctgcatcaatatggtgatgttctgggagtggggaccactaggttgcctaaggaggggtgaactggcccaggttggaaacggaccagctgaaaactcccatgctaatcagtagtggtatatcctgtgccagtcatcagtagtggtatgtcctgtgccaatcatcagtagtggtatagtgcctgtgaatagccactgcactccagcctgagcaatataatgagacccccaataaaaaagtttttaaatgaaaattaaatggaagtgatggtaatacccaccttgcaagggttgtatgtaaaatggccttattcctggcacaaaataaatattattcgatggatatttagtagctgcctatgcttcctatatcaggatgatttcagctcaatgctacaaaaaacaagtttaaagtagtttaaataataaggcaatgtattgtctcacataaatggaagtacagagtgaatacaaacataaaatttggtgaggtaagatttagtgaggtagctgggcaaggtggcttacgtctgtaatcccagcactttgggaggccaaggcgggtggatcacgaggtcaggagttcaagaccagcctggccaagatggtgaagcctcatctctactaaaactacaaaattagccaggcgtggtggcaggcgcctgtaatctcagttatttggaaggctgaggcagaagaactgcttgaacccaggtagcagaggttgtagtgagccaagattgcaccactgcacttcagcctgggcgataagagtgagactctgtctcaaaaaaaaaaaaaggatttagtgaggtaagatgaaaggggtaagggaagctggaaggtattcaatagtattcgatactcatgcaccaagcactagggtaagtgatgtggacataaggacctcacagttcggcataggaggcaggtacctaaataaataagtctatgatggcatgggtgtgggggtcagaaagacatgggtttttgaatcctgattttttgctagctgtatactttggggcactttattttttttttcccagtttgagatggagtcttgctctgtcgcccaggctggagtgcactggcgcagtctcggcttactgcaaccgccgcctcccaggttcaagtgattgtcctgcctcagcctcctgagtagctggcattacaggcatgtgcccctacgcctgtctaatttttgtatttttagtggagacagggtttcaccatgttggccaggctggtctcgaactcctgacctcatgatctgcctgcctcagcctcccaaagtgctgggattaagacatgagccactgcaccgggcctggggcacgttttaaacatctatgaaacttagtttccctgtctatgaaatgaagataatatttaagatattgcagtgacaactgtataaaacatctgtgtttgtgacacatagacggtacttaataagtggcatcttctatttatttttttacagtgtacaatgtctatgtaagcacaacaagaaagcaacttaactgcctgcagcatcagaccaagttcctggatcataagtttgaaagcagcttctagatgacgcttgtggatatttggaataatatctactaatttctgttaagcagctatgtttcaactccacttcaataaaaacagccaaatttctctcctggaaattcttaaaactcaaagaaactctgattctttcaagtgttagtatgatgacctaattttgtgcctaactcctcttatatagaaaggaacaaatatttgatattcatcttcattgttttctgtgggttggtttcctgttattttttccctttgtctaggggaaaggagtaaagaaaacttccttgttaaactgctactataaggaacacgtttgaagaaataaacacagaaagcaagtgagtttctcattaatatcattagcagcataattcaactcttaagtacttagggatagtactgaagcattgaatactattcatttacttagctaaagtaacagaagtgcaaagtcccagaaggaggggcagaggaatcagatggaggggcaccctcagagagaataaaacctaggtggagggacccacacacgattgaagtaatacaagttagaaagtgatttaacttcagggggtcaaaatatttaaattgttattattattattattatttttaaagacagaagtcccgctctgtggcccaggctggagtagagtggcgcaatcttggttcattgcaacctccgcctcccgggttcaagcaattcttctgcctcagcctcccgagtagctgggattacaggccatgcccggctaatttttttgtacttttagtagagacggggttttgccatgttggccaggctggtcttgaactcctgacctcaggtgaactgccagcctcagcctcctaaagtgctgggactacaggcatgagccaccacacctggctgatttaaattgtttttgaagtatatacagcatagggggaagccacttcttagagaagaagagaaattaaaggagttttttttttttttttttttgagatggagtcttgctctgtcacccaggctggagtgcagtggcgtgatctcggctcactgtgacctctgcctcctgggttcaagtgagtctcctgcctcagcctccctagtagctgggactacaggcacatgccaccacgcccagctaattttttgtatttttagtagagatgggtttcaccatgttagccaggatggtctcgatctcctgacctcgtgatccacccacctcggcctcccaaagtgctgggattacaggcgtgagccaccgcgcccagcctagtttttttttttttttttgagatggagtcttgctctgttgcccaggctggagtgcaatggcgtgatatcgggttcactgcaacatccgcctcctgggtctgagccattctcctgcctcagcctcctgagtagctgggataacagacgtgtgccaccacaccagactagtttttgtatttttagtagagacggggttttactgtgttggccaggctggtctcaaactcctgacctcaggtgatctgcctgcctcggcctcccaaaatgctgggattacaggtgtgagccaccgcgcccggccttaaggagcttttaaaaaataataataaatgaaagagatagtatctcagctcagtcttgaagcactggcaatattttagaatatgaacctccagatgcaaagttgggaagagaatgttccaggtagaggaattagtgtgctcaaaaggcaagtcacagagactagagtgggagggacagatgggcagccaggtgagcagttccacttagaacagagagtgtgccgggtgcggtggctcacgcctgtaatcccagcactttgggaggccgaggcgggcggagcacctgaggtcaggagttcgggaccagcctggccaacatggtgaaatcccgtctctactaaaagtacaaaaattagctgggcgtagtggtgggcgcctgtaattccagttactccagaggctgaggcaggagaattgtttgaacccgggaggcggaggttgcagtgagccgagatcacgcctgggtgacagagcgagactccatctcaaaaaaaaaaaaaaagaagagagagtggccttatctctgccactcatctgccacttatgtgtccttttattttattttatttttgagacggagtcttgctctgtcgcccaggctggagggcagtggcatgatctcggctcactgcaagctccacctccccggttcccaaagtgctgggattacaggtgtaagctactacacctgacctatgacattcttttgcttaaggaaaaacacgcaggaagtcataagactattacttgccaagattatcttcttatgtctcttttactaaacagacatttccatataccttcactgacatagaccaaaacatccatgtccaaaatggccaagctaatcacagtggtttcattaggataggctaggttatgctgagggaacaaatcttgatgtcttagaacaacaaatcttgacgtcttagaacaacaaatcttgatgtcttagaacaacaaaactttctttctttctcatggccatgtccagagagagttggctagggtatctgcttcataatttttgtcactcttggacccaggttgttagagaaaacatttcaaatattaccaggcatacacacacacacacacacacacacacacacacacatctaatatacatatatacataaacatatatacacatatatacatatacatatatacacatatatacacacacacacacatatatatatacacacacacacatatatctatatctgaaaggagaagaaagctctggagggtctcacactggaaactcagtgctttgactcagatgtgatgcaaatcacttccattcacaaaaaattgccagaactagacagatggcccacccagccacagtcttccatgtgaagggaagggaaggaaaaccggctatctcatctgtgaacagcagtaaaaaccacataattggtcatacatagtagaatatgcctgaattaatactcattcttgaaataaatcatagtgactgagcatgatagctcacgcctgtaatgccagaattttgagaggcataggccagaggatctcttgagcccaaaagtttgagaccagcctaggcaacatagcaagaaccagtctctatgaaaaataaaaataaaaaatttagccaagtgtagtggtgcatgcctgtagtcctagctactcaaaaggctgaggtaggaggatcccctgagcccaggagtttggggttacaggtagctatgatcatgacactgcactacagcctgggtgacagagtgagaccctgtcttaaaatgaaaaaaaaaaaaatctcatagttatttaaaacttatagtttgcaaatttcatggagcccttcgaaacactttacaaatgtatttttacaaacattatgaaggaaaccaagatgtttcaccccaaaacatatttatttccttgacatagttcaacatgtctattcaaaagggctagaaatagaatagctgaaaggttgtttgttgtggaggagatttacatctataaaaataaagtctacatcagtacagttaggttttctctgacggccttcccttctctgacctaaaacaagttaactgagagtccgacagttttaaagatctgaaaaaaaccttcaccatctattctccgtgaaggttgctacctgtgaggtttcgccaggcctcctcttctccctctcccataacctgttttgccactatccaaaccccattctttacggaacctcaagatgatacataaacttccacaccctattgggagcttggaagtaatcaatctatgtgcacattaatacatgtatatgccttttctccaattaatctccttttatgagttttctttttttccttttctttctgtcacctaggcagaggcgccatctcagctcactgcaacctccacctcctgggttcaataaatcctcccgcttcagcctcccaagtggctgggactacaggtgtgtgccaccacacttggctaatttttgtaggagtttaactatgttggccaggctggtctcaaactcctgacctcaggtgatcctcccaccttggcctcccaaagtgctgggattacaagtgtgagccaccacgcctggctatgagttattgttcaacaaatcttcagagggccaacggaaagctttccctacaattacctcattttatattcaccacaatcctgtgaagtatgtatagtagctagatggtgatatcaccctttttttaataggacacagaggctcatggagcttacctgacttacccaaggatacaagtaattgacctgagattcaaacacagtttgactgtatatcttacattatgtccaatataccacactgcctttaagaaactatcttcaggccgggcatggtggcttacacctgtaatctcagcactttgggagtctgaggtgggcagatcacctgaggtcgggagttcaagatcagcccgaccaacatggagaaaccccgtctctactaaaaatacaaaattagctgggcgtggtggcgcatgtctgtaatttcagctactcgggaggctgaggcaggagaatggcttggacccgggaggcggaggttgcggtgagccgagatcgcaccattgcactccagcctgggcaacaaaagcaaaactctgtctcaaaaaaaaaaaaaaaaaaaaactattttcactgcagagtcttagcacatcaatgtattgtcaaacataagggaaaatattagccttagaaacaaaaacataggtgcggtttccttcagcaaactccacaactcaataaatcaatcggacaaatagactgggtacaatggctcatgcctgtaatctccacactgggggaggccgaggtgggaggatcactggaacccaggaatccaggatcaagctgggcagcacaagaccttatctccacgaaaaaagttttaaaattagccgggtgtggtggcaagcacctgtagtcccaactacttggtaggctgaggtgggaagattgcttgagctcaagaggttgaggctgcagtgagccatgatcacaccacagcaccccagcctgggtgacaaagtgagaacctattaaaaaaaaaaagtttgggtgtggtggctcacacctgtaatcccagcactttgggaagccaaggcgggaggatcacttgagccatggagttcgagaccagcctgggcaacatagtgagaacctgtctctattttttaaaatagtccaaataaccacccattatctgtacctataattagcctgaaagttagagacaacatatcattatcatggccttctagggacaacatatcaaactatcaaagaagtagtgaaattgaatatttctcttgtattccttccctttgatatcagttctggcaacacaagagaagaaaagagggaaacatccaaaggaaatccagttatgaactcagctctgtcagaaatcagctgcgtagtttttttaaattatactttaagttctgggatacatgtgcagagcatgcaggtttgttacataggtatacatgtgccatggtggtttgctgcacccatcaacccgtcatctaggttttaagacccgcatgcattaggtatttgtcctaatgttctccctccccttctcccccacccccctacaggccctggtatgtgacgttcccctccctgtgtccatgtattctcattgttcaactcccacttatgagcgagaatatgcagtgtttggttttctgttcccgtgttagtttgctgagaacgttggtttccagcttcatccatgtccctgcaaacaacgtgaatcattcttttttatggctgcatagtattccatggtgtatatgtgccacattttctttatccagtctatcattgatgggaattcgggttggttctaagtctttgctatagtgaatagtgctgcaataaacatgcatgtgcatgtgtctttatagaatgatttataatcctttgggtgtatacccagtaacaggattgctgggtcaaatggtatttctggttctagatccttaaggaatcgccacactatcttccacaatggttgaactagtttacactcataccaacagggtgaaagcattcctatttctctccacatcctctccagcatctgttgtttcctgactttttaatgattaccattctaacgggtatacatgtgccatgagatggtatcttattgtggttttgatttgcatttctctaatgaccagtgatgatgagctttttttcatatgtttgttgactgcataaatgtcttcttttgagaggtgtctgtgcatatcctttgcccactttttgatggggttctttgtttttttcttgtaaatttgtttaagttccttgtagattctggatattagaccttgtcagatggatagattgcaaacattttctcccattctgtagattgcctgttcactctgatgatagtttcttttgctgtgcagaagcgctttagtttgattagatcccatttctcaattttggcttttgttgcaattgtttttggtgttttagtcatgaactctttgcccatgcctatgtcctgaatggtattgcctaggttttcttctagggtttttacggttttaggtcttatgtttcagtctttaatccatcttgacttagtttttgtataagctataaggaaggggtatagtttcagttttctccatatggctagccagttttcccagcaccatttattaaatagggaatccttttctcattgcttgtttttgtcaggtttgtcaaagatcagatggttgtagatgtgtggtgttatttctgagacctctgttctgttccattggtctatgtatctgttttggtaccagtaccatgctgttttggttactgtagtctcatagtataatttgaagtcaagtagcagctgtgtaattctaagcaagacatttaatctgcctttaccactcacaataatgtctctgtgttagtccatttgcattgctataaagaaatatcagagactgggtaatttatttattttttatccaaaatgtgtttattgaggccaggcacagtggctcatgcctgtaacctcagcactttagaatgtcgaggtgagcagatcacctgaggtcaggagttcaagatcagcctggccaacatgatgaaaccccaaaataagccgggcatagtggcgcatgcctgtaatcccagatactcaggaggctgaggcaggagaattgcttgaacctggtaggcggaggtcgcagtgagccaagctcacaccactgcactgcagcctgggcgacaagagtgaaactcagtctcaaaaaaaaaaaagtgtttattgagatgatttcccactcatcttgattcggagtgctttttaatgctgcttcctcctgaaggaacatccttctgtaagccttgcttttctttctgtaggctggcagaggacagtggagcagccaacacacaaaatttctgttagtgcatggctaaagactgtgatgattttgtaccatcctgggcatttacacccatgaagtaggaattggggctctgcatcaggcactgcttcttgtgtttcctcttcccctattctggagagggatgaaggagatcctttgtgagaggcatgttctcctgggtaggtcgtcaccgctggaaaaagactgggtaattcgcaaagaaaagaggtggccggccacagtggctcacgcctgtaatcccagcactttgggaggccgaggtgggcggatcacctgaggtcaggagttcaagaccagcctggccaaaatggtgaaaccccatttctactacaaatacaaaaattagctgggcgtgatggcgggcacctgtaatcccagctacttgggaggctgaggcgggtgaatcgcttgaacctgggaggcggaggttgcagtgagctgagattgcaccattgcactccagcctgggcgacaagagtgaaactccgtctcaaaaaaaaaggagagaggaaaaagaagaggtttaattggctcaccgttctgcaggctgtataggaaacatggcaccagcatctgcttggcttctagtgaggccttagggagcttttactcatagcagaaggcaaaacaggagcagacatgtcacatggtgagagtgagtggtggaggtggaggaggtgccacacttttttaaacaaccagagctctcaagagctctcagagcgagaactcccttattattgtgaggacagcactaacccatttatgaggaatctgcccccatgacccaaacacctcacactagcccacctccaacagtggggatcacatttcatcataagatttggaagagacaaaacatccaaaccttatcagtctgtgaaaatgtttggaagaataaagtgctactagcagttgagccattcaatatttaagggcaagctgcttccatgggcttggtcttaggagggaattaaagaatagctaaggtgaaaccaactcaatagtcccatagacagttctggtcttaagcttgaaccttacatttgtattatctgagttccttcctcaggaaaggaccctcaaaagcctctcaaaaagtacctgaagaaaaagaactgaaactcaccagatcgttgcatccagacaatgagacaccaggcccttcattcatcatgattgcttccttacccctctcaagttgagttcctgttttcccatgcatagttacatttcttccctgctagattaacccctaattatagtcagtcaggagatgaatttgagactagttcccatgtcttcagctgcagcacccaattaaagctttcttccttggcaatactcattgtctcagtgattggttttctgtgctatgaggagcaggacttagactgaatacctgctattatggtaacaaaagcatggtctatgctggaggcatctgtggtttttgcatgtctagcttctattagagcacacatgcagcttttcatttataactcacccttcttcagcccagcgcagtggctcatgcctgtaatcccagcactttgggaggtcaagtgggtgcatcacgaggtcaggagatcaagaccatcctggctaacacggtgaaacctcgtctctactaaaaatacaaaaaaattagccaggcgtggtgccaggcgcctgtagtcccagctactctggaggctgaggcaggagaatggcgtgaacccgggaggcagagattgcagtgagccaagatcgcaccactgcactccagcctaggcaacagagtgagactccatctcaaaaaaaaaaaaagaaaaagaaaaagaaaaaaaaaccttatctttcttccattccatgaggtcctgacgggattgtgttctgcccacacattagcggatatgagatccaggctgcctcatctgatgtggtgataggttcaaagatggacacataacccaaaccaagacctatcagacgcttccagagacatgatagaaagctgctggaagagagccacttccctgtaacccactacgtgcttatgtactggagctgacaccaggcatcttccgcagttacacagagaaagtctaaacatgacagcatgagactaaatatgctgtgagaagcagtgaagatgagagaaacagactgaaagggaaccctgaagccaagtcagctcctaaacttctcagttctctaattcaaaagagtcccttgtatgcataagctgatttgagtttctgttattagaaaccaaagccgttctgactaatacagtttcagtcctcaaattcatatcttatgaaatttgatagttatttacttaataagagaccatttaaaaaatatcagctaattctgaaacatacaagctcagtttaagcatcttatgatgacctcagcaccctagaaggcctgtttctagagaacactacttctgctctcaatagtggagatgggtggttagcaatagttgtgttgtacctaaacctgttattcccacttgtacttgctactacatgtgtgtacgtatgtgtatgatttaattaaatattatttaaatgataaaatatgatgcgggccagctgctgtggctcaggcctataatcccagtacttggataggccaaagtgggtggatcacctgaggtcagcagttcaaaaccagcctggccaacatggtgaaaccccgtctctaccaaaaacacaaaaattagtcaggcatgatcgtatgcacctgtaaacccagctactcaggaggctgaggcaggagaatcacttgaacctgggaagtggaggttgcagtgagctgagatcatgctgtgtccggaattggttccttacggtggattcttggtctcgctaacttcaagaatgaagctgcagaccctcgtggtgagtgttacagttcttacacgtagtgtgtccggagtttgttccttcagatgttcagatatgtccagagtttcttccttccggtgggctcgtggtctagcttgacttcaggagtgaagctgcagaccttcgcagtgagtgttacagctcttaaatgtggcgcatccagcgttgtttgttcctcccggtgggttcgtggtctcactgatttcaggagcaaagctgcagaccttcgcagtgagtgttacaactcataaaggtagtgcggacccagagggagcagcagcaagatttattgtgaagagcaaaagaacaaaccttccacagcctggaaggggacccgaactggttgctgctgctggctccggtggccagcttttattcccttatttggccctgccaacgtcctgctgattggtccattttacagagtgctaattggtccattttacagagtgctgattggtccatttttacagagtgctgattggtgtgtttacaaacctttagctagtcacagagcactgattggtgcatttttacagagtgttgattggtgcatttacaaacctttagctagacacagagcgctgattggtgcatatttagagtactgattggtgtgtttacaaacctttagctagacacagagtgctgattggtgtgtttacaatcctctagctagacagaaaagttctccaagttcccacccaacccagaagcccagctggcttcaattctcaatgccactgcattccagcctgggctacagagtgagaccctgccataaaaacaaacaaacaaaaaccacacaaataacataaaataaaatatgatgaccccaacagaaaggtgtttctaggctgggcacggtggctcatgtctgtaatcccagcactttgggaggtggaggtgggtgcatcacgaggtcaggagtttgagacaagccaggccaacatgatgaaatcctgtctctactaaaaatacaaaaattagtcaggtgtggtggcatgcacctgtaattccagctactcaggaagctgaagcaggagaatcttttgaacctgggagggagaggttacagtgagctatgatcgcaccattgcactccagcctgggcgacgtagtgagactctgtcccaaacaaacaaacaaacaaacaaaaaggtatttctataaaaatcaagttaattgttaaaagactcataatgatgttgctttagaaaaaaaaaatgttggctaggtagggtggctcacgcctgtaatcccaacactttcggaggctgaggctggaggatcctgtgagcccaggagtttgagaccagcctgggcagcatggcaagaccccctctctatgaaaaaattaaaaattagccaggcgtggtggcacacacctgtggtcctagctactcaggatcctgaggtgggaggatcacttaatcccacaaggtcaaggctgcagtgagccgtgttcacaccactgcactccaacctgggtaacagagcgagactctgtctctaaaaaaaattaattaatgaaaaatgaaaaatgaaaaaaaattaagacaaactatggcacccatatgtcactttttgatgtttagctttaatctacttttttgaattgacattctaattactgatcccagctgtgtcaggtaagagagcaacaatctgttgacttcaaaattatcttacctgaacaataggagatatgaacttacttaggggttggaagatttattttaattatgaccccacagaaaagattcaagacaacaaaactttaagataagactttctaatatattaggtaacagagtaaacttaaatgagatatttgtttacctttatttttatttattattatttattattattttttgatggggtcttgctctgtcacccaggctggagtgcagcggcaagatctcggatcactgcagcctccacctcctgggttcaagcaattctcccacctaagctacctgagtagctgggattacaggggcacgccaccacacctggctaatttttgtatttttagtagagacagggtttcaccatgttgggaaggctggtcttgaactcttgacctcacgtgatccacccaccttggcctcccaaagtgctgagattacaggcgtgagccactgcaccccggcctatttttattttttaatatttatttatttttgagacagagttatgctcttgttgcccaagctggagtgcaatggcgtgatctcggctcaccgcaacctctgcctcccgggttcaagcaattctcctgcctcagcctcccgagtagctgggattacaggcatgcgtcaccacacccagctaattttgtatttttagtagagacagggtttctccatgttggtcaggctggtcttgaactcccgacctcagatgatccgcccgccttggccttatttttatttttttagagacggagtctgactctgtcacccaggctagagggccgtggtgtgatcatagctcaccacagccttgaactcctgggttacagtgatcctcccgccttgttctcccaaaatgctggtattacaggcatgaaccaccatgcctggttgcagtcttacctgttttttttcaaaaatgttctgactattccatcctattgtagcctcttcagaattctctctctccaggatttaaggcgctatcaaggtctgtcaatcctgagatgagttatgtgaaagtatttaagaaaggatagggccgggagcggtggctcacgcctgtaatcccagcactttgggaggccaagccgggtggaccacgaggtcaagagatcgagaccatcctgaccaacatggtgaaacctcgtctctactaaaaatacaaaaacttagccaggcatggtggtgggcaactgtagtcccagctactcgggaggctgaggcaggagaatcacttgaaactgggaggtggaggttgcagtgagccgagattgtgccactgcactccagcctgggtgacagagcaagactccatcttaaaaaaaaaaaaatgataaggactaaggactatatacatgtaaaagtatagtacttccttctctttctcattctgtctctctctctctttctctctttctttcacaggatcttgctctgttgcccaggctggagggcagtggtgagatcatggctcactgcaacctggaactcctgggctcaagtgatccttctgcctcctgcctcagcctccagagtagctgggactacaggcttgctccaccacatctggctaatatatacatctaatatattatatgtattatatacatctaatatattatatgtattatatacatctaatatattagatgtattatatacatctaatatatgtattatatacatctaatatatgtattatatacatctaatatatgtattatatacatctaatatatgtattatatacatctaatatatgtattatatacatataatatatgtattatatacatataatatatgtattatatacatataatatattatatgaatatatatataatatattatatgaatatataatacatatactatagtatatgtattatatacatatactatagtatatgtattatatattcatatactatagtatatgtattatatattcatatactatagtatatgtattatatattcatataatatagtatatgtattatatattcatataatatagtatatgtattatatattcatataatatagtatatgtattatatattcatataatatagtatatgtattatatattcatataatatagtatatgtattatatattcatataatatagtatatgtattatatattcatataatatagtatatgtattatatattcatataatatagtatatgtattatatattcatatagtatatgtattatatattcatataatacagtatatgtattatatattcatataatacagtatatgtattatatattcatataatacagtatatgtattatatattcatataatacagtatatgtattatatattcatataatatagtatatgtattatatatttcatataatatagtatatgtattatatattcatataatatatatattatatatttcatataatatatatattatatattcatataatatattatatatattatatatttcatatatatatatatttttgagatggagtcttgctttgttgcccaggctggagtgcagtggtgccatctcggctcactgcaacctccgcctcccgggttcaagcgatttttctgtctcagcttcccaagtagctgggattacaggtgcacgccaccacgcccagctaatttttgtatttttagtagagatggggttccaccatgttggtcaggctggtcttgaactcctgaccttgtgatctacccgcctcagcctcccaaagtgctgggattacaggcgtgagccactgcgcccggcctctggctaatatttttaaaacattttttgtagagccaggtcttgctctgttgtccacactggtctcaagctcttggctcaagcgaaactcctgccttggcctcccataaatgcaggaattacagatgtgagccactgtgccctgccttagtatttcttgagttgttatttaaatgtaaatattcccttgtctttaatgcagcagaaaattcctcaagagccaaaaatactttttaaatttttaaaatttaaaagtttttaaattgtttaattttaaattttaataaataaataaataaaaatttaaaaaaattaaaaattttaaagggcacttcataaatctcaaactgccctggtcctcacagtctttctaacttggctgaagatagctctgcttttgctgagaaaatgtagatcactttcctctctctcaaaggatctgtggagtcatccctctcctcttacaacctctgctccctctcctcacattgtacactcagatttcaaaatcttggaggacgcacctccctcatccttctcggggttagctttatgttctccgagtgcacctcccaaggggcagcccactgattccaaattggaagtgctttccttggttcttatgaaccaatgcagcagttttttcttttctgtaagtaaatttttatattgcactaaggactcctagtaactttcttcaggagttactaaggataacatgtctttgctatccaacacctagggtattaggccggctgtggtggctcatgcctgcaatcccagcactttgggaggccaagctgggaagatcacttgagcccaggagttcaagaccagcctggacaacatagtaagaccccgtttctaagacaaaaacaaaaactaaaaccctggggtattagcacttaagttgacagaggaattgatttggcattgtactgaaaagttgagctggccgggtgtggtggctcatgcctgaaatcctagcactttgggaggccgaggtgggcagatcacttgaggtcagaagttcaagaccagcctgaccaacatggtgaaaccctgtctctactaaaaatacaaaaattagccgggtgtggtggcgggcgcctggaatcccagctactcgggaggctgaggcaggagaattgcttgaacctaggaggtggaggttacagtgagctgagatcatgccactgcactccagtctgggcaacagagtgagacaccgtctcaaaaaaaggaaagaaaagttgaaaagttgaattgctggtaactatgtgaagctcccactatgcaaatacctacatccttgggattcctcaattttctagttagataggtatgttatcagtactttatgtgttgactcagacagctcgttaggtattagcttggcttagtctttcctttaaaatgtcaattattagtttagcttcattattatcaatttggtgtttcctttagccaactgtataatttttgtgatgctcatttgcatgagcattttttttttgacacggagtctcgctctgttgcccagtctggagtacaatagcatgatctcggctcactgcaacctccgcctcccaggtttaagcgattctcccgcctcagcctcctgagtagctgggattacaggtgcgtgccaccacgcccagttaatttttgtatttttatagagatggggtttctccatgttggtcaggctggtctcaaactcctgacctcaggtgatccacctgcctcggcttccaaagtgctgggattataggcgtgagcatcaggcccagccaagtaggctttctaggccataattttcaaggaattcgacttcaagatgtgttagtttgttattctttttttttttttttttgagacggactcttgctctgtctcccagactggagttcagtgatgtgatctcagctcactgcaacctctgcctcctgggttcaagagattctccttcctcagcctcctgagtagctagaatgacaggcgcccaccaccaggctggtctcgaactcctgacctcaggtggtcggcccgcctcggcctcccaaaatgttgggattacgggtgtaagccaccacgcccagccggtttgatattctaataggattcttctatatccatattgctaaatcagaggtttgtataatttcctaaaaatatgcttgcactatgacacttcattggttatgtgcttctcatgaatttgtgctatttatataacatggaagccaggtaggtgtaatgaaatgactgcgttcttttttatttatttatttatttttcgagagggagtctcgctctgtcacccaggctggattcagtggcgcgatcttggttcactgcagcctctgcctcctgggttcaagtgattctcctgcctcagcctcccaagtagctggcattacaggcatgtgccaccatgcctgtctaatttttgtatttttagtggagacggggtttcaccatgttggccaggctggtcttgaactcctgacctcaagtgatccatctgccttagccgcccaaagtgctgggattacaggcgtgagccactgcacccgtccgatgactgggttatttttaaatgtataaggcactttgtacaatataaaaccatgtggacaagctcatattctttttatcaagtaaataccaagtgattgtatattttgtatccagcaacatatccaccccaatttgtttatgggtaaaagcctatcaattgtatccctagtgtacatcatggtatcatattgtgatatgacattgagaacatgtttattgttttgctagaaatatatagctattttcaacaagggtaccattcaatggagaaaggacagttttttttcaacaaatgatgttgggaatattggatatccacatgcaagaaaataaaattggacccttaccttacttacaccatatggtggttaattttatgtgttaaacttgactggacatagggatgcccagatagctggcatcatgtctggatgcatctgtgagggtgtttctagaagagattagcatttgaatcaaactgagtagagatcaccctcacctgtgtgaatgagcatcttcccgtcgttgaggacctggatagaacacaaaggcagaggaagggcaaacttgctctcttttctggaactggaatatccatcttctcctgcctttggacattaaagctccaggttctcaggccttcagactcagattgaattataccactggctttcctggttctccagctccagcccacagacaccacactctgggacttcatgacctctatatttgcatgagccaactgccataatagatcccctcttatttgtctatgaatatcctattgcttctgtttctctggagaaccctaacacacgccatatacaaaaattaactcaaaatagatcaaacacctaaatgtaagagctagaagtatacaattcttagaaggaaacagagaaaggcttcgtgacgttgggtttggcaatgatttcatggatatgataccaaaggacagccaacaaagggaaaaataggtaattcggaccatatcaaaattaaaaattttgtgcatcagagggcactatcaacagtgaaaaagcaacccacagaatgggagaaaatatttgtgaattgtatatctaataagcagtgcttatccacaatacataaagaactcctgcaactcaacaaaaaagcaaacaacccaattcaaaaatagacaaaggacttgagtagacatttctccaaagaagatatacaatggccagtaagtggatgaaaagatgctcaacattattaatcactggagaatgcagatcaaaaccacaatgagatacaatttcacacctattaggatagctgctattaaataaacaaataaacaaaaacagaaaataagtattggtgaggatgtggaaaaattggaaccctcctgcattgccgataggaatatacagtgatgtagccactgtggaaaaaagtatattgactcctcaaaaaattaaacatagaattaccatatatcagcaattccacttctgggtttgtacccaaaagaagtgaaagcaggctatgggcgcggtggctcacacctgtaatcccagcactttgggagtctgaggcgggcggatcacctgaggtcaggagttcgagaccagcctgaccaacatggtgaaaccccatctctactaaaaatacaaaattagttgggtgtggtggcaggtgcctgtaatccaagctacttgggaggctgaggcaggagaattgcttgaacccaggacacggaggttgcagtgagccgagatggtgtcattgcactccacactgagcgacaggagcgaaactccgtctcaaaaaaaaaaaaaaaaaaattccacagtatatacaacatcatcattagtttttattttcattaaggttaaatgtgagcatgctttatttttcttttttttcacgtcagagtcttgctttggctcaaaggctggagtgcagaggtgctatcacggctcactacagccttaaactccggggctcaagtgatcctcctgcctcagcctcctaagtagctgggactacagacatgaatccccatgcctggctaattttttattgaggcagggtctcgctatattgcccaggctggtctcaaacgcctgggctcaagcaatcctcccatcttggcttcccaaattgttaggattacaggcacgagccaccatgcccagccagaagcactttcaaaacttttgtttgatagtcacatattctaataagtgctacttcgtggttcttcacagttattggctatgaacctccaactatgaaagaagagaatttaattatctttcaatcatcttgaacccagtaatgcataaatatgtaactaatgtcattctcaattctttctacatgttaagtcttccttttgaatagaacgataatcaatgtttagtttactatgcctataaaaatattctcagctaagccataagttttcccctatttaaaacatttttttttttcctggaaatactgtgttgctattcccaaggttagtttcctatataattgacactaattcaggcccagtcttctccagaatagtctaactgtcctctcgatatgttcaaatacatcaggagttctgcagttttcatccccttggtgatctctctcctggagcatcctgactgtctccaaactggacggttccccatatgtgacacacaggtatcattctggaatttctccttaccatcatcctaggccgttcttcagcctgttttgaattagatacatattactagatcccatgtcattctccttctcagttcctttgaatcacctacctcttccagaccttccccagaaaaatctctttttgagaccttacaagtctgaaaatgtctttattctacctacacttaactgatagtttggctgggtatctaagttggtaacaattttcactacaaactttgaaggtgactgctccctctctgcatccggtgttgctaatgagaagccaaacaattttaattccagatcctttgtgtgtgacctagtttttcctctctggaaatgtttagggttaatggtttattgtgtattctgaaatttcacaattatggggtctgccttccttcaatacgttaggcacttggcagtccctttcttttatcttcgttgcagagatgaggtcttgctgtgtgacccaggctggcctggaactcctggcctcaagtgatcccccagtctcagcctcccaaagtgcaaggattagagctacgagccacccttcccagccaacaggccctttcaatctagatagttctgtccttcaatagaaaatttctttgaactatgtctttgatgatttttttatcctatgttttctttttttctcatatcattctcatattagaccttctggataaatccaccagtattcttatctttactctcctatttgaacctctttattttactccttttattgtactttctggaatatttcttcaactctatcttctatagtactgggtttttcatttctactatatttaacctcaaccacaagcaaataaataccaagctaaaacaatgagacttttttctttttcttttgcctgtgagttttggccaatataaaaaagtttcgtaatacctaatgttggctaaatgtgggaaaacaataaatgaaagttctttgaagaacaactttacaatatctatcaaaattcacaaaacatgtaaaactcttgactcagtaattttacctctaggaatttaccatgcatttatacttgtacaagtgttcaaaaatatagatataagcattatttgttaatagcaaaaaaaatcttaaatatccaacaggaagcaattggttatataaaccataattatccctgaaatatccaacaatttcaaaaacaacattgatctagatatggtgatattgaatgacttccaaacgacttaagcgagccgagattgcgccattgcactccagcctgggcaacaagaatgaaattccgtctcaaaaaaaatatatatgaaaacagggactccaaaagatatttgtacacccatgttcatagcagcattactcacaatagctaaagtggaagtaacccaagtgtccatcggtggatgaaaggatgaagaatatgtgctctctatatacaatgtagccagaaagaaaacgtggtcattatatataatatagacatgatggctcatggctgtaatcctagcactttgggagggcaaagccggaggatcacttgagcccaaggaggtcaaggctgcagcgagctgtgattgcaccactgcactccagtctgggcgacagagcaagactttgttttttttttttttttttgagacagggtctcgctctgttgcccaggctggagtgcagtggtgtaatcacagctagctgcagccttgacctccttgggctcaagcgatcctcccacctcagcctcctgaatagttgggactacaggcacatgccaccatgcctggctaatttaaaaatttttttcaatttttgtagagataaggtcttgctttgttgcccaggctgctctctaactcctggcctcaagcaatcctcccacttcagcctttcaaagtgctgggattataggcatgagccactgtccctggccttggtataattttaacttgcattttactttatatgagtgaggctgagcacattttcttatgtttaaaagccatttgaggccaggcacggtggctcacgcttgtaatcctagcacttcgggaggctgaggcaggtggatcacttgagcccaggagttcaagaccagcctggacaacacagtgagaccctgtctcaaaaaaaaaaaagccattggggccggcagcatgtgcctgtggtcccagcaaccagggaggctgacgtgggaggatcacttgagcccaggaagtcaagggtgcagtgagctgtgattttgccactgcactctagcctgggtgacagagcaagatcttgtctcaaaaaaaaaaaaacaacaaatgctgagagttaacagcgagcagtgaggagtgctgtgcgggttggcccagctggtttggtttggtttgattggggaggggttagccagatgataaactcccctggctttttcactaggtttggcttgctgctgtgttcccaatagctagcacagtgcctgacatatagcagatgggcaacaaatttgttgaaaaaaaatgaatggaaggcatcctggaggtaagtgtttgagagctgtttaggaagaaagaacctggtcatgaattggatgctggggagagtgaagtacatgcataggtttctgactgcgaagaaaccaagagtctatgtttctgcacgaatgttttattcatgtgggtggggctctgctgagctggcttttacaacttaaaaccttttcactgggaggacaattccaaagtctagcagaagcaagcttcaggaagaacaatagctccaaccccaccccagtttttcaatttaagcgaaaaattagcttctctgagacctctccaccctcctctttgaatatttggatgggattaagacagtcattccgggaaaaggggcatctcagagcctggaagagaggaggcagagtcagctgccacaagccagttgaaaataaaacagatttcacgacagaaggaagagcatggtggctgaatttgttaggttatgtccttggaaattcagagatgaaaatcagagccacggactcttccctcttccttcttccgggattaaaaataataatagactgaccatcctggctaacacggtgaaagcccatctctacttaaaatgcaaaaaattagccgggcgtagtggcgggcgcctgtagtcccacctactcaagaggctgaggcaggagaatggcgtgaacccaggaggcggagcttgcagtgagccgaggtcgcgccactgcaccccagcctgggcgacagagtgagactccgtctcaaaaataaataaataaataaataaataaataaataaataaataaacaaacaaataaataaaaattatagaccgaatctagcacttccaacttctctggtcatgcctcaaagttatattaagagattaaagccacatcttccttttattattgggcactggtcttagctttccacagcttttaaaaattgttaaaaaaaaaaaaaaaaaaggaaggggctaggcacagtgactcacacctataatcccaacactttggaaggcagaggcagggggttacttgagcccaggagttcaagaccagtctggctgacatagggagacggtgtctttacaaaaaatttttaaaaattagccaggcatggtgaggtgcacctgtggtcccagctacttgggaggctaaggtgagaggatcacttgagcccaggaggttgaggctgcagtgagccgtgattgcaccactgcactccagcctgggtgacagaacgagactttgtctcaaaaaagaaaaaaagaaaagaaaaggaagtaacatccctcctggtcttttgaacttgtgggccactcctccaatgcacaccaccctagcccctcagaaaagaaaggtaagcaacataacaaagtttggtttctttctggttttttttttttttgagacagggtctccctctgtcacccagggtggagtacagtggcatgaacacggctcactgcaccctggacctcctgggctcaagtggtcctcctgcctcagtctccccagtagctgggctcacaggcgtgcgccaccacacccagcttatttttaatgattttttttttttttttagaggaagtcttgctctgtcgcccaggctggagtgcagtggtgcaatgttggctcactgcaagctccacttcccgggttcacaccattctgccacctcagcctctcaaggagctgggactacaggcgcccgccaccacgtctggctaattttgtttttgttttttttagtagagatggggtttcaccgtgttagccaggatggtctcgatctcctgacctcgtgatccacccgcctcagcctcccaaagtgctgggattacaggtgtgagccaccaggcccggccttaatgatttttttttttttagagatgggtcttgccatgttgcccaggctagtctcaaacttctaggctcaagtgatcctcccacctcagcctccgaaagtgtttattattttatttaaagggcttatctggagttgaaatagccacaaacaaaaacaaacaaacaaaaacaaggaaagaaagaaaaagaaaaaaagctaaaaggcttattaactgatttattttggtaaaattttaagtagttttccttcctcttattcggaatatatgttgaattattataatgagataactagataaaaataattttctataacattagatataaccaatctttgtgttgctgttttgaaaaggtcaggttttgttagcatggtgcttcagttatttgcgatatttatgaaactatctcaaaattcaaatgcttgtatcttatcttctaaaagctcagggaaactagactgcaaacagggcaaaggttgcagcatgaaagtaaatatttagattgcctcttaactctgccaggtgtaatattcctgtaaaatagtgataccgaaaccagctctggagatggaaagtataatcaggaggtttgttttataataattttaataccgttgtcccaagtatttgtttctgataactactttcctattttcttactcaatatttatacctgaatccccattctcccagttctctgaatgagctctcccatcatatattcctaatttcattcacatgtcccacaacagtttcaccaagtatgtgttctattttcttcagaatcttttgacctagaggatctgtgaatgattaactgaagcactccctacccactgctacaaaccaaaaacacgtgtgaaacctgtctcttccattttctttcttccttccttccttctttcccttaccttccccttccttccttccttccttccttccttccttccttccttccttcctttctttttttctctctctctctttctttttttttcttgagatggagtctcactctgtctctcaggctggagtgcagtggcatgatcttggctcactgcaacctctgcctcccaggttcaagcgattctcctatttcagcctcccgagtaggtgggattacaggcatctgccaccacacccagcgaatttttgtatttttagttgagaccagcgtgaccaacatggtgaaacccatgttggtcacgctggtctctaactcctgacttcaggtgatccatccacctcggcctcccaaagtgctgggattacaggcatgagccactgcgcccagctgtttctgccattttctacccaatttatggacacccaggtttggagtacagaggacaagtaccaagcacaaggcttgggtactgggtacccagaaaacacagctgcaggtctcaaaggagtcttggccttgttgcttgacttctatacttttaatttttttgtgacctactatacttatctggccagcccaaccagcagtccaacagtaacatctgttgacctaaactccaccatcattaagccccctatcagattatattatttttgtatccaaagataatttagctgagattattttctggcatatatttttacaactcttctgatgaacaaacagatggatttagccaagttcaaaactaaatcaaattcaaaatatataaagaactcctacaactgaacaacaaaacgaccacaacccaatttaaaaatgggcaatgaccagccgggcatggtggctcacgcctataaatcacagcactttgggaggccgaggcgggtggatcacgaggtcaggagatcgagaccatcctggctaacacggtgaaaccccatctctaccaaaaatacaaaaaaattagccgggcatcgtggcacacacctgtaggcccagctactcaggaggctgaggcaggaaaatcatttgaacccgggaggcggaggttgcagtgagccgagatcgtgccactgcactccagcctgggtgacagagtgaggctccacctcaaaaaaaaaaaaaagggcaatggatttgaatggccatttttcaaggaagatgtacacatggccagtaagtacgtgaaaaaaatgctgaacatcactaatcattaaggaaattcaaaccataatgagataccacttcacatctattaggatggctatttatttatttatttattgagacagtcttgctctgtcgcccaggctgaagtgctgtggcgcaatctaggctcactgcaacctttgcctcccaggttcaagtgattctcctgcctcagcctcctgagtagctgggattacaggcatgcaccaccatgcccagctaatttagtatttttagtagagacgaggtttcaccgtgttggccaggctggtgtcaaactcctgacctcaagtgatccgcgtacctcggcctcccaaagtgttgggattacaggtgtgagccactgtgcctggcagtatggctatttattaaaagagagaaagagaaaataacaagtgttggcaaggatgtggagaaattgaaacccgcatgcattgctggtgggaatgtcacaaagaggaagaggaatttctacagtacagtcattcagtaccaatttctcctcttgagaataggcagaaatcaaggaactgtagggaaacagtgactctctgaaattgactcatgagttactcatggacatttggcacattgacatcaaacacctaccataatgttgttcttacagtatgtaatctctcatattctctaatttcaaacccttagccctgagggtttctttcttttttttttttttttttctgagatggagttttgctctgtcacccaggctggagtgcagtggcgcgatctcggctcactgcaagttccacctcctgggttcacgccattctactgcctcagcctcctgagtagctgggactacaggcgcctgccaccacgcctggctaatttttatttttttttttgtattttcagtagagacggggtttcactgtgttagccaggatggtctcgatctgctgaccttgtgatctgcccacctcggcctcccaaagtgctcggattgcaggcgtgagctaccgcgcccggccaaccctgagggtttctaagaaaatcctggatatcactataaactctaagaacagtggccgactgttttcaccacattgctgcatctgggcagctatatcacatggcaggcaccttccaaatacttgggaagctagttctgagtaactttgtcttttaacttggctttgcccttcagcaatagcaatccgcagagtacccttgaatattaacactggcaggcttactggtcacaaacaagatttaaattgggaagggctactattgttcacacattaactaacagcattttccccacgtgtcatacatccttcagcctcctgccctatacacaaagggaattcataggcatgaatgcaattatgttgaataaaagcatttaaacaggtataaatcaggcccattcacttgcagactttttgttttagaaccactcataggggaaaaggggacgaaatggttatatctaccatcttagatgtggggtttggcttcaagtcatacacacacacacacacacacacacacacacacacacacaggcttgggtttcaaatatggctcatgaagccaatagttgtaagatttttgtttctccagaactttgtaaatgttttccaaagatcactagaacactacaggcagttcccaatttatgaaagcattgtattcttaaatttacatttttttggccaggcgcggtggctcacgcctgtaatcccagcactttgggaggctgaggtgagtggatgacctgaggtcaggagttcgacaacagcctggccaacatggtgaaacctcatctctactaaaaatacaaaaattatccaggtgtggtggctcacacctgtaatctcagctactcaggaggctgaggcaggagaatcacttgaacgcaggaggcagaggttgcagtgggccgagatcacactactgcactccagcccaggcgagggagtgagacagtgtctcaaaacaacaacaacaacaacaacaacattacttaaaaaaaaactgtgaacatacttttgttcaaacatgtatacagtataattgttagaaattgagggccaagcacggtggctcacgcctgtaatcccagcacttgggaggccaaggcgggcagatctggaggtcaggacttcgagaccagcctggccaacatagtgaaaccccgtctctactaaaaatacaaaaaattagccgggcatggtggcaggcgcctgtaatcccagctactcgggaggctgaggcaggagaatcgcttgaacctgggaggcagaggttgtagtgaactgagatcgtaccattgcactccagccctggcaacagtgcaaaactccgtctcaaaaaaaaaaaaaaaatttgagatataccagcctgggcaacatggaaaccccatctcttaaaaaaaaaaattagctgggcgtggtagcttgctcctgtggtcccagctgcccagctgctccggagtctgaggctggagggctgcttgagcctggaaagcagaggttgcagtgagttgagatcacatcactgcactccagcttgggagacagagcaagaccctgtccaggcgcagtggttcacacttgtaatcccagcactttgggaggccgaggtgggtggatcacttgaggctaggaattcgagatcagcctgaccaacatggtgaaaccccgtcactactaaaaatacaaaaattagctgggcgtggtggctcacacctgtgatcccacctactcgggaggctgaggcaggagagtcacttgaactctggaggtggaggttgcagtgaggcgagattgcgccactgcactccagcctgggcaacagagagagactccgtcttaaaaaagaaaaaaaattgaggtaaaatacatgtataatatatgtacagtaaaaggcaccaattttaaatgcttagcttgatggatttttaaatatgtatatatcctggtaagcaacgaaccagatgaaggtatagtacccagaaagctccctcatgctccttcccagccaataaacctctctcacaggtaacccctattctgaattctatcatcagaggttggagtttcaaaataactttctttttttttttttttttccgagactgagtcttgctctgttgcccaggttgaagtgtggtggcgcgatctcggctcactacaagctccgcctcccgggttcacgccattctcctgcctcagcctcccgagtagctgggactacaagtgcccgcaaccaagcccagctaaattttttgtatttttagtggagacgcggtttcaccatgttagccagaacagtctcgatctcctgacctcttgatccgcctgcctcagcctcccaaagtactgggattacaggcgtgagtcaccgcacctggcctctcttctttctttccttccttccttcctttctctctctctctcttcccttccttccttcttttcttctttttctttcttctttcttttcttctttctctttcttttctctttccctccctccctcccttcctctctctttctctccttccttctttctctttcttctttctctttccccctcccctcccctcccctcccctcccctcccttcccttcccttccttctgcagagtcttactctgtcacccaggctgcagtgcagtggcatggtctcagctaactgcaacctccacctcctggggtcaagcaattctcatgcctcaacctctcgagtagctgagattacaggcgtgcaccaccacaccaggctaatttttgtacttttttttttttttttctgagacagagtcttgctctgtcgcccaggctggggtgcagtggcacgatctcagctcactgcaacctccacctctgaggttcaagcggttctcgtgcctcagcctcccgggactacctccagggactacagtgtgcgacaacacgcccagctaatttttgtattttcagcagagaagggtttttgccatgttggccaggctgttctcaaactcctggcttcaagtgatccacccacatcagcctcctaaagggctggggttactggcatgagccaccacccctgacctaatcaattttctataataaatatattacctatatactttttaaaaaagctttttataacttttattattcaaaagaagtcattttgatagtctatagccaccttattatttaacacaatgaaaagtatattttgagtatctagccaccagttattgagcaagtatcttcgtggtgttttacattatttaattttcacaacaatttcgtcaggtggtattatcgccacatcacagttaaggaggctgatggttggagatgttaatttgtcaaggccacatagtaagaaatggagtcttggttgtgatgagctcagaagttcaccttcttcgccttctgcggggctaaaccatccctcctgccttctgcctatccccagtttgtctattataggacaagtagtctattacatgctcgagcaggtctgtcatactctcctttaaaaacccattgaaagcagccgggcatggtggctcatgcctgtaatcccagcactttgggaggccaaggcaggtagatcacttgaggtcaggggttcaagaccagcctggccagcatggtgaaaccctgtctctactaaaaatacaaaaattagctgggcatggtggtgtgcgcctgtaatcccagctactcaggaggcggaggcaggagaattgcttgaacccaggaggtggtggttgtggtgagcggaggtagcaccactacactccagcctgggcaacagagcaagactccatatcaaaacaacaacaacaatcccaaaaaagaaacccattgaaagcattaaagtagacaattttaaagtgattttacagccaggtgtggtggctcatgcctgtaatcccagcactttgggaggccaaggtgggcagatcacttgaggtcaggagttcaagatcagcctggccaacacagcaaaatcacatctctattaaaaatacataaattagctgggcgtggtggtatgcgtctgtagtcctcattgctcaggaggctgaggtgggagggtcacttgaacccaggagggggaggttgcagtgagccaagatcatgccactgcactccagcctgggcgacagagcaatacttcatctcaaaaataaaatgtctaaagccatttttgtaaaaataaataaataaataaataaataaaggtgattatacacaccacaaaggtctgggagggtatactgcaaacagtatatactgccagggaatagaattggtactggtaggacttttgttttctaagcttttatactcattatttttaaaaattataatagttaaaaaaagatggtcagaaaaaattgtagacttttcctgtgttgtatctttcaaatgtcggtgcatctcaatatcagaaacaatttctagaaatatgtacttcattaccacccccaaagtctctacctgtttcactgatttcagtatctttaatgctaacatatctgggacaataaaagcatttgacatataactggcatatacttttttcaagttttagatatactgacatatcctcatattaattttcaaattagaatacatgttgaaataatatggaagggctgggtgcagtggttcacacctgtaatcccagcactttggaaggctgaggcaggggaattgctttgggaggccgaggcgggcagatcacttgaggtcaggagttcgagaacagcctggccaacataagatgaaaccctgtctctactaaaaatatagaatttagctgggtgtggtggtgagtgcctgtaatcccagctacttgggaggctgaggcaggagactagcttgaacccaggaggcagaggttgcagtgagccaatcacactactgcactccagcctgggcgacagagtgagtctccatcacaaaaaataaaagaaaaaataatatggaagaaagaaaatgtacagggaagtacttttccttctgaatcttgtaacttgccaaatgtagctattacaggctaaactgtggcctctcaaaaagataacactgaagttcctaacctccagtacctcagaacgtgactttacttggaaatagcgtcctagcaaatgtaatgagttcacaggaggtcatgctggagaaggtgggcctctcatccaatatgactggtatggccagacagggagaaggccatgcgagaatggaggattggagagatgcatctacaagccaaggaacatcaaacatggccagcaaaccaccagaaactagaagaggactcccctacaggtttttgagggagcatgtcccagctgacaccctgcttccagacttctaggctgcaggtctgtgagacaacacacttcagttgttttgagccactcagtttgtagtacattgtcatggcagtcctaggaaactaatatagtggcctggactttgaattattgcgaataatgggggaaggagaaacagtgagtcacctgagcatcgtgacctacgggttttcaatgactttccagtttattttctgacaagtgaaaatattttcaagaacatgcacagtgaacacaggaatgctaggaaggcaaacataaaagggcacacacacacacggcaggtgactgaaactttaatgcacctagggattgaccacaacatttacaaatcagtgttactgcattggtttttcaaagattagctacatttataaactttattttaaaagtttcacaaagttaaatttccttaacacttcaacaggaatctaactctttacagtctatcaaaatggtaatattttacctttttttttttttaaagcactggtgctcttcttaagtgaaatgttaacacagggctcaatacataaaagagaaagtgaagttgttccatttggggggtcccataaggggcctcatgtttccctaggtgttaccccttcagacacagcacagcctacaaagccatggaattaaaatattaacaatgaatgcataaagatttcactgacaaataaaaaccagggagtgcattcagtgaccacaactttctaagcttctgcttttccacatgcttttctttggttttatcactttagaaaactctttgaacattaattgtctgaatggcagctatattagtcagaagctgtaatgctacacctgggaatttatctacatgatagatgctgctgaataaaatccaacaagaacgattttgtttaaaaaaaaactttgttaaggcagtctattgttcatactaacagaaataaaacatttatgaataaagtccaaagccaagataattcttagaaagatgaagcatccctgctgggcacagtggctcacacctgaatcccagcacttcagaaggccgaggctggtagatcatctgaggtcaggagcttgagaccaacctggccaacatagtgaaatcctgtctctactaaaaatacaaaaaattagctgggcatggtggtgggtgcctgtaatcccagctacttgggaggcagaggcaggagaatcgcttgaacccaggaggcagaggctgcagtgagccaagatcataccactgtactccagcctgggcaacaagagcgaaactccatctcaaaaaaaaaaaaaaagggagtttccaaggaaatgctacattgtgggactgtagcatgtatgtccaaagggaatagaaaagcaataccagctgggcgcggtgactcacgcctgtaatcccaacactttgggaggctgaggcgggtggatcatgaggtcaggagatcgagatcatcctggctaacacggtgaaaccccatctctactaaaaatacaaaaaaattagctgggcgtggtggcaggtgcctgtagtcccagctactcgggaggctgaggcaggaaaatgacgtgaacttgggaggcggagcttgcagtgagccgagatcgcaccactgcactccagtctgggcaacagagtaagactctgtctcacaaaaaaaaaaaaaaaaaagcaataccattcatacaattcaatgtgtccagggcaggctggactatggggagatggagagatgtacagtcacactgatgaaagacagggaggccatgtggaaccccaggggccacagagccacagtgaagcaccaggctaaggccatgagttaacaccacaaaccagaaaggcaccagacacttgggcttttggttaagtaggttgggcttgctcattaaggaccttttcttgagactcattctttataatttattcatttcacaaacacttcagtagacttcacaaacactaatatagttcctaccatattagtaactcctttaatcctaacaactctatgaggaaggaactattattagccccattttacagaagaggaaacaggcacagagagattaagcaatttgcccaagatcaggatgtctgaaaatgttgatctgggattcaaacacctttcaagggaataaatgacacctttgaaagatgtcaccctttttcccttagaaaaatcctttagaaatcccctaggaatttctctaggaagagaaatttgtcccagaaaaatcctaggaacctgcctgagtaaaaaaggaaaaagtagcaccagaattgatggtccacttgcccatcacactgccaggatacgatctctaaaatgatgacacatttaaatgagatagatgaatatgaaattggtcacagatgaaagatgaacacaggattttttccattcttagtaaaggcccttagaacatttgaattcgtttaaaaatgtctgagtaaaatctttaatgttgcatactggttaaaccaattggaagctgatttgggaagcgcttgcttctctaccacagaggctagcattaaaaaggcagtaaataaatagtaaacttgctattttttaaaaaaagtagtttcccagcctgaccaacatggtgaaacctcgtctctactaaaaatacaaaaattagcggggtgtggcagcgcacgcctgtaatcccagctactggggaggctaattgcttgaacaggagaattgcttgaacccgggaggtggaggttgcagtgagccgagattgtgccactgcattccagcctgggtaacagagcgagacttcatctcaaaaaaataaaataaaataaaaaaataaagtggtttcaaataagcgttaagaataaccttgtacatcccaattcattactttatcatattcttgaattctttgctttatgtgagaaagtttattctttaggtaatcacagcgttcttttttttccagaaatgtaggatcctgtaaaagaaatataagtattattttggctcctggcttcctcagtgaaaaacacagaaacatacattgtcacccaggaaatgatcatacatagcaaaagtctctacagcagattctgaactcagggtaacagttaagctctctacatattttttaaatgtacttttttttttagagcagttttaggttcacagcaaaatcaagcagaagtacaaagtgctaagacacctttcattttaatatctgataaagccaggtacagtggcatgtgcctgtagtcccagcaactcaggaggctgaggtggaaggattgcttgagcccaggtatttgaggccagcttaggcaacatgccaagaccccatctctttaaaaaaaaagaaaaagtaataagtatagaaaatactaataaacggtctctccagcctttactgattttttttttctttttgagacagggtttcactttgttgcccaggctagagtgcagtggcgtactgtctcccagtgcaacctctgcctcccaggcacaagtgatcctcccacttcagcctcccaagtagctggggctacaggcgtgtgccaccactaccggctaatgcttgtatttttttgtagagacaaggtttcgccatgttgcccaggctggtctcaaactcctgggctcaagcgttccactcgccttggcttcccaaagtgctgggattacaggcctgagccagtgtccagccacctctactgattttgagattaagttagagttggaaagatgtaaaatcagttcatctttttgaaggaacaggtggagaattcctgatcaatgctcatttctctaggttgctaaatcaggacacagcaaaatgtattcagagcagacatgagaagaaatggcatccagcagccattttctcttaaaaggagcatcccatgaaatacaaaaaggaactattttagctaacagaatctagagtctgtaaattatcacatatgtacttggataagaatacagtttgaagaaaactgttttactcacattcttttttttcttaaactcttcatggattcttgaaattctctcatgttcctaaaaataatacattgtatacttaagttaaaacatttgcatttactcaaatcatatctcaaagcacactgagaattagaacaaaaaataatttttacctaagaaaataatgaaaacattcacacacaaaaattcaattcacaggcaaatatttgaaggcttactgtctgctaggcccaggcgataaaagagagaaagggccctgaccacatgcaaccagacccaagccccaggcccttagggaggatacatagcttgcccagggtcatacagctggcaagttcagtttccttactggtaaaatggaaataaaaccataatgatctcaaagggttgtaagaaggttcacttatttgaaatgatccttataaagtgcttgccacataataaccacattagctatgattatgttcatcctttttggaaagttcttttttgagttattaggtgttgggattaagaagtttgagagtatgcaacttttgaaaatagctaatataaggctccttgtaacttttttctaagttttataataaatacgaactttgttaaggagttgaacggcctatccaaagggaacacattactatagcaatgccctcgttcatccatgcaaacctatgcatagagattgtcagacaatgcaaacctaataaataaataaatataataatttacagcgttttttttttcattttaagacagtctccctctgtcgcccaggctggagtacagtggcgtgatctcagctcactgcaactcccacctctctggctcaagctgttattgagcctcagcctcccaagtagctggaattataggtgtgcatcaccatgcccagctaatttttgtatttttagtagagatggagttttgccatgtttcccaggctggtctcgaactcctggcctcaagtgatccacccaccttggcctcccaaagtactgggattacacgcatgagccactgtgcccagccagtaatttatagttctaaaagcttgccctacacctgtaatcccagcattttgggaggctgaggcgggtggatcacctgagatcaggagttcaagaccagcctggccaacatggcgaaaccccatctctactaaaaatacaaaaattagccaggcatggtggcgggcacctgtaatctcagctacttaggagtttgagacagtagaatcacttgaacccaggaggcggaggttgcagtgagccaagatcacgccactgcactccagcctgggcaacagagactctgtctcaaaaataaataaataaataaaaaactaataaaataaaagcttggcctgagaactttttctatcactgacccatatccttttcccagtatattttcttcttctttttttttttttttttttgagacagggtcttgctctgttgcccaagctggaaggcagtggtgtaatagctcactgtaaccaaaacttcttgggctcaagtgatcctcctgtctcagcctcccaagtagctgggattatacggcacatcaccaggcctggctaatttttatttatatttatttttttttatttttgagatggagtctcaattctgtcacccaggctggagtgcagtggtgcgatctcggctcactgcaaccttcgcctcctaggttcaagtgattctcctgcctcagcctcccgagtagctgggattacaggcacctgccactacgcccagctaattttttgtattttcagtagagatggggtttcaccatgttggcctggctggtctcgaactcctgaccttgtgattcacccacctcggcctcccaaagtgctggggttacaggtgtgagccaccatgaccggccgctaacttttacttttttgtgtgtagatgcagtcttgctatgttgcccaagctcatcttgaactcctggctttgagcactcttcctgccttgtctctcaaagtgtggggattacagccatgagcccccttgcctgaactattttaattcttcaatctcttttacatactgagatcatgagtatgtttgtgttttgaatgcttgccagcagtgaagataaacctggtgatttaattgtaatctgtaataacagatcctggacaaggaataaacttgctattggggttagcactgctgtgctggagatgcaggcagagatgagctgtaacatccatctagagtctgtcactgaatttaaggagtggtgaggaccagagggattgtttggggcaatatttctactttatgggctcagaaaagtcatgtgactatttttcagtggtgcacaaccatgtctgtgggagaacctgcctccaaacaggcccactgggctttgaaatgcctcacatgcttccatggggacatggtgggaaaacgaatgagcctgtggactcctgcccaggacaaagctcagcctgtggccaaggagaagctaacttttgtaatatggttaatatttctactttagataaggactggaggatacactgataataataaccgtgggcctgccattgggttacttacaagccctgtcttgttaaaaatcacaggtaatggctgttgttgatattgtgtggaaacatcatgggaagacttggtctctcaacctgtactgtcatcaggaccctcttgatttcccaactgcagaccatgtgctgcagcccttgtccattcatacaaagcacacaaaccagataccactgggtgttggctcaaagattacaggtcaaggtcaagattttctttgttttttttttttgagacagagtctcactctgtcacccaggctggagtgcaatggcacaatctcgtctcactgcaacctccgcctcccaggttcaagccattctcctgcctcagcctcccgagtagcaaggattacaggcgcccaccaccatgctcggctaattttttgtatttttagtagggacggggtttcactatgctggccaggctggtctcgatctcctgacctcatgatccgcctgcctcggcctcccaaagtgctgggattacaggtgtgagccaccgcacccagcttttttttttttttttttttttaagacagagtttcgctcttgttgcccaggctggagtgcaatggcgcgatcttggcacaccagagcctccgcctcctgggtcaagcgattctcctgcctcagacttcccgagtagctgggattacacacatgcaccaccacgtgcggctaattttgtatttttagttgggatggtttcttttttttttttttttgagatgaagtcttgctctgtcgcccaggctggagtgtagtggcacgatctcagctcactgcaacctccgactcccgggttcaagcaattctcttgtctctgcctcctgagtagctggaattacaggcacacaccaccatgcctggctaatttttgtatttttagtagagacgcggtttcaccttggcctcccaaagtgctgggattacaggcatgagccactgtgcctggccgagatggggtttctccatgttggtcaggctggtctggaactcccaacctcaggtgatctgcccgcctcagcctcccaaactgctaggattacaggtgtgagccaccacacccggccttacaggtcaggattttcttcattatttctcccaacaagcctgcatttcccagcctgtgctgatccagattcctggggcctcatgccttcctgcactcctttgacggcctctgagagactaggtcacccttcttagacctgtgggccttgcttattttccaaatggtactgacattcaacctcaatatttgctgaatttctcttgcttcctggtactggcgtctcttagccaacaccattccattgctccaggattaggaaaatgttactgtaatacacatttggcttagttaactcataacgataagtgatttaaatgcacacttaacaaagagtctgtgattgaaacaaagacacctaacttctcaggtaaaaaatttatatatatgtgtgtgtgtgtgtgtgtgtgtgtgtgtgtgtgtgtgtgtgtgtgtgtgttcccatacataaatttgacatttagttttttttgtttgttttttggttttttttggctctgtcgcccaggctggagtgcagtggcatgatcttggctcactgcaacctccgcctcccgggttcacacgacttgcctgcctcagcctcccaagtagctgggactgcaggcatgtgccaccacagccagaccgacatttagtttttacaaagctgtgtttttaaaatttaatcatacatgtaatagattaatacagcctcttttaaaaagacagaatattacacaaatatttataccagcattattcgtaacagccaatgagtggaaatgactatatagacatttggaaatgaccaaatgtctatctcttgataaatggataaacaaaatgtggtatatccatatagcagaatattattccaccacaaaaaggaatatgtattgacttatgctaaaatatggatgaaccttgaaaacattatgcaaaatgaagaagccagacacaaaagattgatatgaaatgttcaaactaggcaaatccattcggacagaaagtagattagtggttgtcaatggttggacagagctgagaatgggaaataactgctaattcgtaaagggtttcattttttttttttttttttttttttttgagacagggtctcactctgttgcccaggctggagtgcagtggcgcaatcttggcccactgcaacctccacctcctgggttcaagtgattctcctgcctcagcctcccaagtagctgagattactcagcctgccaacatgcccaactaatttttgtacttttagtagagacagcatttcaccatgttggccaggctggtctcgaattcctgacctcaagtgatctgcctgcctcagcatcccaaactgctgagattacaggcatgagccaccacacccagccaatatagggtttctttttggggtgataaaactgttgtggaatttgagtggtgctgattgcaaaactctgtaactatactaaaattcactgaattgtacactttaaaagggtgggtttattatatgtgaatgagatctcaattaaaaagagtacatctgggccggatgcagtggctcatgcctgtaataccagcactttgggaggctgaggtaggtggatcacctgaggtcaggagttcgagaccagcctggcctaaatggggaaaccctgcctctactaaaaatacaaaaattagccgggtgtgcacctatagtcccatctactcaggaagctgaggcaggagaatcgcgtaacctgggaggcaaaggttgcagtgagccgagattgcaccactgcactcccgtctgggtgacagagcaagactccatctcaaaaaaaaaaaaaaaaaagagtacatctgattaaaaaatggcacaggtggccaggcacggtggctcacgcctgtaatcccagcactttgggaggctaaggcgggtggatcataaggtcaggagtttgagaccagcctaaccaccatggtgaaaccccgtctctactaaaaatacaaaattagctgggcatggtggcgcatgcctgaatcccagctacttgggaggccgaggtgggagaatcgcttcaacccgggaggcagaggttgcagtgagccgagatcgcgccatggcactccagcctgggcaacaagagcaaaactccatctcaaaaaaataaaataaaataaaaattaaaaaatggcacaggttataaggcattcctatttcaatattcctatttcaaaatgtgaaaaatgtggggggtgcggaagagcactacgaaaaagcttaagcctctgtaactaccatatctactcctggttttcctctttgtcataatcacagctacctgtctgatgtgtgtgtccagcagctcacatttgtagcatatctcatatctgcttgcttttttttttttttttggagacatggtctcactctgtccttcaggctggagtgtagtgacaaaatcacagctcactgcaaactccacctcctgggttcaggcaatccttgcacctcagcctcctgctgggtctacaggtgcatgccaccatgcccggctaatttttatattttttgtagagacagggtttcaccatgttgtccaggctggtcttgcatgcctgggctcaagcgatctgcccaccttggcctcttaaagtgttgggattacaggcataagccactgcgcctggccatttctgctctctactcttactcagtgggcgctctgcctttgggcctggggtgctaactgctgggctctggcttagcaggggaatgcaatgcccctggtggcttccctacattccctttctgaataaacctttgtgaattatcctagtttgaatgtgctatctgtctcctttgggaccctgactgactcagtatctatcttaggcaaattcgtattttacttaagtaagaaaataaaatatgggtaagcacagagtgaaaaaaaaaaaagaagaaatactgtttaataattgaagacaaaagatattaagttacataatttgaattgtcatcttgactagacaccttgaggatctcaaatgctttcctagacacagaaagcagatgtaaatggttataaatttttttaaaagccagattttgggggccaggcgtggtggctcccacctgaatcccagcactttgggaggccgaggcaggtggatcccgaggtcaggagatcaagatcatcctggctaacacggtgaaaccccatctctactaaaaatacaaaaaaattagctgggcgtggtggcaggcgccttagtcccagctactcgggaggctgaggcaggagaatggcatgaactcgggaggtggagcttgcagtgagccaagatcacgccactgcactccagcctgggtgacagagtgagattctagccttaaaaaaaaaaaaaagccagattttatgccaaatgcggtggctcatgactgtaatcccagcactctgggaggccaaggcaggtggatcacttgaggccactcttggccaacatggcaaaaccgcgtctccactaaaaatagaaaaaaattagctacgtgtggtggcatgtgcctgtaatcccagctactcgggaggctgaggcaggagaattgcttgaacccaggaggtggaggttgcagcaagccaagattgtgccactgcactccagcctggcaacagaacaagactctgtctcacagaaaaaaaaaaaaaaaaaaaaaaaagccagattttattcatcctctagatttcagtgctcctcctaggcagctgcacatactaacctgtcggctttccgaatgatgtggcaatctgctcatcactgcatccagctcatcaaacttcctcaggacagcctgaacttctgcagacagctctttgtactctgaaaactggtcttggaacacagctttatagcgttctcgctcatcatctgtctgaatcacagggtattttctaggggaaaaacataagccaaagatataattgtttcactaaaagaagctgaatgggaaatcagcttatcttattccttactgatcatattgtaccttcaattcaatacattacctctcagataacaactatttacatacacgattttaagcacagagtattaacttggagacaaactggaaaatgaaaggaccaaatggggcccctcaacttctaccttgaggaagaattcagactgacactcacgccacatagtcgggcatcacgataggtttaggaatgtggcctggggggatgtgtccactcagtagttcaggtttcatttttgctgttctcagttccttgaaattaacttctgagtctctttgtctgtcaccactggtggccatttcacactgcagttagggagaaaaagaggatttgttaataaacataagtagaaaaaaaccctctgaattcattcttagaaaatgaggaagaagatcaggtggggtggctcaaacctgtaatcctagcactttgggaggacaaagccggaggatcacatgaggccaggagttcaagaccagcctggccaacatggcaagaccctgtctctataaaaagtttaaggccaggcacagtggctcacgcctgtaatcccagcactttgggaaaccgaggtgggctgaccacttgagatcaggagtttgaaaccagcctggccaacatggtaaaaccccatctctattaaaaatacaaaaattagctgggagtggtggcgggtgcctataatcccagctcctcgggaggctgaggcaggagaatcacttgggcccaggaggtggaggttgcagtgaaccaagattgtaccactgcactccagcttgggagacagactgagactctgtttaaaaaaaaaaaaatctggcagatgcagcggtgtgtgtctgtagtccgctagtagctacttgggaggcttggaggctgaggtgggaggattgcttgagtccaggaggtagaggttacagtgagctgtgattgcattactgcactccagcctgggcgatagagtgagactctggctcaaaaaaaaaaaaaaaaaaaaaaaagaagaagaagaagaaaatggggaggaagacaggaggaagaaaagtggaaataagagttaacatttcacatcacaattatatgttttatagtcacaaagttgttctgaacgtttctgtaatagctaagggaatcacatttgggatatggtaatacacagtaggtaaaacacactccagccccaatcgtgtacatgtcaaaggtggatgatgcaatgccaaacacgcagtcttaagaacttacctatttagaatttacaccccaactaaacgtaaaagaataaaaaatgtaattcaaaataaattcaaggataaaaatggaacaagcctacttaaatggaaagagaaagtaatgataatggcaatttgggatgatttaattgtaagtaaccactgagtggattagaaaaggaaatgagttggccgggcacggtggctcatgcctgtaatctcagcaccttgggaggccgaggtcggtggatcacgaggtcaggtgttcgagaccagcctggccagcatggtgaaaccctgtctctactaaaaatataaaaattagccgggcatagtggcgggcgcctgtaatcccatctacttgggaggctgaggcaggacaatggtgtgaacccaggaggcggagcttgcagtgagccaagatcacgccactgcactccagcctgggcaacagagtgagactctgtctcaaaaaaaaaaaaaaagaaaagaaaagaagtgaggttgaggccaggtgcaggggcttacacgtgtaagcctaacactttgggaggctgaggtgggaggtgggaggatcacttgaggccaggagttcgaggctgcagggagctgtgaatggtccactgcactccagcctgggcatcagagcaagaccctgtctcttaaaaaaaaaaaattaaaaacagaagtgaggttcagagaggtcaagtcaattctccaaggtcacataactattaagtagaaaagccacaattaaaacccagaactgggccaggcaaggtggctcacgcctgtaatctcagcactttgggaggccgaggggggtggatcatttaatgtcaggagttcaagaccagcctggccaacatggtgaaaccctgtctctactaaaaatacaaaaattagccggatgtggtggtgtgcgcctgtaatcccagctactcaggaggctgaggcaggagaatggcttgagcccgggaggcggaggtggcaaggagctgagattgtgccactgcactctagcctgggtgacagagcgagacgccgtctcaaaaataaataaataaataaataaaacccagaactaggccacgtgcagtagctcattcctgtaatcctagcactttgggaggccaaagcaggaggactgcttgagcccagatgtttgagaccagcctgggcaacatagggagatgctgtctctacaaaaaaaattaaaaaaatatattttttcttgagacagagtctcgttctgtggcccaggctggagtgcagtggcacgatctcgactcactgcaacctctgcctccaggtttaagcaattctcctgcctcagcctcctgaatagctgggactacaggtgcacaccaccatgactggctaattttttgtattttagtagagatggggtttcaccatatttcctagtctggtctcaaacttctgagctcaggcaatccacccacctcagcctcccaaagtgctaggattacaggcatgagccacagtgcctggccaaaaaataaaaaattaactgggtgtggtggcatgcacctgtggtccaggctacttgggagtctgaggtgggaggattacttaaacccaggaggtcaaggctgtagtgaatcgtgatcatgccactctactcagcctgggtgacagagtgaaaccctgtctcaaaaaacaaacaaacaaataaataaataaataacccagaactatttggtttattgatacttttttttttttttttttttgatacagagtctcactgtgccacccaggctggagtgcagtggcgagatcatatagctcactgcagcctcgaactcctgggctcaacctatcctccctccttggcctcccaaagtgctagggttacaggtgtgagccacggtgcctgacctggttcattgatactttaaatgaataacataaagaaacctgttagcttaaatgtatattgttcatatcctaaagttgcatgaagttctagtagcacactagaagtgagcttgtgatggacagggcaagcaatgccatactgctactggaaagtaagatcgtgcttgggaacatgattcctctttggagcagtaacctccctcccctctactgaccccttaagccttcgagaaatgcttgctgaactaaactgagagtggcttgggagggcccctacttcactgcaaataaaaaaccaaacaggattttaaaaccttaatcttcatcttgccaggaagctttaaaaatcctttgtttcctgatttccttaccctgaaactggctttggtttaatattagctcattctaaaaaccactagcactttaactcaccaaatagcacaccctttagattggattaggtgtggaggctgctaaccagccctaggggaaggttatgaaaaggaaaagctctccaaccatggctctaggtgggacagaagccagatcacctagatgtagaaagcatgcctcgccacttggtctcccaatctgcaaaaacatgagtggcgagcagagtaccccgaggaaatgaaattaagccaggatatttttaggcaacacattttgaagttagtatttattctgctgtatttcttgctgattaggatgccatttcttcatcctaatgaattcctatatacttagtcttgaaaacgaataatggtattaaacattagggggagcatttttggctttaataaatgaatttctatttctctttaacttctgttttattttttttgacccccatatggacacatggtttaactcctaaatgtttaacaatccagatctcatggtgctgaggaagctgctatgagcttgttgatcctctggatctcagcagcagtcccagcatcaatctcagatctcctggtcaaagctgctttgggcagaaggtccatcattaatttgttttctacataaaatttttttaaggaagaactaatcatttttcttacttgcccatccctaattgtaagacttaccttttaatatagaaagggagcctgaagaaatcagaatatttccatgtagacatttcatctgctttaaatttattttaattacttaatttatttatttttgagacagtctcgcactattgcccaggctggagtgcagtggtaacaatctggatctcagctcactgcaacctccaccttccaggttcaagtcattctcccgcctcagtctcccaagtagctgggattacaggcttgcgccaccacacccggctaattttttgtatttttagtagagatgggattttgccatgttgcccaggctggtctcaaactcctgacctctggtgatccacccaccttggcttccaaaaatgctgggattacaggtgtgagccaccatgcccggcctaaatttttttttatttttatggtcttaactttttttctgctctttttggatgaaccttcccgatcatcagtttggaaaactctattgggaaaaaacttttttttttttgagacatagtctcgctctgtcacccaggctggagtgcagtggcacgatctttgctcactgccacctctgcctcccagttcaagccactctcctgcctcagcctcccgagtagctgggattacaggcatgcaccaccatgcctggctaatttttgtatttttagtagaaatggggtttcaccatgttggccaagctggtcccaaactcctggcctcaagagatccacctgctttggcttcccaaagtgctcggattacaggcgtgagccactgcacctgttctctattgggaagaaatctaaaaccacatatgagacaaagaattaaatcttcgtcaggcttttgtgggaagactgcattaagctccagcacgggaaaggccactcttagacagtactcttgatgacagacatgtcaaaggaaaggggaaaatgtcccagtgccccagagtaacatgaccgttctttgcttccagcaaaaactagtctaagtaatgttatgaatataattattaaacttttcaacttaaaaatgggctgaatgaatatctgtcaggttagaaatagagagaactaagggaggctgaggcaggacaattgcttgaaccaggaagtcggaggttgcggtgagccgagatcgtgccacagcactccagcctggtgacagagtgagactctgtctcaaaaaaacaaaccaaaaaaaaaaaaggaaaagatatagggagaactagctatgtgtttcagtatgcatttatttctccaattcttgattctctctccctttgagtgtataatataataatgcacaggcccctgacctcaaacccataccatcacgttccatgcccacattagattccggcttttctagcttataatataaacctgcacagcacttaaagcacagacttcagaatttgttgctgtctctatgtgatcttatatctattatttcttttaaaagtagtcttatttgcttttaaaaattatattaattaaaacacaaaataagaaggcaccccctagtattaaaccaaacaacagacaggaaactgaagttcagagaaagtaagcaatttccccaggatcgcagagctagtaagtagctgacctagtactcaaatttagattgcctgattctgaagttcacttgctggctgggtgaggtggctcacacctgtaatcccagtgctttgggaggctgaggcaggaggatcacttaagaccagcccaggcaacatagtgagacctcttctctactaaaaattatttaaaaattaactggcatggtggtgcatgcctgtagtcccagctacttgggaggttaaggtgggaggattgtttgagcccaggagtttgcggctgccctcagcctgggtgacagacccttttgaattttcaaccaagtaaatatgctctcttttcagagaaacaaatccaaagactgaattctcaactccttgctaagaaataatgtccaggccgggcgcggtgactcacgcctgtaatcccagcactttgggaggctaaggcgggtggatcacgaggtcaggggttcgagaccagcctgaccaacatggtgaaaccctgtctctactaaaaatacaaaaattggctgggtgtggtggcgggcgcctgtaatcccagctattcaggaggctgaggcaggagaattgcttgaacctgggaggcgaaggttgcagtgagctgagatcgcaccactgcactccagcctgggcgacagagcaagactctgtctaaaaataataataataataataataataataatgtccagtatctcaaaaaatgagggtaaaattttcaatgagggtaaaattatgattattaaaataaattattacatatatgtaaataatgataacagcatctcactgagtcctctcagcaaacttgcgaggtatgaattattattattgcaatctcacagatgaagaaatgcaggcatagaaaggttaaataatttgtctgctgccacacagttggtaaattgtggaatagaaattccctgacactacaaaatttggcatctttaaaaaaaagtattattggccgggcatgctggctcacacccataatcccagcactttgggaggccgaggcgggcggatcacgaggtcaggagatcgagaacatcctgacctcgtgaaactagctaacatggtgaaaccccgtctccactaaaaatacaaaaaattagccggccgcggtggtgggcacctgtagtcccagctactcgggaggctgaggcaggagaatggtgtgaacctgggaggcggagcttgcagtgagccgagatagcgccactgcactccagcctgggcgacagagactccatctcaaaaaaaaaaaaaaagtattattattattaatttcttttttaactgtcctgtgagtgtagtaaaaaatttggcatctgaaagcaaggtgagaaggatacaaagaacagcacagaactttaaatacaagtgaagaaagtttcagagaatcactttcatttaaaaaataattaaatttcaaacatatgttggtttgtttacttgcataaattttcatctaacaaaattaaaagcagctatagatatgattgtttaatttggtccttttagtatctggaaaaaagctcaaagtcctaatatgaactcgatgtaacagctacaatttctttttttttttttaatatatatatatttttttattatactttaagttttagggaacatgtgcacattgtgcaggttagtcacatatgtatacatgtgccatgctggtgcgctgcacccactaactcgtcatctagcattaggtatatctcccaatgctatccctccccgctcccccgaccccaccacagtccccagagtgtgataatccccttcctgtgtccatgtgatctcattgttcaattcccacctatgagtgagaatatgtggtgtttggttttttgttcttgcgatagtttactgagaatgatgatttccaatttcatccatgtccctacaaaggacatgaattcatcattttttatggctgcatgtaatagctacactttcttttcttttctttttttaaacagtctcactctgtcacccaggctggagtgcagtgacgtgatcttggctcactgaaaccttcacctcccagattcaagtggttctcgtgcctcagcctccagagtagctgggattacaggcgtgtgccaccacgtgcaggtaatttttgtatttttggtagagacagggtttcaccattttggccaggctggtcttgaaattctggtctcaagtgctccgccctcctcagcctcccaaagtgctgggattacaggtgtgagccaccacacctggccaatagctacatttcacagatgtacgatactactatgtagataaacagacctaagagaaaagtattaacaaatctaaagcataatatgaagtaaactttattcttaccattttccttttcgatgacaatgatggctcatttatctggaacaaaaagagttcaaatagtttttcaaaggcatgtgaagctactttgcaaatattttcatccatttgcatttatagcccaacctcaattttaagaggttgatcctctacttgacgggtgtttctcatcctttttttgcctaggttttgaagggccagtggagaactgagaagagggataactgtaattccctgtcaatcagggcatagagaggagtagggaatacggagatggtggaaactgttagataaaccactctgaattaccctcaaattttatttattcttgcctcccattactttgcatgattaaagagttaggacaattactctataaaattaatagaaaaaagccctaggccattacatcttctaacctttaggaagttatagcaacgtacagacaggcacaactttcaacatcaggtgactgaagtctaattaggcattatgaaaagtctcatagacataagtttttgttgagaaaggaaaaagaaataaaagtattatgttgatcattctattcatatagaatttttaaatattaagatttaataacttatgcaactagcataaatttatgaggaagtatgtgtttcactatctggatttcatactgattagaattaacattttttactttgtacacagagatgtacatttaagaaataaattgtaactttaagaaacaaaaatttaatacatgtgaaggttacataaaaaaacaaaaatgtaagaaatatgcttaaaatgctaagacacatttttagaaataacttgaatctatgtagagttctagcaagataaattattttgtgacaatcaagctaggcatggtggcttatgcctgtaatcccagcactttgggaggctgaggggagaggattgcttgaggccaggagtttgagaccagcctgagcaacatagcaagaccccgtctctacaaaaaatttaaaatatatagagagagagatcacatggacacatgtcaaagtcctttgtataacatgtaggtacttgttataaaactatttttttccatcaagcacagtggcttatacttataatcccaacactttgggaggctgaggcaggaggattgcttgagcccagaagttcgagaccagcctgggtaacatagtgataccctgtctctacaaaaaatattgaaaaatagccaggtgtggtggtgtatgcctgcagtcccagctacctgggaggctgaggtgggaagattgcttgagcctgggaggtcaaagctggagtgagccatgattgtgccaccgtattgcaggctgggtgacagagttagacccttcctcaaaacaaaccatcaacaacaacaacaacgacaacaaaacgatttgtttcccattccactaggtgtaaaaagaaaatctaaggctgggtgtggtggctcacgcctgtaatcctatcactctgggaggccaaggcagatggatcaccagaggtcaggagctcaagatcagcctggccaacatggcaaaaccctgtctctactaaatacaaaaattagctgggcatggtggcatgtgcctgtaatcccagctactaggggggctgaggcagaaggatcacttgaacctgggaagcggaggttatagtgagcagagattgtgccactgcactccagcctggtgccagatattgggggaaattcatccccgatatttcacataggttcttttctatattccctaagtgtcggccagtctgagaaataaagggaaagagtacaaaagagagaaattttaaagctgggtgtgcaggggagacatcacatgtcggcaggttccgtgatgcccccgagccgtaaaaccagcaagtttttattagtgattttcaaaaggggagggagtgtatgaatagggtgtgggtcacagagatcacatgctttacaaggtaataaaatatcacaaggcaaatggaggcagggcgagatcacaggccacaggacggggcaaaattaaaattgctaatgaagtttcaggcatgcattgtcactgataacatcttatcaggagacagggtttgagagcagacaactggtctgaccaaaatttattaggcgggaatttcctcgtcctaataagcctgggagcactacaggagaccagggcttatttcatcccttatctatgattgtaaaagacagccatccccaaagcggccatttcagaggcctaccctcagggatgcattctctttctcagggatgctccttgctgagaaaaagaattcagcgatatttctcctatttgcttttgaaagaagagaaatatggctctgttccgcccagctcacaggcagccagagtttaaggttatctcccttgttccctgaacattgctgttatcctgttcttttttcaaggtgcccagatttcatattgttcaaacacacatgctctacaaacaatttgtgcagttaactcaatcatcacacggtcctgaggcaacatacatcctcctcagtttatgaagatgacgggattaagagattaaagacaggcataggaaatcacaagggtattgattggggaagtgataagtgtccatgaaatcttcacaatttatgttcagagactgcagtaaagacaggcataagaaattataaaagtattaatttggggaattaataaatgtccatgaaatcttcacaatttatgttcttctgccatggcttcagctggtccctctgtttggggtccctgacttcccgcaacagtgccactgcactctggcaacagagtgagactctgtctcaaaaaaaaaaaaaaaaagaaagaaaagaaaattaaaaaaaccaaaaaacgggccaggcatggtggctcacacctgtaatcccagcactttgggatgccaaggcaggtggattgcttgagtccaggagtttgagaccagcctggacaacatggcaaatactcatctctaaagaaaaaaaaaattaaaaaaattttaaaaccaaagcgctatttgttgctatgcatcagattcaagcaaaagattaaaaacaaaatacatatgtcagtgtgtgctgttataaggacaggatttaatttttatttatagttttgcccaatatataccatgtgcaattgtatagtatctaagaagtcttaggaaaagtggaaaagcaaaaattcataatatagttaacttaaaattacaaaaaattttaaggtaaatactgaaaatttcagtggcataggagagtctactatacacatatccttggaagaaggcaaaatatcaacttacttcagagaataatgtagccagtggaacatactctaacatttgctactgttcaaccaaaataattttaggtagggcttttatctcatccttcagttattattattttattcttcttattgttctcattattatttattctcattattatcctattaagttctagaaatataaaaacaatgtaggacttccattctcattttggaccatacgtcttcctcaaataaagacaaattatcaaaaccactgggcaagttttcagagtatgttcattacaattcaatctctcaatacttaaaaaaaatcaaacatggtttaccacattcttatttggctttattcaactcactgggagaaagtaaattgtaacatttaaatgaaaaattaggagcttttattaaagaattaagattgttctcaaacttaatgatgagacacttattttactgagtacactcttcttctttgcaaaaattcggtagctgtatctttcccttaagcttcagacagacataataatgcagccaacaaactatatattacacatctggtgtctacttgcaatgttatgtaacagccaaacaccagagtgggttatcccagtcaaagcatgtcagatattgcactaggacttttgaatctcagaccattgaaaaaaaaaaaaaggaagaaagaaaagatttctatgaaagctttctgttttgagcgctatacattttttaacaagggagcaaataacagaaaaaacaaacatacacacacaaatgagggattatgaaatcacttacctcctgttgttccatatattctctatgtctccgagctgcctcatgcctccataactttaggcaaaccaaagcactaatgagataaactatcatggtgacaaacaggaagatcattgcagctatctgtcctccttctacccggcagaacactgcattcactggtgtattaaataacggatagtagcagaggccacctcggttggtatcattcacatagactatggctgcggccatatacaaaataaacaaggcaacgttaattccaaattcagttaggggccaccaattagagtccagaagaatggtccggtaatacatggacatgccaagaaccagaataataatggtggtgatccaagctaatccagcaaccacgagtacaaaaggggtcttagggccagtgtagtaatagcccccatacatactgcccaatccaccaacgcctcccatgccatacggttgtgaatatccaaacaagttgtaccactcactgtccttgtgaatgtaagctgtgacacaagcaaagacaccggcccccaaaagcagctccaccacacccagtattctcagcaggcctgcccacgacttcatgtaggagtatctcaggttatactcctccaccttctcactgtatgttcgaactgtttgtgtgtgtcggtctagagatccatagggatcccggggaaacactgcgtcagcctctttccgggaactaaaggttccttctgaccctccgtagggatctttgcaggagttgaggggcgaacggtggtttggtcttgctggagaggctggtggtgaacactccactccatcggagatgtacctgatatcagacaccggcttatcccattcggggtcctttttcttccctctgaaaaagttcttccaggagtcagggacaaagcgccttactggtttgagatctggcgctatagctggttcttctgtgtcacttgagtagaagtctgggccgaatggtggctgtaatgggagagggggtggtggcaagggatcagcgctcactgcccgctcactgtcatgaagagttgggtgggttcttatggtggtatcttgatagggcaggtcgcttgggacctcatcgtagcgcctgtcccgattcctggatcttccatcatttgacatttgtgattttcacacctgtggccaaatttaaagttatcacttatgattagttacttatcctctcaatgatgctgattttattcatgtagtagcaaaaagtatttaggagaccaacaggatcatgtctaattattatgatatacaaaaatgataaatatgataccgggcacggtggctcatgcctgtaatcccagcactttgggaggccaagacagacggatcatttcaggtcaggagtttgagaccagcctgaccaacatggtgaaacactatctctactaaaaatacaaaaactagccaggcgttgtggcatgcgcctgtgatcccagctactcaggtggctgaggtatagaccgcttgaacccgggaggcagaggttgcagtgagtcgagattgcgccactgcactccagcctggctgacacagtgagtctctgtctctaaaaaaaagaaaaaaaaaaagaaatgaaaaatgatttataaatctaatttatctgtgagccctattaaacaataaaataaaaaacaaaagtgacaaaactttaacacaacagaacgcgaacacactcccaagtagagtcatttcctcaaacatctaaatcaaaatactaagagtttgagtgtagcgaaatttgatgggtcagcaaatattcttcattttcacttggaatagcctaggagaggcagtctgttaaaacacagggtatgcacagcccttccccttcctaaatcaacaaagtcattttagaggacttgcttcttccagtctaaaatattaacaattgaaactagatgtaaaaaagttgaatctcagagacaacatcaccaaaggctaaggctcccccaaggcacaatagagaatggcagcaatgaccattactattactctttcgagggcaattcaggtgatttactgttcccaaggagagactcaagtatctcagaaggtattcaatccacctcaaaaataaagcatagaaaatgcacttttactaagcctgttgattcatgaaatcaatgctctgcacccatatacagaaagaaggaaaccatttgtgaattaactactagttttaaggtatgctgaatttctctctcgaattgtttataagtattttgtttgaagacttaaaaaaattttttcattcacaccctgccaagactcattattgaagacttaaactgggcacatggtattgtacttgatactatgaaggtctcaaaattaaaatggataaccccatcttttttgttattgttttatttatttaatatttttaagacagggtctcactctgtttcccaggccagagcataggagcacaatcatagctcactgcagcctcaatctccctggctcaagcactccagctgcctcagcctcctgagtagctgggactacaggtgcatgccaccatacccagctaattctttttttttttttttttgagacagagtctcaatctgttgcccaggctggagtgcagtggtgccatctcggctcactgcaagctccgcctcccaggttcatgccattctcctgcctcagcctcccaagtagctgggactacaggtgctcgccaccacgcccggctaattttttgtatttttagtagagatggggaccatgttagccgggatgatcttgatctcctgacctcataatccacccgcctcggcctcccaaagtgctgggattacaggtgtgagccaccacgctcggccgctaattctttaaaatttttagtagacattaagtatcactatgttgcctaggctggtcttgaactcctgggctcaagcgatcctcctgccttggccacccaaagtgctgggattacaagcgttagccactgcacctggtctgataaccccatctttatactgttgaacaatttggaaattcctaaggctttattttattttactttggaaaacgaagacccttcatttaacctgccttgcaccaggcatgctgaaagtatactggtggacaaaccagactgaaatccttgccttcatgatgctttaaccgggggagtgccgggcagattgacagatgatagataaatgaaatatacagtatgctaaagaacaaagttgagaaagggggtaaagactgcaatggggacaggatgttaccatcttaaaccgagtgggcagggaaatcttcacagagaaagggatatctgagtatagaactgaaggtgaaggaggaagccaggccattatcagggacaagtgttcaggcagatggaatagctagcgcaaatgccctgaagcaggagtgcctggtatgttcaagaaatatttaggcatggaagctactgtggcagcagcaaagtgggtaagaaggtgaatagtagaactgaggccatctgaatcatgtagggccttgaaaaccactggaaagaaaggactttgtcttttgctaggagtgagatgagaagccactggaggattctgaatagaggagtgacatgacttgacttgttttaacagtatcactatggatgctgtgttgagagtacactccagaaggcaagaggtaaaacaggaagactggctaggccattgaaataatccaatggatcactgagatcttgagaagaggtcaaatgctagacaggtatttaaaatttttattatagaatttttcaaacataataaaaagtagaaagaatagcattatgaacccttgtgtacccacatccagcttctacacttatcgatttatggccaaacttgtttcatttatactccccatactatttcctctgccaatagagtcctctgaagtaaaccccagacatctgatcattttatctatctatacctcattctccacccctccagcttagccttggggagcagcagactgaagagtgtttcagatgcgttaaaaatccaggtagagacgttaagagggcaagcaaggcacacagggtatgtacagactggagacaagggaatgcggtggaaacccagggtcttctaatagggcactccgaccttagaggattaactgtgatggccccagcagggtgcccaatgcaaagcggctctgtatattataacaatcagttatttttgtacctttctctttctttctctaaaaaagtgtaagttctagaaatgctattacgactctagtttttgaaacacattcctaagaaatgtagaagcaaaagcacaacaaatgattttagcaagttttacacagcatttacaggatacgctatgcttaattcaactcactggtaaaaatacgattcactgtaatggatttaactcttcacctgtgaagtggcttatttgaatcaaaccaccctatccatttttaaagaaaaaacaagcaattattaaagagttgtggaaaagcaagataatgtgatttttagaagggaatggttagctgtatttcattacatcttaaatatctggatacccctaatgtctttcaagatgtcactgagagttcgttctggtcccgcaggtcgcggcagcgtgtgtctttgtcctgctcaggccccggacccttactccactcttggacactcatcttggaaagccgcggcaatggcaggagaaatggctgccccagcaaagtgtcacaggaatcatgcctggtcacctttacacaaacagaaccaccggtttacctggcttaaaagttttgctggacccaagaaacgggtagatttcggatacttctgcgcttccgaggggtcgggaaaggctctgcggttctaactaacccacgactgcccgggggtaccgagcattttagctgtggggtctcccccgcgccagcctctgggcgcccggtcccacaaatctcattgtgtcctcggttctgcccgcgccggctaggcgttcgtcttcgcgtttctggctgaaacccactgtctttggagattccgacccaacgaggccgaaactaagccgggagacctcccaggtaaggagcaccgagatcgccccgaggtgcgcgccccgccccgcgcccggaaggacggcggctcggccgcacctgcgtccgcagagcgaaacctggcgggacgcgggcctccccggatccctggctccggcctcccccgcgggctatggcaggctgagcgccgagcgcgggcagccgtccgtcgcagcacacctgggccgggggccgccgggccctcctctcccggtcacgtggccccaccccggtcccacttacctgcgcagccgccaggaagagcgcgcacgctgcccaggactctgaaaccggtatcgggctcccggggtgggggcggggccgggacgggacgagcccagctttccccgcccggctttgccccgcccggatctgtcggcccgacaaccgctctgggcccaggctgctcggtgccaccagccggcacgtcgcggcaatgaccacacactgggctcttttggaaagagtttacagttctcatcgcaacgttgccatcctcttccctatcttttgaaaagtttgacactgggggagggagattggtgcactgtgcttaaggacccatggcagcgagtgcgtgctagataatgttaaaagacaggagaaacaaaattaaattcaacattttaattgtgatataacttatgtaaatactttccaaaaagtatctaagatattccactgtacaacacatcaaaactatctgagaagcgggagacaataaagtgtaaataaggcacacagtttacactcgtaattgcatcctaaactgttgaatagttgatatttacaaccccccaataacgtttttgcatcctgaattagtccttcacatcttgatatttggcataatgttcaaacacactttatacacactgaccgctccttaaaccactcacagatttaataaataccgaaaaaattaagagatttgaaggcttgatcttctatttacttcaagatgacagaagagtaggtttcttgtgatgaaatactacaagaatgaagaattaacaaactgttgtgtaattcatcagaaaagcatattaactctgctgaagtaccactgaatgaaacaaaaatgaagctgtgaagtagcaatctgattagcaggctggcttctatgtcccatcactctcgtagtcttctattattatgttttcttccatgtctccttgggctgaaaagggctggggctggctagcaggcagttcactggcactattctgactcaaaggaagagaccaggtttccggcacagtggcttgagtgggttcacccagagattcctctgcagaatgtcctccattaagctgggcttcatctccgctgtcagggtctatcattccatgttccctgtcagtcagggcttccattttcaatctgtcagattcacagtgcaggcattaataagaaccaaaggagaagatttttaaattacaccatgagtgtgatgattatgaagccatctttcatttacctacattgtgctgtttagctagtccctttaactataaaaacaaaactacaaggtaaatgacaaactgaataagttcctacaacttaaaatacaaaaaggagctgaacacgatggctcatgcctgtactatctgcactgtgggaggccaaggcaggcagatcacttgaggccaggagttcaagaccagcctggccaacatggcaaaaacccatctctattgaaaatagaaaaattagccaggcgtggtggcacgcatctgtaatcccagctactcaggaggctgaggcaggagaattgtttgaacccaggaggcagaagctgcagtgagccaagctcgtgccactgaactccagcctgtacgacagagcaagactctgtctccaaacaaaaaacaaacaaacaaaaaaaccaaaccaaaccacaacaacaaaaacacctaaaaataaaaagaaataatgtcttcagtaaagaatttttcttttttcttttttttcattgagactgtctttctctatcgcccaggcaggagtgcagtggtgcaatctcagtttactgcaacctctgcctcccaggttcaagcgattctcctgcctcagcctcccaagtagctgggattacaggcacatgccatcatgcccaactaatttgtatttttagtagagatggggtttcaccatgttggccagggtaatcttgaactcccgaactcaggtgatccatctgcctccgcctcccaaagtgcggggattacaagtgtgagccaccacacccagccttcagtaaagaatttttacaaattaaaaaggaaaaaatgaaatagaaaaatgggcacaaacatggacaacttataaaacaaatacaaatggttcctaaattgttaaatctaatttgtaattttaaaaatgaaaattaacataatgagctactactgtcatctttttttttttttgagacagtcttgctctgtcacccaggctacagggcagtagcacgatcttggctcactgcaacctccacttcaggttcaagcgattctcctgtctcagcctctggagtagcagggattacacgcgggcaccaccacacccagctagtttttgtatttttagcagagatagggtttcaccatgttggccaggctggtctcgaactcctgaccttagatgatccacccacctcagcctcccaaagtgctgggattacaagcatgagccactgcgcctggcctattactgtcatcttctaaactggcaaagatacttttaaaacccagtggtggcaagggttaggagaaaagaacatactgatacactgtaagtggatacaaaactggcaaaatattcttgccaacaatttggcaataaagaggaaaagccccaaaaggtatatacctattgatccagcaatttcatttgtaggaattcaccctaagtaaatagtatttgaagtgcatgatgacttatctataaggctgggatagtaaaagctgaaaaaaagctaaatgggcaaaaataacgtgtaggttgaattacaggaaattaaacacctattaaatattaagtattaatatttaatactaaatactaaacatatgaacaatggttttaaatatggtcaacataaataaaagatagtaccagtcattgtaatatatagcactgaaaatactgcctctcgtggccaggcgtggtggctcacgcctgtaatcccagcactttgggaggccgaagtgggcggatcacgaggtcaggagatcaagaccatcctggctaacacagtgaaaccctgtctctactaaaaatacaaaaaattagctgggcgtggtggcgggcgcctgtagtcccagctactcggcaggctgaggcaggagaatggtgtgagcccagaaggtggagcttgcagtgagccgagatcgtgctactgcactccagcctgggcgataaagctagactccgtctacaaaaaaaaaagaaaagaaaatactgcctctcaagtcacatcaagtaggtagttgaaccaataataaaatagtgaagattctcattcaatttagccttgtgtaaattgcagcaactcaatacatctcaggagcaaaaatacaatagaacatacttgtctttattttgatgccataatcttagggggttggggagagaagccatcaaagagacttggtcctgctttcattcagagggatgtgagaagaaaagcagtgtttatgaaatgtgtaagccctgatcacatcccagtgggacgatgcttcaagatccatccatcatggtctttctgcgataggaaagatgggccccacatagctaagccagtatacagaaaaaaacattaacactacaaaggccttaatgaatcttggagggtaaagagggggaaaaagctcacatcacaggagttttccatttgggaccagaaataggagaaaaggtaggaggagtcagaggtgccatttctatcacttacttttgtccatgcattcagtaagcaagatttttttaaatcttttttttgagatggagttttgcttttgttgcccaggctggggtgcaatggtgtgatcttggctcactgcaacctccacctcctgggttgaagcgattctcctgcctcagcctcctgagtagctgggattacaggcatgtgccaccacacccagctaaattttgtatttttagtagagacacggtttcaccatgttgtccaggctggtcttgaactccttatctcaggtgatccacctgcctcgggctcccaaagtgctgggattacaagcataagccaccacgcccggccatttttaaaatctttaaacaattcctaagtgcttaattcgatcttacaaataagctaagtcaaactgaaatataagttttgtgttaatcactgataatggcacagaagctactttccaataaaatgaacagtatatatatatatatatatatatatatatatagacagacatctattttttgcttgtttaaattttctaaaataagaaaatatgaaggactcttctactttctgaggcagttcctagtcactgcaggtcttcaagcataggctaagaacatctctcaacaggaaagctggcaaggggtttctagatttgttgagttggaggattttaaagattcctctgcctttgtgattccatgcttccatttaatctggtatagtccattgggagtgggtgaagatatgctgttatatttaagaaaaggaagggtctacaatacaattatgtttataaattactaggtacagtatgtctttcttggatgttacaggtaacagttattgattcatactgaacatattcagtagacatttcattatcagctttttggaaattgagatgatcagcttaccttccaaagtgtcgcttcagagggagccttccaatatcttggataaaagaaatctgagctgaaacagattttttaaaagttgtaaacaattttccaaagaaaatatacaaatggccaataagcacctgaaaagatgctgaacatcactaatctttagagaaatgcaaatccaagccatagtgagataccaattcacatctattaggatgactgttacaaaaaaccagaaaacaagaagtgtgggtaaggatgtggagaagctggaacccttgtgcattgctcatgggaatgtaaaatggtgtagctgctgtggaaaacagtatagtgcatcctcaaaaaattaaaaatggaattattgtatgatctaacaattccacttctgggtatatacccaaaataattaaaaacagagtctcaaaaagatatttgtatgcccatgttcatatcagcatcaacaataatcaatgggtggaagcaacccaagtgtccatcaacagatgaatggataaccaaatatggtatatacatctcatggaatattactcagctttaaaaaggacacatgctccaacacaaatgaactgcgatgacatcattctaagtgcaactagtcacaaaagaacaaatattgtatgattccacctatatgaagtatttagagtcataaattcatagagacagaaagtagaatggtggctgccagggggaagggaaaatggggaattaatgctaatagttatagaatttcagttttgcaagaagcaaaagtttcggaaactggttgcagaacaaggtggatatacttaacactactgcactgtagaattcaaaatggttaagatgataaactttatgctttgtatactttatcacaattaaaaatgcaaaaagaaaaagaatgacatagtaaactttcaggatgacagcataagctcttgtgtacccactcccaaagataagcaaaatcggtgaaaacttttaaaaatcaatcatttgaagtctctggaaattgtcctaatagcatacagcaaatgagaaaagatctattcaagaaaaccaaacaggaagaatctgaggcatctgagccactatctcctccctcccattcccaaccctgagctgagagggctcagcttgatgaacatttcattccaggtgggtacagccaagaacaaaggactccttcctactggagtgcagcagggtgtttggggcttcctttccccacctggccctactcataggataagaggttctaacccaaaggcactgtcccctgtcccagctgcagtctcccttaccccagcttgttacatagcagagggtccacactgggagaggcaagccaaaataatcagaggctacctctgcagctgggcacccacccagaataagtggcttagagattttgcccagaggagaggcagtccgtaggaaaaagctccgaagccttccccaaaggaactcactttatttgaaacatagtgtggggaagttcaagcctaaagggcaccctggaaaccagctcctcttaaataagaacaagctaaacataagccaactagttcataagaaaccagggaaagagacaactaagaagggccctcctggtttcagaacaaccctcagaaactggcttgaaagcctacacctgcccaaattaaactggatcagcctgtggagaaatttttgtcctagagcactgctgaaaacagagcaattagatagtaattagggagtagtcaggcacagtggctcacgtctgtaatcccagcactttgggaggccaaggtgggtggatcacttgaggtcaggagttcaagaccaacctggctaacatggtgaaacgccatctctactaaaaatagaaaaattagctggggatggtggcacatgcctgtagtcccagctactcaggaggctgaagcataagaattgcttgagcccaggaggcggaggttgcagtcagccatcgtaccactgcactccagtctgggtgacagagcgagactctttcctcaaaaaaaaaaaaaaaaaaaaaaaagtaattagggtagccaacagtgtgataacaaaggaagcaaagagctatacagacatatcagggaaagagacaaagtgagctctgctaaaaccaccatcatcccaagtaaactgtgggcacagccaaggatgagctctctgaagagggaggaaggcttcatgttgcaaaagacagacttcattacatgagtttagccaagtcactaaacaaataaacaagcacacaacaataaaaacaagccccagaggaggagaatcaatattctccaaaattgctacaatatattccctaaaacatctagttttcaacaaaaaattatgactgtaaagaaacaggaaagtgtgacctacacacaagaaaaaggtgggtaaaagaaactgcctttgcgagggctcacacattaaatttaacagaaaaagacttcagataaaccattataaatattttcaaagtagaaaaggaaatcatgctcaaagtagtaaacaaagctgtaatgacaatgtctcatgaaaaagagcatcaacaaaaagacaaaaattataaaaagaaccaaatgaaaattctgcagtcaaaaggtacaataactaaaatgaaaaattcactaaaggggctcaacagtagatttgaaccagaagtatcatcaaacttggacataggccaggcgtggtagctcatgcttgtaatcccagcactttgggaggccgaggcaggcagatcacctgaggtcaggagttcaaggccagcctggccaacatggcgaaaccccgccgggcatagcggcacatgcctgtattcccagctactcagggggttgaggcaggagaattgcttgaactcaggaggtggagattgcagtgagctgagatggtgctaccgcactccagcctggacaacagagggcgactctgtctccaaaaaaaaaaaaaaaaaaaaaaaaaaaaaaacttggacatagattgacatatagaagacagaagaaatataaacaaaatctcagaaaaatgtggaacactttcaagtgaacataccctaatgaaagactagaaggacagaaagcagcagaaaaatatttaaagaaataatggctgaaaatgacatagtaaataaaagcggaagaaacagtataaaaattgataagaaaaaccaaaacatcttacttttactaatttttatgaaccttttaaagtttgcacatctaacactatgaggacctttggatacttaacctgttaaaaattctactacacaggccgaagcaggcggatcacctgaggttaggagtttgagaccagactggccaacatagtaaaaccccatctttactaaaaatacaaaaattagctgggtgtggtggtatgcgcctgtaattcaagctactcaggaggctgaggtaggagaatcgcttgaacctgggaattggaggttgcagtgagccaagatggtgccactgcactgcagcctgggagatacagcaagactccatctcaaaaaaaaaaaaaaaaaaaaatctactacaaacagagttattttaattaacaaacaaaattgtatatatttactgtgggcaacatattgttttaatatatatatagtagaatgactatagctaattaacatatatattacctcacagagttattatttttgtggcaaagacactttacattcactctcagcatttttcaagaatacaatatattggttcggtgtggtagctcacacctgtagtcccagcactttgggaggctgaggtgggaggattgcttgaacccaggagttcaagaccagcctgtgcaacatggcaaaaccccatccttacaaaaaaaaaatacaaaaattagccaagtgtggtggtgcgcacctgtggttaccagctactcagtaggctgaggtaggaggatcacttgggccaaggaggtttaggctgcagtgagccgtgatcataccaccacaatccagcttgggtgacaagagtgatactctgactcaaaaaaagaaacaaaaccacacacacacacaaaatactattaattatagtcaccatgttgtaaaatagaattcttgaatttattcctcctacataacaaaattttgtattctttgatcaacaactcccctaccacccaagcccatggtaatcccattctgtgctctactattatgagatcaacttttttagctcctatataagtgagaatatgcaatatttgtctttctgtgcctggcttatttcatttcaaataaggtcttccaggttcatccatgttactgcaaatgacaagattttgttcttttttatggctgaatagtattccactgtgtatatataccatgttttcctcatccaatggacaattagactgacgctatatcttggttattgtgaataatgctgcaataaaactgggagggagggcagatatctcttcaacatactgacttcatattcttttttttttttttttgagatggagtctggctctgtcacctaggctggagtgcagcaacacaatctcagctcacagtaacctctacctcctggattcaagcaattctcctgcctcagactccacggtagctgggattacaggagtacaccaccacatctggctaattttttatatttttggtagagacggggtttcaccatgtttgccaggctggtctcaaactcctggcctcaagtgatccgcctgcctcgcctcccaaagtgctgggattacaggcatgagccactgcacctggccttgacttcatattctttggatatatgtccagtagtgggactgctggatcatatggtagttctatttttagagttttttttttgtttgttttttgagacagagttttgctcttgttgccaggctggggtgcaatggcgtgatcgtggctcactgcaacctctgcctcccaagttcaagcaattctcctgcctcggcctcccaagtagctgggattacaggcatgtgccaccacgcccagctaatttttgtatttttagtagaggcagagtttcatcatgttggtcaggctagtctcgaactcccgacctcaggtgatccacccacctcggcctcccaaagtgctgggattacaagcgtgagccaccacgcctggcctatttttagtttttttggtgttttttttttttgtgtgtgtgtttttagtagagatgggttttcactatgttgccaggctgctctcaaactcatgacctcgtgatccgcccgcctcagcctcccagagtgctgggattacaggcgtgagccactgcgcccggcctattttcagttttttaaggaacctccatactgttcctcaaaacagctgtactaatttacattcttactaactctgtgattcccttttctccacaccctagccaacgtttgttatcatttatcttttggtaacggccattctaactggtgtaatatgatatctcattgtggttttaagtgtgtttccctgatcattagtgttaagccttaatgttaagcagtttttcatataccttttggccagtcttcttttaagaaatgtctatctggtcctttgccttttgagacagcatctcactctgtcccccaggctagaatgtagcagcgtgatctcggctcactgcaaccttcccttcccaggctcaaaccatcctcccactcagcctccaagtagctgggactacaggtgtgtgccactacacccggctaattttatctattttttttttttttgaaacagaattttgctcttgttgcccaggctggagtgcaatggtgcaaactcggctcatggcaacctccgcctcccgggttcaagcaattctcctgccttagcctcccgagtagctgggattacaggcgcccaccactgcacccagctaattttttgtattttcagtacaggtggggttttgccatgttggccaggctggtctcgatctcctgacctcaggcgatccacccacctcggccaaccaaagtgctggggttacaggcgtgagccaccgtgcccggccaattttatctattttttgtagagacagggtttcaccatgttgcccaggctggaattgcctgttttttaattgggttgttttcttactattgcattctttgagttccttatatattttgattattaaccccttatcagatgtataatttacaaatattttctcccattatgtaggttggctcttcattctgttgtttcctttgctgtgcagaggcttttcagttttgatgtaatcctatttgtttatttttgcttttgttgcctataatcaggatctttaaaaaatagctctttgatatgaacagcttagagatgtgatcccagaatctgaacttttaattagtggagaaatgataaaagttaacttcaccagcaattttaccatcagtttctcttttgtaatgtgtattttaagggccatatttcattaatgatcacctgtctgtggtgctaatcttcaaaacagaaaacagaatttgtgtcatattaaaaatgttagtaatctaccatataacttatcaaaacatctcagaaattttattttatttttttggagagggtctcatcctcaccctgtcacccaagctagacaggctagagtgcagtggggtgatcacagctcactacacccttcacttcccgggctcaagtgatccccttacttcagcctcccgagtagctgggactacaggtgcaagccacaacacccagctaatttttaaatttttttgtagagacaaggtatcaccgtgttgcctaggctggtctcaaactcctgggctcaagcgatcttcccaccttggccgcccaaagttctgggattataggcatgagccgccatgcctggcccagaaattttaaagatagagttgaccttatcagtgatcagaagaaaggattaaagactaaatatctactttgatacaatgaagtgttttatcttacagcttttgtaagtactgatacttaaagtgtttaaaatgttgtgtattcataggcaaaaataacgtttatgcagtggacatgatgaatctgttggtcagaatccagatatctttcctctccttgccaattttttttaagatcacttctgtggtatttctgccaaaaaaatacatatcctgaatccaataatgaggaatcaccagacaaacccaaattgagggatcgtacagtaactgtcctatatccctctaaaatgtcatggacaaagaaagactacaaaactgttccagatcaagggagactaaaaacacacggaaactaaatcactaaatgcatcaggttatctttcattggattctggacaagaaatggggagttatcattttacaaaggagattattagggctgggtgcagtggcctgtgcctataatcctagccctttgggaggctgaggcaagaggattgcttgaggccagcagttcaagaccaacctggccaacaaagcgagatcccatctctattaattaaaaataattaaaaaaggatattattaggacaattggaaaaatttgaatggggactataaaataaacggtattaagttaatttcctgatttgattgcacactgtggttatgcaggaaaatgtccttgtttttggcaagtgcagacttaagtttttaagaataatgggatatcatgcctgcaatttactcaagactagtttagcaaaataatacatatatgtgcatgcttataaagagagagaatataatcaggcaaatatggtaaaaaatgtaataatcaggaaacttagtgaaggatatacaagaattttttgtactattcttgcatccttacatttaaaataatttttttttttttttgagacagagtctcactctgtctcccaggctggagtgcagtggcgtgatctcagctcactgcaagctccgcctcccgggttcataccattctcctgcctcagcccactgagtagctgggactacaggcacctgccaccgtgcccggctgattttttatatttttagtagagacggggttagccaggatggtcttgatctcctgacctcgtgatccgcccgcctcggcctcccaaagtgttgggattacaggcgtgaaccactgcgcccagcctgaaataatttcaaaataaagtttaaaaaccagtggccgggcgcggtggctcacgcctgtaattccgcactttgggagtccgaggtgggcagatcacttaaggccaggagttcgagatcagcctggccaacatggtgacaccccacctctactaaaaatacaaaaaaaattagccgggtgttgtggcacatgcctgtaatcccagctactttggaggctgaggcaggagaatcgcttgaacctgggaggcagaggttgcagtaagtcgagatcatgccattgcactccagcctcagcaacaagagtgaaactccatctcaaaaaaaaaaacaaaaagtttaaaaactagtgtaatcttttttttttttttttttttttttgagacagagtcttgctctgttgcccaggctggagggcagtggtgcaatctcggctcactgcaagctccgcctcccaggttcatgccattctcccgcctcagcctcccaagtagctgggactacaggcacccaccaccaggcctggtttttttgttttttgtgggttttttttgtatttttagtagagatggggtttcaccatgttagccaggatggtctcgatctcctgaccttgtgatccgcccgtcttggcctcccaaagtgctgggattacaggcatgagccactgcacccggccaaaaactagtgtactcttaaagcaattggcaaggagaagggcaatctctggattctgatcaacagattaatcatgaccactgcccaaaagttatcccatttttgcctatgaatgcataacattttcaaaacttgtgcagatgtatactgccacaggcatagtaatgtttgtagcattataatttcgtaacagaaatataatgaaaaatactattaataggcatttttgtaatactgaaatccaccaaaatatccatcataaggttaaataaaatgtttacaaattggaaaaaaatgagattgctgctctgacattaacttataagatatgaaaggctatccacagtaagtgacataagcaaattaaagcttgcctcattctgcatgtttctacatccacagaagagtatctggaagaatttacattaatctgtcaaagcaacctgtggttgtaggggaagtactttcaatttttactttagaaacttttttcttttttctgagacagtcttgctctgtcgcccaggctggagtgcaatggcctgatcttggctcactgcaacctccgcctccggggttgaaggttctcctgcctcagcctcccgagtggctgggattacagacgcgtgccaccacgcctggctaattttttgtatttttagtagaaatggggtttcccagccttggcctcccaaagtgctgggattacaggcataagccaccacgttcggctctttatatatttctgtatcatctgatgctttttgtttttttgagacagacctcactttgtcacccagcctggagtgcaggtgtgcgatcttggctcactgcagcctccacctcctgggttcaagtgattctcctgcctcagcctcccgagtagctgggattacaagcgcatgccaccacacctggctaatttttttatttttagtagagacagggtttcaccatgttggccaggctggtctcgaactcctaacctccagtgatctccctgtcttgaccttccaaagtgctgagattacaggcatgagccactgcacctggcctgtttgatgcgttttaaaaaaaaaacataaaggatccagaattatctggatcaaaaaataaaaggaaaaaaagtatctcactgcatatagcaataaattggcccacaaaaagatattgctataaaaccctacttctggccgtgtgcggtggctcacacctgtaatcccagcactctggggggccgaggcaggcagatcacaaggtcaggagatcgagaccatcctggctaatacagtgaaaccccatctctactaaaaatacaaaaattagccaggtgtgggggcgcgtgcctgtggtcccagctactcagaaggctgagggaacagaattgcttgaacccaggaggcagaggttgcagtgagccgagatcgtgccaccgcaatccagcctggacagtagagactccccctaaaaaaataaaataaataaataaataaataaaccctacttcttaaaagaaaagaaaaacctatgttattaccttgatttctcattggaatggttagtagagcaaggtatggcaatagctgagtttggaggcataaagctggtaggcagaagtcaggaaaaagtgcttttgctgccaggcaattttcccgatactgtatagaaaagaaaaaaaaaagatgaaaggaaaaatgaaattaaaaatatgtattcctagacaaactaagtttattatataaacttacacaataagtttatattaacttgtgggtttatatatcacaaatatacttttaatagcttatttaagtagtcctttatagtttttttagcatcgtttaataaagtattttacctacacaactattccacatttaataaacaacaatttttaaaagacattgaatgtataagaaaaccaaatttaaaactcaaaggaattgtttatgagcacacacacatcataaattacacgaaaatagttttcaatgaaataatttgttttctttagtcaacacgttatgctgagcaagagaaaagcacaatccctgccttcaagaagctaacagtcttagataatttatatgcagcaacaatgcaaaattaatatatatgctataaaagacaaagcaagtcaatgagatataaattgcttaaaagtcattaaattctccaagaaatctgttggaaaaaatgtcctaggtaataaattatagggtaattttcagctgtatgattttagaactggaagacatctcagagacgacccagtccaggggtcacgaattcagatattacagaagtcaagcaggcaatataagtgaatgaaccagctggggacagtggtgcctactactctcatctcaaaggggcagatgctacatggcgaggtgattgttgctacgcagaaatatgagccagtgttatacttcactttcatttttttgagagatgggggtctcactctgttgcccaggctggagtgcagtggcacaatcattgttcactgcaaactctgcctcccaggcttatgcaatcctcccaattcagcctcccaagtagctgggactaggtaggaaaaacaaaaaaaatttttcctttttcctgtagatatgggatctcactatattgctggtctcaaattcctggtgtttgccaccacacccagctaatttttttattatttttttttttatacagatggggtttcaccatattgcccaggcaggtctcaaactcctgggctctagtgatccttccacctcagctttccaaagtgctcggattacaggtgtgagccactgcacctggcctcttttttttttttttttttttaaccaggagattccagaaattctgaagctagaaattcatatctaactttttttttttctttctgagacagagtctttttctgtcgcctaggctggagtgcagtggcatgatctcggctcactgcaacttctgcctcccgggttcacgcgattctcctgcttcggcctcctgagtagctgggattacaggagcgcaccaccacacctggcaaacttttgtatttttagtagcgatggggtttcaccatgttagtcaggctggtctcgaactcctgaccttgtgttctgcccgcctcagcctcccaaaagtgctgggattacaggtgtgagtcacagcgcccagccgaaattcatatctgacttttaatcattagtctgatttttaaagattggcaattcattttgaaaactgttgtgtattttgttttcaacttgtgtgcctcccattttttacctctaaataattcaatcatctacatttttagctgtggagagtaagaacacattaggtgaataccttgtccatatagaggcaaggccaagatttcttctcctttctttgattaatttaaattgacaaataagctctgtatgtatttataggtatacaacatgatgttctgaaatatgtatatatggtagaatggctaaattgagccaattaacatatgcattaccttacatacatatattttttgtgtgtggtgagaacacttaaaatctaccgttttagtgattttctttttttttttttagatggagtctcgctctgtctctcaggctggagtgcagtggcgccatgtcagctcactgcaagctccgcctcctgggttcacgccattctcctgcctcagcctccagagtagttgggactacaggcgcacgccgccacacccggctaagtttttttatttttagtacagacagggtttcatcgtgttagccaggatggtctccatctcctgacctcgtgatctgcccgcctcagcctcccaaagtgctgggattacaggcgtgagccaccatgcccggccatgattttcaaatacatgacacattgttgttaatagtcaccatgttatacaacatatctcttgaacttaaaacttattcctcctggccagcgaggctccgtctcaaaaaccaaaaacaaaaaaaacttattcctcctgcctaactgaaattttatatactagggatttctattttccaatcagcattctcaggttgaactagggtttatttatttacaatttttttctttttcttgtagatatgggatctcactatgttgaccaggctggtctcaaactcctgggctcaagtgatcctcttgttttggccttccacagtgctgggattacaggtgtgagccaccatgcctggccctaaagtttgtttttaattgaaactgaaatataactatgcagctgggcacagtggctcatgcctgtaatcccagcactttgagaggccaaggcgggcagatcacttaaggtcaggagttcaagaacagcctggccaacatggcaaaaccccatctctactaaaaatacaaaaattagctgggcatggaggtagatgcctgtaatcccagctactcaggaggctgaggtgggagaattgcttgaacctaggaggtagaggttgcagtgagcagagatggcaccactgcactccagcctaggcaagagaacgactctgtctgaataaaaataaaaaataaaaaataaaatatggccgagcatggtgtctcacatttgtaatcccagcactttgagaggccaaggcaagaggatcatgaggtccaaagatcgagaccaacctggccaacatggtgaaaccctgtctctactaaaaatacaaaaaattagccaggcgtggtggctggcgcctgtaatcccagctacctgggaggctgaggcaggagaactgcttgaacccgggaggcggaggttgcagtgagccgagatcatgccattgcattccagcctgggcaaaaagagcgaaactccgtctcaaaaaataaaaaaataaaaaataaaataaaatgtaactacgctttgattccaataaaactgaactaatattttcaaattgtgatggtcttttttcccttaaaaaattgtacaagcatttaagagtcacctttttatgttttataaaaactcagaatctaattgtggaccttagcaactattttattaaaaatgaaatattttttcctttgttatgttttaaagaaaataactgctttgagttataattcacgtaccataaagttcacatattgaaagtacagaatttttttttttttttttacctttttatttattagaaaccactgaggtttgtgcaagggtcgaaaacttgatcctcctccttggcaatgagcatatcctcgggctttgttggaatgcatcacacctctcgtagctatagatgtgctatattccctgagtaaagagcgtgtctaacaaatgagacaagatgtgaaagaaaatagatttataaaagagcattactggtattcctgatatatacaaaaatactaaccgtatttagtttctatgtgttcactttcttcaacatcactacagccctataaataacagcactataaacttatctaaagcaaattccactgggacatagccatcaaattaaatgtgtaaaccctgactggatcttggacaggggtggaggaaacaactttgaatacatttttgaggcaaatgaggaaatctgaatagggacaatatattgctagattagtgtgaagtttctctggaaagttaacttaattatataactaattagttaatgtaactaattagttaatataactaaaatataattgaaactaaaatatgactatgcagctgggcgcagtggctcacgcctgtaatcccagcactttgagaggccagttatatcaactagttatattttagtttcaatggggtatgataatgctatggtagttgtaatagaacaatgtccttatgctgcttaagtgtcacgatgttcgcaattactaatactttccaattattcagccagaaacaaatacgtaaatatatagagagattaagaaaaagtggcaaaatatgcaaactgctaaacaaaagttaaggatatgcagctattcattgtactatcatttttttttaatttttaatttgtgtgggtacttagtagctgtatatatttatgaggtacaggggtcattttgataccagcatacaatgtgtaataattacctcaagttaaatggggtatccattacctcaagcatttatccttggtgtcacaaacaagtcaattatactcttttcgttattttgtattattatttaaaatagggtctcagtctgttgcccagcctggaatgtggtggcacgatcacagctcactaccacctcaaactcctgggctcaagtgattctcccaccacagcctcccaagtagctacgactacaggtgcatgccaccatacccagctaatttttaaaatctcttctagagatggggtctcgctgtgtttcccaggctgttctcaaacttctggcctcaagtgatcttcctgccttggactcccaaagtgcagaattactggcaggaaccaccactcctggctcattgtactatccttttaatttatttataggatggaaaatttcaaaataagaaagaaacaattattttaaaagttaagcaaattcaactgctgagtaatgaagctctataacataaatggtttttctgtgtctttcctaattttacttattactgctatttcaattttttaattttttgagacaaggtccagctctattgcccaggctggagtgcagtggtgtgatctcagctcactgcaacctctgcctcccaggctcaagccatcctcccacctcagcctcctgagtagctgggaccactacacccaaacaattttcttggtatttttttgtagagatggggtttcatcacattgccccagctggtctcatactcatgagctcaagtgatccacctgcctcggcctccttaagtgctgggtttacaggtgtgacccactgagcccggccttattttaatatttatagcacacagaaatattaacgtatcaaaatagtgtcgtccaacagaacgccctgcaatgatggaaatgttttgtatctgggctgttcaataaagtagccatcagccacatgcagttatcaagtactggagatgtggctagtatgactgaggaactgaatttttaaatttaaatgtaaatagctacatgtggttggtggctgttgtactggtaagggcagtgttaagatgttaagaacaaaatacaaattttatggtaaatagtttcaaatatgtaaaagaaataaattttaaaaactagcagaaagtgtagcaacatgtacagttctttctcttgtatctacttcttaatggttgtcatattttgagtatgtattaattttaaaatcagaaaataagctggggctgggcatggtggctcactcctgtaatcccagcacttttgagaggccagggcaggcagatcgcttgagctcaggagttggagaccagcatgggtaacatggtgaaccctgtctctaaaacaaagaaaaaaaaattagctaaggatagtggtgcttgcctgtagtcccagctactagatggggagtgcctgaggttggaggatcgcttgagcccagaaggtcaaggttgcagtgaaccatgtttgtaccactggactccagcgtgggcaaaaaagtaagacgctgtctcgaaaaaaaaaaaaaaataagctgggcatggtggtgtgtgcctgtatttctagctacttcgaaggcagagaggacaggattccctaaacccagtagttcaagaccagactgggtaacatagctgtagatagagcctcttctcaaaaaaaaaaaaaaaaaaaaaaaccaccataacacaaaacacaaaatcagaaaatttagagacaggagtgtggtggctcacgcttgtaatcccagcactttcggaggctcaggtgagaggactgtctgagcccaggagtttgagaccagcctgagcaacacagtaagaccctgtctctacacacacacacagaaaaaaaagaaaaaaagaaaataactttagaaacaattggtgctatattatcagcagaaaaatcagatttgctactgaagcttcattataaacactgagttggttacattaactttagcatagttatgaagaaaagtcacataaaataatgtcaggcaattagggataaaagtaaactttcttttcttaattctaaggaaatactataaacataaacattttaagtcaaatggtcttacattccagtcaccactgaggatatctgcaaaactcagaaattcactggctctcacaatatcatcaatttccatgaagaaatctatgtagttttggtgaagatataaattaaataagtctccaggcatgtgtgacatttctactacctcctataaaaagaagcatatatacataaatttggtaaaaatgcaatggtcaaatatatatgcacacgaataatatatcctttgtaacctatactaagtgtcatcaaagaacttacctcaggttcaacaagtaatgtatcccgttcatattctgataaatgagagggcaaccgaggtgagtctaattctgttaaagatgctcctataaaaaatttctggaattattaaagataataccttctttataattatatagcacctctcatttgaagagtttgaaaattttagacatacaataccaacatagtaacaaactgttaaaaaataataaataaataaaaaacaactggaagcaagcacctattttttccacattagcaagaactaaattaacaattctgatgcttagattatggcttctctagacttaaaatattccatttcctaatgcactcccatttcacctttttcagctttgggttgctttcttcccttgatttctcatctcaatacagtggtctttactcttttatttactatgtaggaagatgttgctctctacatgaaagaatacgaattccattcactaatgcaagagacgataaacgtatgttggggaggaaaagaaaggagagaaagaaaagaatcaggtgggaatagtcactcaggttcaaagtaagaggatccagtgacagaggagtgtcctcactgccacctaagtgatgcccattttcctcagatggtatgaaggtttccatttagaaatcctaatttctttcctttagggtcatcagactgaaaacaggcatttgctatcaaaaggagggattatttgggacactaaaatgggcaatagggagtgaaagaactgagggggagcagtcatcaaaaaagacagaaaaggcgataaacatctctggttggggagacagaacgcttgtaaattagagaaatacaagacgattgaaagaaaccttaaactacctggtaatttgtataaggctctgttggctggagcccagtgttaagagggctttaggctaccaacacttgccactacaagtctagatgatctgctctcttaccttcagcaaactataattttaaagatttacacacatggatatggcctgcaattgcatgtttttacttttaatcctgcttacggtcagaaaatattctgatttcctactatgtcttaggcctaggcaaacagtatctgacctagctctaactcttagagcagaaccaaaatacatgacatttttttaaaagtgacattttatttccattttaagactatgtgatatccaacagattttaaaagtgtaaaaatttcttacttttacaatatagaattttccccaaagctctgaagagaaacagagaaacatctttgccaccaatagcttggacctcttgattttcaaaaaccctatcaggtttttttcttcgttttgattttgacagcacagcatctgattttaaagacattccttttttccttggccgtaagttgttttctcctgaataatatacatccaagtgacaatatttaaattaaaatatgaaaattaaaactaagaacacttcagatatagttacactaaatattctaattacaatttgttttcctaataaacaaaaattataaatgacattaactgagttggaatcctctttgggttactaacattaaaatggaataaagtattatctgaaagttatttcataatgcagatttcaaactttcacatgcacaatagcacaatctctaatataggctgacattcctgatccaaaaaattcaaactccaaaatactccaaaatatgaaacttgcagtgccaacatgatgctcaaaggaaatgctcattggagcactttgtatttcagattttcagacaagggattttcaattcgtataatgcaaatattccaaaatcttaaaaaaatctgcaatccttctattcccaaaaattgcaaataaaggatattcaacctgtacagtcacatcgccttggtttctcatcgtgttatgtgcaagatactgttcttggcatgtaatacataggaatttaatcttcataacaaccctgtgaagggagaattttttttttttttttttgagatggagtctcgctctgttgcccaggctggagtgcagtggtgtgatctcggctcaccacaacctctgcctcctgggttcaagcgattctcctgcctcagcctcccgagcagctagaattacaggtgtatgcccggctaaatttttgtatttttagcagagatgaggtttcaccatgttggccaggctggtcacaacctcccaaccacacaaattggcctccccaagtgctgggattacaggcatgagccaccatgcccggcctttttttttttttgacacagggtctggctctatcacccaggctggagtacagtggcacaatcatagctcactgaagcctcaacctccaggctcaagtgatcctcccacctcagcctctcaagtagccgggactacatgcaccaccatgctggctatatatatatatatttttaattagagacgaggcctcgctatgttgcccaggctggtatcagactcttgaggttgaagctttcttccacctcagtctcctatagtgttgggataacaggcgagagccactgcacctgaccaattattattagacagttaatgaaatgagatacaaagaggtaaagtcattggctcaaggtcatcagtgagtgaatgactggaatccaggcagcctggttctgcaatctatgtttaacaacctctctattgatgttgagagtatccaatttatgaatatgcatgtgatcacatttcttgggtttttattttttttccttaatttttttgtagagacaaggtcttgctatgttgcccaggctggtttcaaactcctaggctcaagtgatccacccaccttggcttcaggcatgagtcaccatgcctgacccaagtttcatttttaagtctaatatttagaactcaagagtgcatggcttaaaagctaccttgaacagcagaaagagcacaggatctggatttgaatcaaaatactgtctatctcatcaggttgatatgagaattaaatgaaaaaaacataattgctaacacagttcctggcccactctttgatgtcaattatcaacgttaagcattaagtagtctgctaaatgccttctgaaggaggactatgcagtaaacgatgaccattacagtaaaaatgtaactcactgccattagtgaaactatctttttactacatctttctacatattaacaggaaatttattaaacatatctcataaatttatactttttaacattaacaggaaataaatttattaaacatatctcataaattattataaaaataatttcaggccagatgaggtggctcacacctataatcccagcactttgggaggccgaggcgggcggatcacgaggtcaggagatcgcaaccatcctggctaagacagtgaaaccccatctctattaaaaatacaattagctgggcgtggtggcagctgcctgtagtcccagctactcagaaggctgaggcaggagaatgctgtgaacctgggaggcggagcttgcagtgagccaagatcatgccactgcactccagcccgggcggcagagcgagactccgtctcaaaataaataataataattccaaaagtaaacctacctcggcacagtattattaaactgattaatggctggccatttatgaacacttaatatgaatcaagtactgtaagaagcactctataatagtgtcacctcacatattcttcatagaaccctaagaggtaagtgctcacataaaaggtgagaaaacagaggcacagaaagataagagtcacctgcataggcctatataactggtaagtggcagaggcagaatttttatccaggaaatctggttctaagttaactttgaaaggtaaactatctcaaacagaaacaaggatatatactacgacatattcatagaagggtatgtatgcatgtgtatatatttaattttaagccactgtctcagtaataaagaaggataaataggtatagaccaaatgtaagttaaaatgtttgatttcattgaatgaattaagagaaagtcagtcacctatataatgccacatgactgtatcttccatagttaccttttgaagaagaaaactggaggctgtttattgcacttctgatatcaccagaacatccctgacagagcaactctagagaagttttgtcagggacagtaatttttcctccattctaaaataagaaaattaaatttaaaaaaaagtattttcttaaaaataacaacaacaaaaaaccccaacctattttctaaacttaattaacgtaaattagattcttttaaacttaaatactaaaaagggctgggcacggtggcacattcctataatctcagcaatttgggagactgaggcaggaggatcacttgagctcaggagtctgagaccagcctaggcaaggtagtaagaccttatctctacaaaaaatcaaaacaattagctgggcatggtggcatgcgcctgtagtccctgctacttgggaggctgaaatgggaggatcacttgagacctggagatgaaggctgcagtgagctatgatcttgccactgcactccagcctgggcaatagagccagaaaaaaaaaattatcttaaaatagtaataaaaaactaaaaagccttcatgctaaacactggtctatgaatgatacaagcttcaatgacttattacagtttaaggtatactttcaggaaatattaaatactgtattattttactttttcactttgaccaggttgtattttgaagtttttactctttctcactacatacacacagatatataacaacatatatgtgtacacacaaaaaaaccctcaaaatgcaacagactgtgataaaattaaatatacacaaaataatctaactaatttatgaaatttacatgaaaattcctttactggggttatacattatacagtctggtgaggatgaaaaagccataattacaccaattatttcttcttcttcttttttaaaccagagccacttgaactaatcaattcactaaaaaaaaaatttttgttttgacacaaggtcttactatatcacacctgggctggtcttgagctcccaggctcaacaaatcctcccaccactgtcagcctttgtagctgggactacaggcatgcaccatggctcaatttgcagttctcatgcttatagtagagaatgtagatgtttttttagagacagggtttagctctgtccatgacagactacagtcatttcatctagatcactgcagcctcaaactcctaggctccagcgatcatcctgtctcaggcttctgagtagctgggaatacaggagcacaccaccatgcccaggtaattttttttcttttttttgggatacagagttttgctcttgctgcccaggctggagtgaagtagcgcaatctcggctcactgcaacctccaccccctgggttcaagctattctcctgcctcagcttcctgagtagctgggattataggtacccgccaccacatccggctaatttttgtatttttattagagatggggtttcacctgttggccaggctggtcatgaactcctgacctcaggtgatacacccacctcggcctcccaaagtgttaagattacaggcgtgagccaccgcacctgacccattaaatattttcaaaacactaatagcataataattcatcacagtaattgcttcctgtattattggactcagtttgtttctcatttttcactattaatatctgttatttattcagttaggtgctctacactaacgtatttaatcctcaaaacaacctctcccttggatatttccctcagttcctgtggtcctagcagtgcaacaaaaattatgtttcatgcaagatttggttgatttataccaataggattccctaaaaccatgacgctgggagcagaaggtccatcaatttttttttaacatcatcttgatttgaaatacagaaaaaatgacgtactaaaagtgaaaagaagccgggcacagaggctcatgcctgaaatctcagcactttcagaggccgaggagggaggatcacttgagccaggaattcgagaccagcctgggcaacacagagagaccctgtctctaaaaaaaattaaaaaattagccaggcgtggtggtaccagcctgtagtcccagctgcttgggaggctgaggtgggaggaacacttgagcccaagaggtcgaggctgcagtgagccatgattatgccactgcagtccagcctgagcaacagagtgagaccctgtctccaaaaaaaaaaaaaaagtgacaacagctgtatatgaatgtaaatagactttacaatactgaagtgtatctttgaaaatggttaagatgataaattttatgatacatgtttttcaccataattaaaaaaaatgtgaaaataaaaaagtgacaacaggacaataggaagagttgaattgttgataactaccatacctacatgccagaaaacattttcttgatgacagacacaatttagaacagtaaaccaagcaaaggaaaaatttacctcaatgtgaaagtgaaagtttaatagtagaaaaatgttaaagatttttaaaatcagtatttcctacatttgctaaaatgacatgccttatgagtataataaaatgttttaattctaaaaaattaaaataacactccttcagtttacataatactatttaagctaggctttctatagttatcgagtaaggtttaattaatcagagacttaccttgttagcttctatagtcactattcgattaagaaatttcatcataattgttggtgccacagggttgaaactaagttttataaagaaagatagcagttaaatgattaatttaaaaatataatatgtatgtgacctttataagcagaaatttctttcttacctaatatttgagatagaacactcttcctgaatttctttgggaaacaataacctttgattattatctccactgagactgtccgagattataaatataagaggacatcgaccaatcctcacatacttcctaaaataacaaaatacagcaatgttgaaatttaagccacttctcatttaatttggagttttagaatacttcactgaaacctaccttagaacttcatgtaaagtatgagaatcccgataaaactggttaggtaaatcctattgaaaataaaaaataaataatagtatagttttattccattgcaaatttatttttcaaatttatatttattgaggtaggcaaaaatatatttattcaatgtattttaaacagaactttcacaggaaacatgaaatagatgatatccgaaacagtaatatacatcaatggggatcccaatttttagatcaaatttctttgggttgctttccagttacagtattttcactaggaagtaattttccaaacttttcttttgtttttctatacttaaaccattaaaatttataacattccttatcctacagctattccattcaagtttactagaagagactttaggtttctactattacaaagcctttgtgttgtattttaccaatatcactactatagagacaagttaacattatcatgtaagatatatctcacaattgtttagtcaatagctacagcaaaattttaaaagttggctgggtgtggtggctcacatgtgtaatcccagcactcgggaggccaaggcgggaggattaccttgaggtcaggagtttgagaccagcctggccaacgtggcaaaactccatctctactaaatatacaaaaattaggccggcatggtggcaggttcctgtaatccccactactcgggggaggctgaggcatgagaattgtttcaacccaggaggcggaggtggcagtgagccaagactgcaccactgcactccagcctaggggttaaagagagactctgtctcaaaaaaaaaaaaaaaaaaaagattttaggccaggcatggtggctcacgcctgtaatcccagcactttgggaggccacggtgggcatatcatgaggtcaggagatcgagaccatcctggctaacacagtgaaaccccgtctctactaaaaaatacaaaaaattagccgggcgtggtggcgggcgcctgtagtcccagctactccggaggctgaggcaggagaatggcgtgaacctgggaggcagagcttgcaatgagctgagatcgcgccactgcactccagcctgggtgacagtgacacagcaagactccatttcaaaaaaaaaaaaaaaaagattttaaaagttgtccttacttcaaccagaattatcttcttatcagttctcagatcatctccaagcatttgtaacttgttatactttgtcgctcttagtagaaactctttgaaaactgctatctgagactgatagggaaacatatggaagcttgattctgaaaggaaacacataaccacttttattttcaacaaatgatatacattaatattatacatctgtatgtacacacacacatacttgatgcatctcacaatactgtagactatttcccaattaggaaaaatcatttaaatttaaaataggatattcctttcaaaggacaagagtcaacatgtagccaggcacagtggctcacgcctgtaatcccagcactttgggaggccgaggcaggtggatcgcttgacctcaggaattcaagagcaacctgggcaacatggtgaaacccggtctctacaaaaaaatacacaaattagccaggtgtggaggcttgtgcctgtagttctggctacttgcagggctgaggcagagggtgggggtaatagcttgagcccaggaggtggaggttgcagtgagccaagattgtgtcactgcactccagcctgggtgacagagtgagaccctgtgtaatatggagttaactgacctaagaacacagctgtcggtataacattcatataattggtaaaaatatctatgactgtggcctacccaatgaagaatctctaaatgagttcaagcctataaatgaattaccttcagtgataagggtttggtttgtttgttttgagacggaatcttgctctgtcgcccaggctggagtgcagtggcgcaatcttggctcactgcaacctccacctcccaggttcaagcaattctcctgcctcagcctcctgagtagctgggattacaggaacacaccaccacgcctggctaattattgaatttttagtagagacggggtttctccatgttggtcaggctggagtgataaaggtttaacaacaaaaacagaataactgattagtgaacttgagaatgagggaagctctctgaaggcatgtttcatattgaagactgtttaagttaaagcttatcagactgtcaaaagtaatgctactatttagaaagcagtaaaagccagatgcaggaacacacgtctgtagtcccagctaccccagaggttgggtcgtgagaatcccttaaatgcttaagaagttcattctagacaatatagtgagactttctctcttaaaaaaatgataataataatgggccgggcgtggtggctcacgcctgtaatcccagcacttttggaggccgaggtggttggatcacctgaggtcaggggttcgaaaacaacctgaccaacgtggtgaaaccccatctctactaaaaaatacaaaaataagccgggcatggtggtggacgcctgtaatcccagctacttgggaggctgagtcaggagaattgcttgaacccaggaggcggagcttgcagtgagacaaaccactgcactccagcctgggtgacagagcaagactccatctcaaaaaaaaaataataataatagtaataataataataaagaaaagaaaacagtaaaagccccagcaggatgggatactagtagcacaagggagtacattaaagaagagtccagagaagggattttgaggaacactccacattaaaattatccttctacagaacccttttcccttcaaaatggcctaggagatttggctatccctagtttcaccacctggagttgcaatatgaaaaactatgaaagataaaaatgatagtgctaaggtacataagcatatgcatgaacttataacgtattacatctttaaattggtactattgccacgcatggtagctcacgcctataatcccagcactttgggaggcagaggcaggtggatcacttgaggccaggagttcgagaccagactggctaacatggcaaaaccccatctctactaaaaatacaaaaactagctgggtgtggtggcacatgcctctaatcccagctactcaggaggctgaggcatgagaatagcttgagtctgggaggcagaggttgtactccagcctgggcgacagagtgagactctgtctcaaaaaaaataaaaataaataaaattgttactattatcaatttttaaatcgttatcttaaggcctccttccaaattccaaagacatctttgtcttttgctttcatttgatattgttctaacaggtacttactgatctaagctatcttgttggggggcaagttctttttaacacatcttaaggcttgatttaacaaataaaatatcttagttaatactgtctaacctcctagccagatcttagaaaaaagcagataaataatgcaaacagaagaatatgttaacaaaacagttaagacttaatcttcaaaaaattccattgtcttccattggagacatgctttctttccttctcctgaaataacttttatttatttattttttgagacaatgtctcattctgttgcccaggctggagcacgatggtaacactatagctcactgcaaccttgaactcatgggctcaagtgatcctcacacctcagcccttgagtagttagaactacaggtacacaacactatacctagctgatttttttatttttgtagacaggttctttgtatgttgcccagcctggtctttaactcctggcctgaagcaatcctcctgcctcagcctcccatgtgacagccatcgcacctggcctgtgaaattccatccctctgaaagcaagaagtatgggaaaaaatgcactcatagaactttatctgaaagctcccttaagcacaggtttgccccactacttctactaccttcacagcaaatcttaccagtattaaacatccccttgaaatcatctttttggaagtctggtaaaactggattaatccactcttgtacttgaataccatgctcctttgatagtatttttaaggtcgttgtctttccacatccaggaggacctgttattaataaaatagatccaccctaaaatcaaatacaaatatgaattaaaaaccaaaatcactggaatgctagaatattatttctgacttttcattctaaatatatttacttctataaatatttgctgaatgtctcatataagcacattaaatttcataataatgcttgctggaataaaccagctttatttttttcttttttaaaaattgcctttttccccccttttccatacaaaaacatctgcaaatatggaaataagagaatcttaattcttcaactctcaattccgcttctgataatttctcaatttttgcattatgtccctctcaaggactatttagtagccaaatactaaactttggctaaattagggaggtgatgtctgaaacaaagatttttagaggttacctgaactcataaaatttattctttttttttttttgagacgagtcttgctctttcacccaggctggagtgcagtggcataatctcggctcactgcaagctccgcctcccgggttcacgccattctcctgcctcagccacccgagtagctgggactacaggcgcccgccaccacgcccggctaatttttttgtatttttagtagagacagggtttcaccgtgttagccaggatggtctcaatctcctgacctcgtgatttgcccgccatggtctcccaaagtgctgggattacagatgtgagccaccgctcccagcaaaatttattcttaatatagacatctcattggatgatataagttactgttatacaaatacaatattcttatggaaagacctcagtttggttattagattctttaagaaatgcatattaagacacatatttgggaagagcacggcggctcacacctgtaatcccagcattttgggaggctgaggcagacggattccttgagcccaggagtctgagaccagcctagtcaacatggcaaaaccctgtctctacaaaaaaaatacaaaaaattagctgggcatggtggtgtgcgcctatagtcccagctggtcaggaggctgaggtggaagaatcacttgagcctgggaggtggaggctgcaatgagccaagattgccgctgcactccatcctgcacattagagtaagatcctgtctcagaaaaaaaaaaaaggaaaaaaaagaaacatatttaccagagataggactctaacgagagactagaggttgtggatcccagtaacattccctcataccgtaaatttgattaaaaaaaaaaaagttgaagctacagaaatatcaaaagatttcctacatacaatggtaggctataattcttgtttattttcctttaataagaacctatgtacttggacaaagagagcctgctccacttttgaaaggggcagtgcatgagttatagcgctgttcaccatgagttcaaactatatggatcaacaatatacagtcatgtgccagataatcaactttcagtcaatgatgaaccacatataaacagtagtctcataaaattataatggagctgaaaaattcctagtaacaataatgcaaaacatcactcatgtttgtggtaatgctggtgtacacacacctactgtgctgtataaaagtgtaacacgtatatctcattatgtgtaacacataatgcttgataattataataaacaactatcttactggtttatgtatttacagtgcccatctttattattagaatctacttgttttttaaaaaaaaaagttggccgggcacagtggctcacgcctataatcccagcactttgggaggccgaagcaggcagatcatctgaggtcaggagttcaagaccagcctggccaacatggagaaaccccatctctactaaaaatacaagaactacccgggcgtggtggtgcactcctgtaatcccagctactcaggaggctgaggcaagaaaatcgcttgaacccgggaggcagaggttgcagtgagccaaaattgcaccactgcactccagcctgggcaacaagagtgaaactctgtcaaaaaaaaaaaaaagaagttaactataaaacagcctcaggcaagtccttcaggaggtactgcagaagaaggcactgttgtcataagagatgacagctccttacgtgttgttgcctctgaagaccttccagtggacaagacatagaggtggaagacagtgctattaatgatcctaatcctgtgtagacctaggctaattggtgtgtttgtgtcttcatttctaattttaaaagaagcttaaaaatttttttttaaatacaaaaaaaatttatagaataaagatataaagacaaaatatttttgtacagccgtaccatttatttgtgttttaagctaagtgttattatcaaagaatctaaaagtttataaagtaaaaaagctacataaagtccttcacatggcctttacaaaaagttccagtaagtgaaggttaatttattaaataaaaaactgtttaagtttagtgtagcctaagtgtacaatgtttataaaagtctacaatagtgcacagtaatgtccttagactgtcactaaccactcacagtcactgacttaaccattttccagtccaagctccattcatggtaagttccctatataaatgtatactagcattttttttatcttttataaccatgtttttaccaaaaaatattttttttttgagacaaagtctctgttctgttgcccaggctggggcacagtggcactatctcagctcactgcaacttccgccacccgctttcaagtgattcttgtgcctcccatatagctgggactacaggcacacaccaccatgcctggctaatttttgcatttttagtagagatggggtttcaccatgttggccaggctggtctcgaattcctgacatcaggtaatccacccacctcgacctcccaaagtgctgggattataggcctgagccaccaagcccggcctttttactgtactttttaatggtatgctttaggtatgtttatttacacatatagttcccactgtgttataattgcctacagtattcaatacagtaacaagctatacaggtttgtagcataggagcaagaggctataccatatagcctaggtggaggtttgtgtaagtacactctatgatattctcacaacaatgaagtcacctaatgacacatttcccagaatgtatccccatcattaattgaagcatgactgaacattaaataactttaaataaaaacacatatacaacaaggctatatattgatgggttgacaaaaatgttgttaccagaggtttgcaaaaacctaatttagtgtttttcttagaataatggttcagtatttgctaattcagcaactttacagaacataactaccttgaataatgagaactacaataccagacagatcacttctttacaaagaaaaagaagcctatgcacaggcattatacatttttctcatgtaataatatacttaagtgcctgttttctgacagagtgggtacagccacatagcaagtttcccttccagtaagagaactaggaggtagtttcttatcaggacattataatgtgaagaatcttgttaatcccatttgtctacactgtaacagagttttactgaattttgaaggaaagaagctgtcctgaaaaattaaactctgcaaatatttggtatatcgtatttaaaataaattttgaaaagtaaatttcgtttgcccattgataaatctagatcttaccaatttttttgaataaaaacattttctaattactgacatccctgaaacttctgtaaaataaatggtaagtgatttgggccaggcatggtgtggctcatgcctattgattctgacactgtgggatgccaatgtgggaggtctacttgaggccaggaattcaagaccagcgtgggcaacaccataagaccccatctctacaaaaaaatttttttttaattagccagatgcggtggcacacacttgcagtccccagctactcaggaagctgaggtgggaggactgcttgagcccaggagttcaaggctgcagtgagctatgacagcacctctgcaatccagtgtaggcaaccgtctctagcaagaccctgtctctaaaaaattaataaacaaataaacagagtatatgattaaagtccaactccttagggggaaaacttttgaaaccataaagaaaatacttttcccaatacatatatatatgtatacatatatatatatgcatatatatatgtatacatatatatatgcatatatatatgtatacatatatatgcatatatatgtatacatatatatatgcatatatatatgtatacatatatatgcatatatatatacatatatatgcatatatatacgtatatatacacatatatatacgtatatatacatatatatacgtatatatatgtgtgtgtgtgtatatatatatatatatatatatatatatatatatacacacacacacacacacacatatacctaagtttatccaactggtagaataataatagtaacaccaatgtaggtttatgatgtgacaatgtttatactgacagagtattgctaagtgagaaaacacaatggacactgaaaaataaaaactattagctaagctgaccaaaaacaaatcaatgagaaaaagcctggatgtaagaggtgtgtcagatagactgcccaaaaatctgtattcggagacaagagacgagatttctatgaaacatcagaggaataccaatgctgacactgaaaatccaacttgaattcatgatcttagccctaaaccaaaaggtttagatccacaggccagagagaaaggagcttggttcaagagaggaggattggctgggcgtgatgactcacacctgcaatcccagcacttagggaagccgaggcgggtaaatcacctgaggtcaggagttcaagaccagcctggccaacacggtgaaaccctgtctctattaaaaatacaaaaattagctgcgtgtggtggcgcatgcctgtaattccagctactcgggaggctgaggtaggagaatcgcttgaacccaggaggcagaggttgcagtgagccaagatcatgccactgcactctagcctgtgtgacaaagcaagactctcgagaaaaaaaaaagagagaaggatctgttaccatcaaagcaactaaaacaccaactccttcatctcaaggttgaaaactaaaggaaagacctaatgtaaacaatggactctgggtgttagtgatgtgtcaatgtaggtttatcagttttaacaaatgtactactctggtgagggaaggttagtaacgggagaaggctatgcatgtgttggggcaggggatatgaggtacatctctgtaccttctacccaatttggctgtgaacctaaaactgctccaaaaataagtctattttttaaaaaaggaaaagatacaaaacttatcctgcctttctagttggaaatgtatttcaaggtaactaaacaaccctagctagtgatggcaaacttttctttgtagaaaaatgccagtaataactgtagaaataacagaactataagaaagtcactactgtacaactctaataaaataagtgattcaggcaaggattgaaaaactgaagctacagcacttaggtggacgactgatggagaactgggcactcacatgctgccacggtatctccccatggattatgtgtcagttgtgagggaaagttactctacaatgaagatttttgactttcatctctttgatctagtgaccaaacttaagacagcaggagaaccacaaatactttccaatttgacgccctatacaacatacaacatgacctttattcttgcaaaaatgttcaacttgagtctaatcaagcccttgattcaaaatttcaggttataggaaatgcaggatagacgaataagttaatcattattaggaggaaacaacctaacaaatccagtgtgagacttctacaagtcaaccggcctggtctccttcataagtcagtgccttggagaaaagaaagggttagtaaactattattagattcagggaaaaaaaaaaaggcctaagatatataacagccaaatgcaacgtgtgatcctatcctgtttgaaacaaaccagctacaaaagacattttggggacaaatgcagaaacgtgaatatgaattcatcattagacagcattacggcatcctggttaactttgttagagagaataatggtatgcataattaattaggaaaatcatttttttaaaaaaacagacatactgaagtatctaaaagtctaactgaaatgtcacaatgtttataatttactttaaaatacttaagggggaaacaatgagtatattctatatatatttttttattattctattttcttttatgcttgaaaaatctcaaaataaaaaacatttaaaaagggagactgatggaaggagagaatattctaccttgggggttcaaggtaattgtgcagtaaggaagtgaaacaaaaaatatcagtctaaaataaataatgactgtttttggctatatttagtagagaaactaacatgtaatttgcctgctttcctcagcctgagataatctgatgtgctaaatacactagcaccctaattggtttactgattctttatgctaacaataagacataaagaaaaagagttacaaataaaggggaaaactcaaagtctctgagtcttttagtcaagttggaagtagtaaagtcatgaagctttctttttcgctttttgttttgttttgctttttacggtttttggtattgctctgttgcccaggctagagtgtactagtgtgatcacagctcactgcagcttccaccttctgggctcaggcgatcctcccacctcagcttcccaagtagctgagaccagaggcatgcaccacaatgcccagctaattagctgtagagacagtctccctatgttgcccaggctgctctcgaactcctgggctcaagtgatcctcctgccttggcctcccaaagtgctgggattacaggcatgagtcaccatgccccactagggagctttctactgcaggagatctagacttattttgaacaaaatcatcataaaactttaacttctaacaacacactgtaagtcagaaaaatatttgatgttaaatatttaaaaacacatttcttagttacctgttttggttgcctttctaaaacttgagcttttaaccaggtttcgacttcttcaattttctttttatgcacagcaagttcatgctacaacaaaaatttcaaatttaaaacaaaacttcttaactgaagattttttggtacatcagcacatatgaacctaagcattattaacgaaaagaagtagcaaatcagtaacaatctatataataaaatgatccttttgattatacttgaatttttatactattatggaaaaattatattcttaagttgatacctctgtatgataattttggcaagtttgcagttataacattttttaaaattcagaaatacattttgagaagacagtagagaggagtattacatttagtacaaaaatttttaaaaagatcaattctatgttgggattaaattaaatctaagacaactaatcatacaactttagaataactattgagaaaaatctaagccttggaaaataaaaaaatccagaattttttctaacacttagaaagattcttatgagtaaaaaatctgaaaatgtaaatccctctgcttcccatctacccttatgcaccctgaaattaaattatgtagatatgtctgcatgcttttcagtacctgagtttctggtttatatttatccacccatggttcattttcagacagatattcttttgaattttctaaaccataaatctgttctaaggaagatagatttcctctttttctcgctggaaatctgctgctttctaatgtagaaggcccattttttcttctatgacttgagttattcacacctaatgatgtggcagtaatagtagagacgccactacactctagaaaatcatcaaatgatgggtcaacccagtctgttacctgaaaaaaaaagaaatcatgtaaatataatcacattttctcccatctattcccccaaataactgaactactctggaaacaacatattcatatatttataacctttaaaacttaaaaaaaaaaaaaaaaaaaaaaaaaaaaaatttttttgagaccgggtctcactctgtcacccaggctggactgcagtggtataatctcagctcaagcaatcctccagcctcagcctcttgagtaactgggactacaggcatgcaccaccatgcccaactaatttttttgtattttttgtagagatgggtttttgccatgttgcccaggctggtctcaaacaattcttgggctcaagtgatcctctcacatcagcctcccaaagagctgggattaaaggtataagccaccatacccggcctaaaaatcttacaaattaactctttttaaataaaactctgtctgtaatagttgtttttctactttacagtaagtgcaagtgcatacttgtctacttgaccttaaaggagtaaagaacacaaacttatttttattaattgtaaccttcccagcataaacactagaatgatttttttaaactctctgtaggattgaaacataaatattaaaattacctattaaaaaaagcaaaacaaaataaacaaatgataatattttaacagaaacagcaataagagtaatatatctgccttggccaggttaatacattcacaaactaagaaccatttcatacatccaaataatccgtatcagcttgaagacttagtgaagatataggccaaagatcataacgtaatctgtaattatgactggattatatttttcttcagtgtatgaagcaactaatatttttataattgaggcaggctttccagagggggaactgtcactcagaaatgcctgggaatggttgggtgtggtagctcacacctataattccagcacattcagaggcagaggcagtaggattgctgagcccaggagtttgagaacagctagcataacatagggagaccccaactctacaaaaaataaaaaattagccaggcatggtggcgcacgcctgtattcccagctacttggggggctaaggtgggagaatcacttgagcgcgggaggtcaaggttgcagtgaaccatgatcaccccactgcactccagcccgggcaacagagtgagaccctgtctcaaaaaaaaaattttgctaataattagaaattattagctaataattacaaataattagaaattagaaatttttactagattttttaacactctaatagcataaatctagaaaaatatagcttcagatctggttgtagaatctactgcctggctaacaaaaagaaaccaagttatatatttctttcaagaatactcagccacagttgagctatttattagacaatgttcctctcttgaagaaaatgaaccagaagttggagctgaaagtaggcttaggggagacaatttggggcttataaatactttacgaatgctaagtcacacttcactcttcttttaagacagagttaggaatattatcggcagtggattaaaaaaggaagaccactggaaaaaattttagtcatagctacctgattcatttcgtcctcatcaaaagattgtgactggtactataatcttggcccctttcctctatatttttgagagtatgaaaatatctttcattatagtaaaactttcgacagcaattctgatttgcaaattatttatacattttatagtttcatttcttacataaatgtggactcccatatactgaaaaaaagagaaagataaacagcaaagttaagtaacttacttaacatcaaagaaaatttagagctaccacttagggaaatagctaccctgcatgcatgaaactgtctgacccccatcccaccttaacccctatcttgctgagaactcacacactgaattacattacttctaagaagcagtgcttttggttaagctataacaccaactaccactcatatttctctcttctatgttctttcattcaaatgttttcagcctttgtgactgggactgtaaaacactttttcaaaattaaggttgtgcttttagagaacacttgtttcacaacttattaccagacttgcttaaatcattaattacaatagatactcggctctattactttgatagcagtaataagttattaagaatatatataaaaatttataattattttaaggcaattattacatggccattccagtgtatcatacctttgtggaagatacctttggtctaagaaaagtttttgacattataaactgtaatagttcccatccgtagtttaggacttgcagtacattaaactataattcacctgggggggggggggggaagaagccctcaaatgaagaaaaactgtaaatgcccaattatagtaataaatgtatactgatataatcaacaatacaataaaggctcaagaactagtgaaaaagaacagtaaatttaagtgatacaagaaatcaaaattctaaaataattttaatgactataactgtatcaaataatctacttgtggtgttaagagtttttcacatgaactcaatgatgtattagaaaaaaaaaaacaaaaaaaccacacatactatgtacttaccttttgtcattaaaatcaggcaattctatttgagcaatttttatactgaaaattaaagttttccttatttcaaattacagttgcaggtcttcatttccagtatttcccaaaaaagtaaaataccatgaattcacttgctgtggacgaagaatttaagtcttaaactgtaaaatttttgtcttcatttgaacatgttattacaaaatttcttggtaacactgtttttcaaccgtgttttcaaattcttaaatgtttatgcaaactagtgaattcaacgattttaagttagccagaagaaaagtttaaggtctacaaacttatacattggaaagtatactggactactttacagtttggaggcacacatagcctataaacacctcgacacactagaaaacacattgttcagccctccgccccaaatcgttcacgattagagactgtgacgtttcaaaaggtatacaggtggaaaaaaaacacctatttgagtaaatatagtttgtagctcgaaataaaagatgcagaccaggggccggacgcggtggctcatgcctgtaatcccagcaccgtgggaggacgaggcgggcggatcatctgaggtcaggagtttgagaccagcctggccaaaacatggtgaaaccccgtctctattaaaaatgcaaaaattagccgggcgtggtggtgggcgcctgtaatcccagctactctggaggctaaggcaggagaatcacttgaacccaggaggcggaggttgcactccagcctgggcgacaagagtgagactccgtctcaaaacaaaacaaaaacaaacaaacaaacaaaaaaaggtgcagactgttgtcacggtcaggtctctattcactcttgaaaacaagattgacaattacctcctttaaaaagcagataactgtccctgaagatgcgaggttactgaaatgagatgtcagaggtagaccttcaagactattcctagccgacccaccaccaccccacacagtgaacagggaatactaagctcaaatattcgtccaacgtaatcctgtaatcagtggggtgccgggttgagctcgcaaatccccgctgcaggacagggctctgcaccctcaatcttctcatccccagatgggatgggcgggtcgggaggaggagcgacgagagcccaggaaagcttgaaggcagagatagactcacgtctctaagacatatacataatatagccgcaaccgcggcggccttactttcccggagctgcatccccttttaggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtaaccagtgggccgcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccgggggggggcgggggggggtggagagaggtcggcagatccagctctccagcttggcaacctgcttagtctttctgaatctggtatttcgtttgtaaaatgggttgttgattctttggcagggttggccttgggatttttagcgaaataacgtaaggccatatctgcttcccggtagagtcattaatggtggatgcctcactccttaggcctccgtgggccgtattttattttttctttgcttctgataaacgcctcagattagatttcggtaaacgagttcagatgtttgtgacgtgacgaaattgctgtatgcttttgttgagttacatcaaaggatccccccgccccttaaaaggaaggcatatagagcatttcgggtcgtttctcgcgtaggagtgggtctttgaagccatactcagggtgcatgttatcagtgaagggaattaaaatgctgcataacgactttaacgaatatttttgctagccgtttagtcctgaaagtgtttatcaaattgtaggccattcgtggaaaaatctaatgcatgtagattttattgcaaggtacagaaaaattaagactctttgtgggaacagtaaagttacatcattcacccaaaggtaaaattgttggcagcgcacaagacatgtctgtttctgagaggtgcagattaaccaccccacaaataacgtttagaattttagattccttaagcggaagattttacatctttttgcatggatcaaacatagtgccctggttattaagtcattgtcaaaactttaaagtgaacattttattgaaaacatgttgagtccagggttcagacttggtgtattatagtggacttgaggtgaccgttattctcctgggtatgggaactggattatccctgttatctttatgcttaagtttaatttcagggatgttaaatctgaatagctgaaaattatgaatttgatgatcttgaaatgtaattttaataggtatcagaaggggaaggtaaagaacaatgtatatagtattgtcatttatgtaaaagggaatatgtgttgtatttatataacaaagagtatgtacatatatgtacatttacatgcaaacataaatagggtttctttgggaaaggaaactggtttacagtggttatctctagggaagggcgcaaggggtcagtagaggtaattttcagactgcttaattttaacatgaacagttttgtttttgttcttgtttttgtttttgtttgagacagagtctcattatgttggccaggctggtctcgaactcctgcgcttaagcgatcctcccgccttctcctcccaaattgctgggattacacgcgcgagccaccacacgtggccatgaacagtttttaaatctttataagttaaagcaaataggccaggtgggtggctcatgcctgtaaatcccagcactttgggaggtggaggtggggagatcgcttgagctcaggagtttgagcttagcctaagcaacatagccaaaccccgtctctacaaaaattaaccagggcatggtggtgcatacctgtggtcctagctaccggacaggctgagatgggaggattgcttgagcccaggaggtaaaggctctagtgagccaagttccactgcactccagcctaggtaacaaagagatatcttgtctttaaaaaaagaaaaaggtaaataaattattgtaattgattcgaggtggctaatttttttttttttttttttgagatggagtctctgtcgccaggctggagtgctgtggcgcgatcttggctcactgcatcctacaactacctggttcaagggattctcctgcctcagcctcctgagtagctgggattacaggcacgcgccaccacgcccggctaatttttgtattttaatagagatgtagtttcactatgttggccaggattgtctcaatctcctgaccttgtgatctgcccgcctcggcctcccaaagtgcggtgattacaggcatgagccactgcgcccagcacgagatggctaattttattctcagcagttccccggtagcagcaggcagtttgaattggcgtcagaatctgctgagccccacccctggagaatcaatacactgggtaatattctgacattcagttagctttggaaaatttttattagatcgtagtacatgctaatttacatatggccaggcatggtggctcacgcctgtaatcccagcactttaggaggccgaggctggcagatcacctgaggttaggagtttgagaccagcctggccaatatggtgaaacccggtctctactgaaaatacaaaaattagctgggtatggtggtgggcacctgtaattccagctactgaggagactgaggcaggagaatcgcttgaacctgggaggtggaggttgcagtgagccaagattgtgccactgcactccagcctgggcgacaagagtgaaactctgtctcaaaaaaaaaattttacatatgattgctaattaggaaatttttcatttcagtcgtcaagaacttttaagggcagaggccaggtgagactctgtctcaaaaataaaaggaaaggcagaaggtggaccgcagtgtgataagtagtatttcacaaacagtatttttctgtggcttgtcttacaggtacaccaggggttggaaaaaccacactaggcaaagaacttgcgtcaaaatcaggactgaaatacattaatgtgggtgatttagctcgagaaggtaagggacactttggtgttagatttgttttgttttttttttaaggtctggtaagtggagtgttagtgctgggtattgtcatagggtacaaaaaacagagattgccattaaagaatatatactctgttagggaatccacagaaatattaagtgtctaatgctatgtcctggttattttgaccattttcccttccgccttcaaaatggctggcaattcttgtgaatagttgggaaggctcctataaagagactggatttcggataggtagaatgtgaataaggagaatgtttttaagttgaacaaacaaaggtttggtactgctaaacatatatatgagcacagtgagtatattggtctcactggaaagagactgttttgagctcaggtgtgggacctgactatgctatggtatcttagattagtgtgagatttgcatgcaactgcatatattctaagatgatcattgtttttatttattttaccctgttttcccctaatctttcatcgctcccttatttgtgtcttcatctttttatagtcgacaatgatttgtacatggtaggaactcaataaattaaagcgaccttaagttgcctcattaaaattaagaaaacatatggtttaaattttaaaaatttttttacagtttaacatagatttaaaatttttttaagttcctgacagttgctactaaagtaactatttcagattgatctaatgtacatatttttttcaaatgatctaaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgattgttggtgctttggcagttatgtttttaaaagcaattttctccttgttgtcaccaagaggagtaacagttggcagttgcagcaatttgcagtactgcagtctatttttgaccactagagtgtcaccttaaacgtcttcagatacatagatcatagtatgatctctggtgtgtacgtcactcttgtgatctgttctctcagattgctgaagtataaccatgactcccctttggagagaccagttggtcaggatttttattcatagtgaattcttaacctgctttgattatcttcctcaattgcccaacttcctaggtcccatttttctgtccttttggttatattaaggacccttagtgtctcccagtatgtctccactttttaaaaaaaaatttataagtgtctctttttgcaggttaattttgagcatctttgtttttcatattcctgatactataagccagtatcatgttcatttttgatccagggctgataattaggttatagtgtttatatatatatatattttttttaatttaaaatatttttttgtccaaaagaacgtcaatttatcaaggttatagtttctaaaacctagatttttatttgctatcatacaactactcattttccatttcattttattttatttcctgagacagaatttcattttgttgcccaggctgcagtgcagtggcacaatctcagctcactgcaacctctatgtcccaggttccagctatctttgcacctcagcctcccaagtagctggaattacaggtgtgcaccaccacacctggctaatttttatatttttagtagagatgggcttttgccatgttgtccaggctggtcttgaactcctggcctcaagtgatctgcccacctcggcctcccagagtgctgggattacaggtgtgagctacctcacctggcctttccttttttttttttcttttgagacggagtctccctctgtcgcccagactggagtgcagtggtgtaatctcggctcactgcaagctctgcctcccaggttcacgccattgtcctgcctcagcctcccaagtagctgggactacaggcacctgccaccacgcccagctaattttctgtatttttagtagagacggggtttcaccgtgttaaccaggttggtctcgatctcctgacctcgtgatccacccaccttggcctccctgagtgctgggattacaggcgtgggccaccgcgcccagcccggcctttctgttttatatctatatgaaatgtggttttgttcctcactgttgaacaccaccatttttgacaagtgatttctgagtcacataatagtcaatttcattcatgcattccaatgttactttcactcaatttaacatttctaaactaattagagcattaatagcattgagagcaatggtgacaccagaccaaggacaatccagtataaggcacttgtcttcctcttctttgggtcctctcctaccagtacttaaaccatttcatttggttgagacagagtcttgctctgttgcccaggctggagtgtggtggcctgatcatagctcattgcatccttgaactcctgggctaaagtgatcatcctgcctcagcctcccttgtagctgggactacaggcacacaccatcctgccgggctaacttaaaattatttttgcagagacagggtctggctttgttccccaggctggtttactcctgggctcaaatgatccttctgccttagcctcccaaagtgctgggattgcagacgagagccactgtacctcaagtactcaacaccattttagtcagttgtgtatagtcccacccatcctctttgttattagtgagattatttcatgaaatgggatctaagtcttaaaggaaaagtattttttccccctcctgtaatgccagataaaagatttctggtctgacttgacatggagtttgatggaggtactttgtggggtttttttgtttgtttgtttgagacagggtcttgctctgtggcccaggctggagtgcagtggcacagtttcccctcactgcaaccccagcctcccgggctcaagtgatctcctgcttcaacctccccagtagctgggactacagacacaaggcctcactgtgttgcccagggtggtctccaattccccaggctcaagtgatcctcccaccttgacctctcaaaagtgctgggattaccggtgttagccattgtgcccagcctgatgaggtactttgtaaggtttgacataccagattttttaacccagatcctgtttgaatatatctggaaatattctggggcaactaacctcatttttatttcaagtggggatatatttttaagggaaaccaggcaatcatctataatgaagtgattctcaactaggtgatttttgccctttgggggtatagcaatgtgtgaagacattttgggttgtcacatggagggggaggtgatggccagggattctactaaagatcctgtagttcacaggacagtcccctgtctcccttagtaacaattaccagactcaaaatgtcattagtaataaggttgagaaatcttgctgtaaagaaataaggcttattccgatgctcactaaagtcggaaaaaaagaaagcttttaagaaaaccctattttaaacttatttctaaaagtttagtatcatcctggtgatcatgtggaattgcagtagtagttgagagaggtcatcttcactcccaaaaccaaggcaaaaaaaaaaaaaaaaaaaaagggaatcaagtttaagaaaactggccgggggtggtggctcatgcctgtaaattccagcactttggcccagcatggtggctcatgcctgtaatcctagcacttttgggaggccgaggcgggtggatcacctaaggtcaggagttcaagaccagcctgtccaacatggtgaaaccccatctctactaaaaatacaaaaaagtagccaggtatggtggtgggccccagtaatcccagctactcgggaggctgagacaggagaatcacttgaacccgttaggcggaggctgcggtgacccgagatcacaccactgcactccagcctgggcaagacagagcaagactcagtctcaaaaaaaaaaaaaaatcagtccggcgttgctgagggtgcctgtaatcccagctactcaggaggctgaggcaggagaatcacttgaacctgggaggtggaggttgcagtgaaccgagatcatgccactgtactccagtctgggtgacagagagagattccgtctcaaaaaaaaaagaaaactattaaagagtcttactgtgggccgggcgcggtggctcacgcctgtaatcccagcactgtggggagccgaggtgggcagatcacgaggtcaggagattgagaccatcctggctaacacggtgaaaccccgtctctactaaaaatacaaaaaattagccgggcgtggtggcagatgcctgtggtcccagctacttgggaggcagagcttgcagcgagccaagatcgcgccactgcactctagcctgggcgacagagtgagactccatctcaaaaaaaaagagtcttactgtggtatgactgtaagagtgcttctcttattgctattcttccagtctcaagactcctcctcacttgataccctttcctatatacaatcatttttatactcttactagcatccttaattttcctggcagcagtttttcggtcttcggcctctgttcctaactgcagaatacccataggtctagacgaagtaatatattgacattggatccatttccagtagaaattgtaaagcatagcttggcttgaacacttagaatcttgatatatctctaacctaggggttggcaagctactgttgtttttgtatgacttctgagctaaagactagcttgcaaagcgtaaggtattacctggccctttacagaaagaaaaaatgctgatccctgttctatccttttctgaatcccatttttctctccccttatcaactcccactggaagccttggaaactaactcctctattgacctctctgacactgctctctccctatctttgcctctggtctttccccttccacctgtttcccccatgatttcattgcagccatattgtaattctgcccctcccactagtaatctcactcattcaggactattcactcccttgtgctgatgacttaaatttataattaaaacaacccaatttctagacacctattagacaaccatctggatagttcccagatgtttacagctctaaattagtatgtttaaagcacgtgctctgaaagcatccttgactatacttgcccactcctctgatttctacctcccaagcatataaatacacattcactctctccacacagatccacttggcctttaaatcttgacggtttctcctacacatccctacagtacccctatttcatcaagacccctggtgctgtgcctagaatcctacctagaatctcctgtttgacttcttcagtatctctttcttccctcttctacactatcattttcttaaaagtggggaaggagaatgacatgatttgaactttttactcacatagtccattctccttcaggaaatataggagattctttataaaatggccacagtttacctgcagccgttctctcccctatgtccccttcagtgcagccatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaatatgaaaataaaaattttaagtattggcagcagtgtcaaaacaaccagcatcccaatatgattaaagaacagctttcacttgagtgtatataagttctaggatggcagttaaacataatgtcatgattttacagtttgacaaacagcagcagctgggaaggttttttaaggtaagaatgagctttaaaaaattttgtggggcctggcgcagtggctcacacctgtaaacccagcactttgggaggccagggcgggtggatcacctgaggtcaaaagttcaagaccagcctggccaacatggtgaaaccccatctctactaaaaatacaaaaattagccaggcatggtggcgggcacccgtaatcccagctacttgggaggctgaggcgggagaattgcttgaacccaggagacggaggttgcagtgagccaggatcatgccattgcactccagcgtgggtgacgagagtgaaactctgtctcaaaatttaaaaaaaaaaaatttttttttttttgagacaaggtatcactgtcaccctaactggaatacagtggtgcaatcctggctcactccagcctcaagcagtcctcccacctcaacctccagagtagctgggactataggctggcaccgccatgctgggctaatttttttttttttcttttggtagtggtggggtgttgctatgttatccagggtgatcccgaactcccaggctcaagagatcctcccacctcggcctctgaaagtgctaggattataagcgcgaaccaccatgctcacccttttaactctggccccacaattgattttttttctgcaagcaatatatctgtacctggaatttaaaaaaataaactgcaaaactttgtttagaaagttgatttaattttctaatctctcagtccttaaacaaatcaacctttttgatctttgcttaagatcctatgtataggcaagtataaatttggcttccaattgaaactttctaaagtagcataaaatttattctttttttgaaatttgaaatgaagtttaggatccgttcatttctctggtacaggctacaatcatcacttacctaaaaatctgcagtagacttgatagcctctgggactccgtctcaaaaaaaataaagacttcaatcctaaaagttaacacatctattttagacagcatatattggttcaagtcatctttctttttttttttttttttttttttttgagacagagtcttgctctgtcacccaggctggagtgcagtggcgcgatctcagctcactgcagcctcctcccgggttcaagcgattctcctgcctcaacctcccaagcagctgggattacaggcacccgccaccacgcctggctaacttttgtatttttggtagagatggggtttcaccatgttggccaggctggtctcaactcctgaccacaggtgatcaaccacctcggccttccagtgtgctggaattacaggcatgagccaccgcaccggccagagtcatcttttaaaagtcaaagatttaaagtatgaaggaacctccgtgtttatctattcaagattaccacatagtacagaatcagctataggtattcttagattttgtggtactgttaaaaaaatatgcaatactgtaaaaatagtatatggaaaaatactccaaagcttttgtttttcttctaatctttgtccctagtaaggacaactttgaattctgctttttgtgttttacacttgtatatgtgagcatttatcatgttgctgcctagtctatactacatagtatttttaaactatgttaactataatactataactctaatacttattaattttaattacataatttttacaaaattaattacataatattttataaagttataaagttggtaaatcaagatttaacttttcttattgttcaacattttttattattttctaattttgtccaattagaaattaaatggtagtgtaaatatctaaatggattgaacatataacaggcataaatatagactcattttaatttgcatctctttaatagctaggaaaattcagtattttttcatgtgtgtttactgattttttccactcttccatcttgtgtgaattcttttcttgtttattgagcaattgttattttggttttaaggtctttatattatctacatttcagtcctttgttatttctcccattctgttacttttcttagaatttgattatttctcaaggaacagagagtcaacattttaaataactggatcagtctttttatttcttctgctactcaacaaactcaaatgaatcattcctttatagctccatctggggtttgtggtataaagtaaggatttagattgttttctaaattgttaaccagttttcttcataccaagacagtttaattttttaggttggtagagttcctggtaggtgagcaatagcccaaggaggcagaggccacactagagtgctagaaaggtggtttatgtgcctagaatcagtccacagaccctccaggcaagacaaggagttacaactgcttttgtgccctccagtgtccatcagactgcccccgcagtgaccatcagactactcctgtgtcccttcagaatttatgttcattttaacctcatttcaacccgtaccaaaatattaaggggaaagaggtgggaagactgctatataacatgctctcagagatggttaatggatgatctgagcttgccttagattaatacctcctaagggctggggctaagggtaagatggtatgtcttacctcctgaaagaatacttcttttgaaaaccagctgtgatttgttggaaagttcttatgttaaatttaaatttgcctcctttgtaactttgaacgttatttttgttttgccttctgaaatgagactatttaactcttatgaggaacggcagtttggaatactggaaatctagaagtaaagatactgttcaggagcatttggatcctgacccttctctattcccatgaggatgtgagctcagtgacagagggttcatttctggaataaagaatctgttattgcttttttctttctttctttttggagacagggtcctgctctgtcgcccagcctggagtacggtggtgtgatctcaccttattgtaacctccacctcccaggctcaagcaatccttctgcctcagcctcccaagtaactgggactacaggtgtgcaccaccatgcctgcctaatttttttttttttttctgtagaaacaggttctcaacatattgcccaggctgtcttgaactcctgggctcaagagatcctcctacctcgtatgggctgggattacaagcgcaaagccaccatgcctggcctgttactgcttttgataaattaatctgcttttaaatgtatgtgagtgtgtttgtatctgttcaggtgtttcctcttcccgccaatctgtagttcaacaaaaatagtgtagtcctcttctagtagccccacaaattctgaagttggttattcactctttttagttggtttcagttttgatatttaaagcagtttcagatatattgcaatccaagtttccctctaaacaaaattccaatttatcagttagtatggctcctttatatttggtgtttatgtaacatttattttgttagtatccacccttgtatctaaaagaataattgatgatacatttcctttcctgaagtctagaattaattgaaaattacttaaagttacttagaaaatatttcaacaagcaattctaaatctcttttagagcaattgtatgatggctatgatgaagagtatgactgtcccattttagatgaagacagagtaagtatgactttttcataaagtatgcatttgttgaatttcataggaaagttgacttcagttttcttaagaagcatttttttttaaacttttcttacaggtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggtaagaaaggaaaaacattagattcttaaagcataatgttaacttttattcagatttctgaaattggccatgataaaagattgttgttgtttgttttgttttgttttgttttgtttttttgagatagagtctcgctgtcacccaggctggagggcagtggtgtgatctcggtccactgcaacctccacctccctggttcaagcaattcttgtgcctcagcctcctgactaacagaccacgggcacatgccaccttgcctggctaatttttttattttttgtagagatggggtctcccatgttgcccagactggtctcgaactcttgggctccagcaatctgcccacctcagcctcccaaagtgctgaggctacaggtgtgagtcatagcacccagctaataaagggttttatttgaaaatatgactactttaaaatatgggcagtactttttgagtaaattaatatctcaactgacaatctgattgagtaaaatgtactgtgtagaaacccaatttagtcggccgggcacagtggctcacgcttgtaatcccagcactttgggagaccaaggtgggaggatcacaaggtcaggacatcgagaccatgctggctaacatggtgaaatcctgtcactactaaaaatgcaaaaaaaattagccgggcatggtggcaggcacctgtacagtcccagctactctggaggctgaggcaggagaacgacgtgaacctgggaggtggagcttgcagtgagctgagatcacaccactgcactccagcctgggcaacagagtgagactccgtctcaaacaaaaaaaagaaaccctatttagccatgctttttctttgatgtaaacccttgctaggaaaacagccaagcccctaacatattctttgcttattgactgaacactactcactcaaattatccctgcatcaggagtgggaaagcttatgaaaaactaacaaaataaaccagcatttcacagtctttaatagataccgagttaaacccacaaatagagcatcagatttaatgcggaagaaccagtaaagagaaacttttagggaagtcttttatccccactgtcttttgatcaaagctgtgggaatatggggattctagagaaattagagagcaatctcagaaaggaaagctccagaattttgcttaaggtcggggtcagaatgtgtggttttcactgattatagtcaactctgactaaccactattatttgcaatacttgtaaatccttgcacagaatagtatggcagcaaatatacatatagaaaaagttaaattggggctaaacctaaaacttttatcttttttaggcagtgaaaagccattaaaagttttggggcagagaagtaatagagactatatggtacatatgctttttttcaatcaagacaatttaaaattttgattaaaaaattactgttttacatatatagccaagggtaagactaaggtatgaaaaaactatgagagagctagttagtatttttaactatcgaaaaggttgtaaaaaagtaacagctttaggctgggcatggttgggtggtgagggggaggcaggacggctcacacctcacacctgtaatcccagcaatttgggaggctgaggcaaggtgattgcttgagcctaggagtttgagaccagcctgggcaacatagcaagaccttggtctctacaaaaaataaaaaatttagccaagtgtggtggcatgcacctgtggtcccagctactttggaggctgaggtgggaggaatgcttgagcctgggaggttgaggctgcagtgagctgtgattgcaccactgcactccagcctggttgacaaagcaagaccctgtctcaaaagcaaccaaaaaacaaaaatatccactttattgagatttagtttacattcacccacttaaagtacataattcaggtttttttctagttttatgggtacatagtaggtgtatatatcagttgctcatttgtttttttgtatatcaaaaagttgtacaatcattaccacaaacaattttagaaaattttgggggtgggcgcggtggctcacgcctgtaattccagcactttgggaggccaaggtggctgaatcatgaggtcaggagttcgagaccagcctgaccaacatggtgaaaccccgtctctactaggaatacaaagattagctgggcgtggtggcttgcacctgtaatcccagctactcaggaggctgaggcaggagaattgcttgaacccggaaggtggaggttgcagtgagccgagatcacaccactgcactccagcctgggtgacagagcaagactccgtctcaaaaaaagaaaatttttgtcaccccagaaaggaaccccatacccagtagtagtcactccccatttaccctcagttccccagccctaggcaaccaataatctactctctgtctttatggatttgtctatactagatatttcatatgaatgaaatcatacaggatgtggacttttatgcctgtctcctgtcaaattagtttgttttcaaggttcattcatattgtatcatagaccagtacttcatttctttttattgccaaataatattccattgtatggatgtatcatttttaaaatacatttatcaggttgtggacatttgggttgtttcactttttggctgttatgaatattgtatccataaacattcttgcacatgtttttgtgtggacatcatgtgtttatttctcttgtttatatatctaggaattgaattgctgggtaatatggaaactttgtatttgacccttccaataactgccagattgttttccatagtggctgcatcatctcatattcacactgtgtatgagggttctaatttgtccacatcctcaccaacagctgttattgttcatattttggttgtagtcatcctgctggatgtgaagtaatatctcattgtaattttgatttgcatttcctatacagctagagatgctgaacatcttttcatgtccttattagacagttgtgtatcttccttggagaaatatttactcagattctttgcttaagttttaattgggttacaaatctttttattactaagttatgagattttgctaatttactaattcattgggaatttattgagtagctgacaaattgtgggggggggaaattcaaacaaacctagatgctggtttggtgatctttagtttcaccctagtgtcaagaaactgtgtcatataaacaggtaccagtcactcctctctaggtgaagagaccatttctgtaatttttcacgtattgaaaagtgtccagtttctggtatgtttctgaaactccagttaatgccatttattttgcttcttgtttgcttaacctccctgccttctaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcatacaataaaatttaccattttgaagtgtataatcagaaccgggtatggtggcttatgcctgtaatcccagcaaatggggaggctgaggtggagaatcgcttgaggcaggagttcaagaccagcctgggcaacatagtgagaccttagactctaaaaataaacataaataaaatttataatccgttggtttttagcttattaacaaggttatgtaactgtcaccactgtggaggaagcagtgatgataaagggaactcctataccctttagcagtcactctctattctttcctcctcatccccttgcagtcactagtctactttctgtctctatggatttgcatattctggatatttcatataaatgggattatacagtatgtggccttttgtgtccagtttctttcacttagcataatgttttcaaggttcatctaagttatagcatgtaccaatatctcattcctttttatggttgaataatattccattatatggatttaccacattttgcttatgtttccatcacttgcacaattgggttgtatccactttgggtattgtgaagttgaatacataatagtagcatactatgagcattcatgtacaagattccatgtggatgtatgttttcagttttcttaggcatatacctgggaggggaattgctgggtcatagggcaaccatgtttaactttttgaggaaatgccaaactggtttccaaagtggttgcagcattttatgttcccaccatcaatgtattagggactcagtttcttcacattcttgctaacacttgttacggtctatatttgttgatttttaccatttcagcgatttttattaggctaagtgtgtgtgtatgttctgtaacttacttcacttgcaggcatgacagggtgaggtctgtctctctacatgggccactcccggggtctggtcacaatataccaccacagggggcaaagcttcagtcctagaccaccagttgggatttcctcctgcagctgcttaacctctcactcctggctttgcctcagcagtttcttccactgctctctcttggctaagtaatcagggtacattgccttctcagaaggattccagtcatctaagcaccactccagagacttgtagcatatcactcgtatctctcataggaagtacccccagagagtcagggaagagaatggctgtgaatgctgacgataccagaattcctctgcctccctcagcagtggggtagcctccatcataccctttttttttttcctatgctcttcaaaccaggctctcatcaaacaggcaaaatataccattatttatctctggatgcaccatggcttgaggtggtacagcgcctggttacaaagcagcaacaccttctggtgataggtcaagtaggccctccagcatcgagaacaccatgactgcttgatcccatctttttttttttttgagacggagtcttgctctgtcgcccaggctggagtgcagtggtgcaatctcggctcactgcaagctccacctcccgagttcacgccattctcctgtctcagtctcccaagtagctgggactacaggcgcctgccaccacgcccggctaatttttgtatttttagtagagacggggtttcaccatgtcaggcaggatggtctcgatctcctgacctcgtgatctgcccaccttggcctcccagagtgctgggattagaggcgtgagccaccgcgcctggcctttttttttttttttttttttttttttttgaggcagtctcactcttgttgcccaggctggagtgcaatggcgtgatctcagctcactgcaggttcaagggttcaacctccacctcccaggttcaagcgattctcttgcctcaatctcccaagtagctgggattacaggcatgcaccaccatacccggctgattttgtatttttagtaaagacagagtttctccctcgaactcccaacctcaggtaatctgcccgcctcagcctcccaaagtgctgggattgcaggcgtgagccaccttgcctggcaactcccatcttttttattataactatactagtgggtgagtagtatatcacattttggttttgatttacatttctctaatgatttatgatgagcatcttttcatgtgcctattggtttatcttctttggatccctcatctttttaatgtttgcataaaatggcattaatgaggctaggcccagtggctcatgcctgtaatcccaacactttgggaggccgaggtgggtggatcacctgaggtcaggagtttgagaccagcctaaccaacatggtgaatccttgtttctactaaaatacaaaaattagccgggcgtggtggtgggtgcctgtaatctcagctacttgagaggctgaggcaggagaatcgcttgaaccgaggaggtggaggttgcaatgagccgagattgcaccattgcactccatcctgggcaataagagtgaaactcccatctcaaaaaaaaaaaaaaaaaaaaaaagccattaatgatatgccaagtacccaggcactgtggctcacacttgtaatcctaggactttgggaggccaaggcgggcggatgacttaagcccaggagtttgagaccaacctggccgacatggtgaaacactgttcctaaaaataaataaataaattaattaattaagtaaataggccaggccgggcgcggaggctcacgcctgtaatcccagcactttgggaggtcgaggcaggcagatcacgaagtcaggagattgagaccatcctggctaacacggtgaaaccccgtctctactaaaaatacaaaaaattagccaggcgtgatggcaggcacctgtagtcccagctactcgggaggctgaggcaggagaatggcatgaacccgggaggcagagcttgcagtgagccgagatagtgcctctgcactccaggctgggccacactctgtcgcaaaaaaaaaaaaaataggtcaggcatggtggctcactcctgtaatctcagcactttgggaggcctaggtgggaggatcacttgagctcagaagttcgagaccagcctgggcaacatagtgagacctcgtctctatttaaaaaaaagaaaaaagaggctgggcatagtggctcatgcctgtaatcccagcactttaggaggccaaggcaggtggatcacttgagattaggagttcgagaccagcctggccaacatggtgaaatctcgtctctaccaaaaatacaaaaactagccaggcatggtggtgcatgcctgtaatcccagctactccggaggccgaggcaggagaatcgctttaactcaggcagcggaggttggagtgagctcagattgtgccactgcattccagcctgggcaacagagtgagacactgtctccaaaaaaatgaataaataaataaaaataaaataatagcccagagtggtggcatgcacctatagtcccagctactcaggaggctgacgcaggaggatcacctgagcctgaggaggtcgaggctgcagtgagctgtgattgagccactgcactccatcctgggcggacagagtgagaacttgtctcaaaaaaaaagacatgccaagtttgatttaatcagtcctctcactaatggacatttaggctgtttccagctttttactattacaatgatgcaagaataataaagagtaaatatattactatgacataaacttctaaacacatttcaaaagtgaattctttatccacatgaccactctctgaggtagatgttattattatttccattacaggaaccaaggcacagaagagttaagtggcttatccaagataatagctaaaaagtattagcttcagtgttctatcttaggcaggctttcactcactaagttgtgttccctaatgcatatgcgttatgcatatgagcaagtttatctgttgagtaaattcccaaagacaaattgtacgcaagcttaacatttagtagactaattttttttcttttttttttttgagacaggctcttgccatgtcacccaggctggaatgctgtggcaccatcatagctcactgcagcctcgacctcctgggctcaagtgatcctctgacttcagcctcccaagtagctagtgaaaccctgcctgtacaaaagatacaaaaattaggccagtggttcatgccactgcactacaacgtgggcaacagatgaggctgcatcacaaaaaaaagaaaagaaaagaaaaaagaaaaaccaacaaaattagctgagtgtggtggcatgtgcctgtaatcccagctactcaggagactgaagcgggagaagcgcttacacccaggaactcgaggttgcagtgagctgagatcgcaccactacactccagcctgggtgacagagtgagacaccatcttaaaattttcaaaaaggccaggcacggtggctcccgcctgtaatcccagcactttgggaggccaaggctggtgcctgaggtcaggagtttgagaccagcctggccaacatggtgaaaccctgtctgtactaaaaatgcaaaaattaactgggcgtggtgctgggtgcctataatcccagctactcaggaggctgaggtaggaaaattgcttgaacctgggagacggaggttgcagtgagccaagatcacgccactgcactccagcctgagcgacggagcaagactccgtctcaaaaaaaaaaaggcctggccaaaatggtgaaacctcctctctactaaaaatacaaaaattagccgggcatggtggcacacatctgtaatcccagctattccagaggctgaggcatgagaattgctttaacccaggaagtggaggttgcagtgagctgaggttgcagtgagctgagattgcacaactgcactccagcctgggcaacacagacagaccctgtctaaaaaaaaaaaaaaaaaaaaaaaagcaaagaaatctgcacatatgggcacatttttaaaaatgttttctttttaaagtttttcccccgcgccccccacctgaagctgacagtagttgatgggccatttttttattttgagacagggtcttgctctgtcacccatgttggaatgccatggcatgctctttgctcactgcagcctcaatctccccaggctcaggtgatcctcccacctcagcctccaagtagctggaactacagatgctcgccagtacacctggctaattttttaactttgtgtagaaacaaggtttcaccacgttgcccagcctggtcgggaactcctgggctcaatgaatcctcctgcctcagtctcccaaagtgttagcgttactggcgacagccaccgagctctgtggcaatttttgatggaagtccaaaggcaagtcaatgggggaaagaataatctttcaacaagtgaaaaaatttagtgtcttggattagaaaaaagatttttctgataagacacaaaaagcacaaaccataaagggactgatacatgggacttcagcaaaattcataactctttctctcttcaaaagacaatgttaagaaaatgaaagcacaaagagccagggcagcagtgctcaccctagtccaaactactcccagctactagggaggctgaggtaggaggatcacttgagccctggagttgaaggttgtagtgaggtatgactgtgcctgcaaatagctactgcatgccagcctgggcaacatagaaagactccatctctacaaattttaaaaaagagaaagaagatgaaagcacaaatcacagattggagaaaatgcaaaatgaatatctgatatcaggtgtgtatctagaatatgtacagaattatcaaaataataaaacaacttgatttaaaaaaatcaacaaaatcggcaaaccttaatctagattaacaaaaaagagaagggaggggatatcactactgactacggaaatcaaatggattataaaggaaaactataaacaactgtatgccaacaaattagataatttatattaaatggacaaattcctagaaattcacaaacttctgaaactgattcaagaagaaatataaattatgaataggcctataacaagaaaatataataaattagtaattttaaaacttcctacacagaaaggtccaggcacagatggcttcactggtgatttttttaaattaattaattaatttatttattattattattttttagatggagcttcactcttgttgcccaggctggagtgcaatggtgacatcttggctcagtgcaacctccgcgtcccggattcaagcaattctccttcttcagcctcccgagtagctgggattacaggcgcccaccaccacacacagctaattttttgtatttttagtagagacggggttttaccttattggccagacttatcttgaactcccagcctcaggtgatccacccaccttggcctcccaaagtgctgggattacaggtgtaagccaccacacctggcgattttttttattgtttataaagaaaagaggtttaattggctcatggttccacaggctatataggaagcatggctggggaggcctgagggaacttataatcatggtagaaggccaaggagaagcaggcacgtcttacatggctagagcaggaagaagagagagccactggtgaattttattaaatgtttaaaaaagagccaataccaattattttaaaatttctcccaacaaatagaagataagggaataattcccaacatatattaaaaagtttacattcaggatgaattgctgttggcccagcacagtgcctcatgcctgtaatcccagcacttcgggaggccaagacaggcagatcacctgaggtcaggagtttgagaccagcctggccaacatggtgaaaccccatctctactaaaaatacaaaaatcagccagggatggtggcaggcgcctgtaatctcagctactccggaggctgaggcaggagaattgcttgaacccgagaggtggaggttgcagtaaactgagattgtgccactgcattctagcctgggcaacagagcaagactccatctcaaaaaaaaaaaaaaaaaaagatgaattctgttaagttgaaaaataaacaaataaataaggctgggcatggtggctcatgcctgtaatcccagcactttgggaggctgagacaggcaggtcacctgaggtcaggagttcgagaccagcctggccaacgtggcaaaatcccatctctactaaaaatacaaaaattatctgggtgtggtggtgggagcctgtaatcccagctacttgggaggctgatccaggagaatcgcttgaatccacgaggtggaggttgcagtgagctgagattgccccactgcactccaaccgggtgacagaatgagactgtgtctcaaaaaaaaagacccggccgggtgcagtggctcatgactttaatcccagcactttgggaggctgaggtgggtggatcacgaggttaggagttcgagaccagcctgaccaacatggtgaaaccccgtctctactaaaaatataaaaattagctgggcctggtggtgcatgcctgtaatcccagctactcaggaggctgaggcaggagtattgcttgaacctgagaggtggaggttgcagtgagccgagattgcgccactacactccagcctgggcaatacagtgagactccgtctcaaaagaaaagaaaaaaagaaaaagaaaagaaattagctgagcatggtggtgcatgcctgtaatcccacctactcaggaggctgaagcaggagaattgcttgaatccaggaggcagagattgcattgagccaagatcgcaccactgcactccagtgtaggcaaaagagcaggactccatctcacacacaaaaaagaaagctatcccatcttcatgcatcagaaaacttaacattgctaaaatggcaatacttgccaattgatgtacagtattagcacaatccatatcataattcccagctggcttccttgtagaaactgacaagctaatcctaaaatacatacggaaattcaagggactcagaactgccaaaacaaagttgcaggactcacatttcttgattttcaaacttactactaatgccacattaagacagggtagtactggcataagaatagacatatagattaatggaataggattgagagaccaaaaataagcccttatatttataaccaattaattttcataagcttgccaagacaactgaacatagaaagaacaatcttttttgtttgttgtgttttgtttttgttttttgtttttttgtgtgtttgtctttttctttttttaattatactttaagttttgggatacatgtgcagaacgtgcaggtttgttacataggtatacatgtgccatggtggtttgctgcacccatcaacccatcatctacattaggtatttctcctaatgctatgaaagaacaatcttttaaacaaatagtgctgaaacaactggataactacacacaaaagaataaagatgacgccaggcgcagtggctcacgcctgtaatcccaggactttgggaggctgaggcgggcggatcacctgaggtcgggagttcaagaccaacctgaccaacatggagaaaccccatttctactaaaaatacaaaattagccaagcgtggtgacacatgcctgtaattccagctactcaggaggctgaggcaggagaatcgcttgaacacaggaggtggaggttgcagcgagccatgagtatgccactgcactccagcctgggcaaccagagcaaaactccatctcaaaaaaaaaaaagaaagaaaaaggaataaagataaatcctttcctcacacatacacaaaaagtaactctaaagctctaaaggatcacagatctaaatgtaacagctaaaacaatacattcttagaagaacatataggagtaaaccttcatcagcctttgtgaggcaaagccttcttaggtatgacaccaaaagcataagcaactaaagaaaaaaatagataaatcagacttcaccaaaatttaaaaacttttgtggttcaatagacacccttaagactgtgaaaagacaacctacacaatggtagaaaatatttgtaaattatatctgattagagtctagaactctaatcagataacaaattatatctgattaagtaagaactcttataacttaatcataaaaagataaataaccctgttgaaaaatggacaatgaaatttaatggacatttcttcaaagaagatatgcaaattgccaataagcacataaaagatgctcaacatcattagtcattaggaaaaatgcaaattaaaaccatcatgagagattgtttcacacccactagaatgactaaaagcaaaaagacaaacaataacaggtgttggtgaggatgtggataaattggaacccttacacataactagtgttaatataaaatggtgtagccactttgaaaaaccacttggcatttcctcaaaatgttaaatatagagtactatatggcccagcaatttcactcctagttctatacccatgagaaatgaaaacatacacccatacaaaaacttgtccatgactgtttatagcattattcataattgcccagaattggaaacaatccaaatgttcatcaactgatgaatggtgtaattcttttttttgagttggagactcactctgtcacccaggctggagtgcagtggcacggtcttgtctcactgcaacctccacctcccgggttcaagcgattcttccacctcagtctcctgagtagctgggattacaggcactcgtccacacccagctaatttttgtatttttagtagacatggggtttcaccatgttggccaggctggtctcaaactcccgacctcaggtgacccgtccacctcagcctcccaaagtgctgggattacaggcgtaagccaccacgcccggcctgaatggtataagataattgtggtatgtccataaaactaaatattatttggccataaaaagaatgcagtactggctgggtgtggtggctcacacctgtaatcccagcactttgggaggccggggtgggcagatcacctgaggtcgggagttcgagaccagcctgaccaacatggagaaaccccatctctactaaaaacacaaaattagccagacgtggtggcacatgcctgtaatcccagctactcgggaggctgaggcaggagaattgcttgaacccaagaggcagaggttgcagtgagccgagattgtgccgttgcactccagcctgggcaacaagactgaaaatccatctcaaaaaaaattaaaataaaatttatttttaaaaaacatgtgctcaggtaacaaaaaaagacaaaaaatacatgtacaatgctgctaaactattgcttaacaaatatatgccgaaagtctttaaaagctatatgtacaatttgagtacgtctcaagtagctgggattacaggcacctaccaccatgcctggctaattttgtgtttttagtagagacagggtttccccatgttggtcaggctggtcttgaactcctgacctcaggtgatctgtccgtctcagcctcccaaagtgctgggattacatgtgtgagccaccgtgcccggtccaaaaataaattttatatccatgcctccacagttctaaattttggaaaagttttgacaaagaaatcagggttatcttagaggttatcttaaagtttttttaagggggacaggtgggagtaagccttgaaatatttttagagtgaagactgttgttttaaatacatgtcagagttttaagtgaagaaaaattatttttggtttgcaaaagctatttgatgtgcctactctaccataatagatactaggcaaactgactttaaaattataaatgtattaatctttttttttttttttgagacggagtctagctctgtcacccaggctggagtgcagtggtgtgatctcggctcactgaaacctccacctcctgggttcaagcgattcttttgcctcagcctcctgagtagctgggattacaggcacctgccaccacgcctggctaatttttgtatttttagtagagacggcgtttcactgtgttggctaggctggtcttgaactcctgactttgtgatccacctgcctcggcctcctaaagtgctggattacaagcgtgagccacttcacccagcctatgtattaatcttttaaaataatcttaaatccttgagcatctaatgtgcacatagcattgaccttatttataatcaggagaaattttagagcctcaattttaagtctcgtatatttcccagtatacctagatatgtttacttttggggtataagtggttaaggcaaatgtgagctggatctggagaagagaaagaataaagaggtttgtcactgcgaggaaagtgtttattacttgtctttgttgttaatgcagaatgatctttagacccagcagttttttgaccactaccacgtccctttggttattccaaggttgtaggatattaggaaataaaaccaaaattatttcaccaaggtaatgaagttatgatgcagcatgttttcatggggttataggtaggtagcacccatctcagaaaaccaccaggaataggtaacagtccccagtagtagctttctaagcccacagggccattcctgttggtttccacttccatgactttgctccaggaattcctttggcctacaatgcctgcttggtttctcagtaatgaaagcctgcttttcttttgttctttttttttttaaattatcagggattttattgattttacaaaggatgatgtagtttcactgacactgcagtataagaaatataacagcaaaaagatactgccttccacctcccccaaccccaagaactttcagtaatggaatttcagactaaacctttccttttattttcttattttctcttctcttctcttttttttttttgaaacggggtctcactctgtcactcaggctggagtgcagtggtgcaatcttgtctcactgcaacctccacctcccggagtgattcaagtgattctcctgcctcagcctcccaagtagctgggactacaggtccgcaccacaaggcccagctaatttttgtatttttagtagagacgggatttcaccatgttggccaggctggtctcaaactcctaacctcaggtgatcaacccacctcggcctcccaaggtgctgggattacatgagtgagccaccacgcccagccagactaaacttttctaaatgtcatgtggaagataaaattatttgtacaaatgttttcataaatatattaaagcatttcaacacctagcaatccattactaaagacattaatttaaaaaaattattgcaatatttggtgccattatataatggaaaataaggtaaacatgcagactgtatatagtctaattcaattaacaaatataaggaaaacctattagctaaatttctggcatttttgaagaaactaaaatcaagttaacagcaccccatggtctcaatgtaacaggaaagggaagggatgctaaaacccacctcctttgataacttccaagtagatgaccatctggcctgatttgcgtgggattgagggttatcaggatgtgggacatttagtgttaaaaccagggcagtcctggcccagtagggacagctggtactcttcacccctccagttcttttaaaaatgtgtgcaattggccaggcgtggtggctcacacctgtaatcccagcactttgggagaccaagacgggtggattacaaggtcaggagatcaagactatcctggctaacatggtgaaaccccatctctactaaaaatacaaaaaattagctgggcgtggtggcgggcacctgtagtcccagctactagggaggctgaggcaggagaatggtgtgaacctgggaggcggagcttgcagtgagccgagattgagccactgcactccagcctgggtgacacagagagattccatctcaaaaaaaaaaaaaaaaaaagtgtgcaatatccacattgctttattctgggacttttctgcttgcatataaggctctccaggaagtcacgaagctgcatgatggcggggctggaggaatcagccacatctccggggcatccacctcttgcattagaggtgtcttcaactctatcttcaggtgtccaggctgccaccaggtagctaacaaagaaatgtcctgggtgacttttgtctttggtactctgtgctttccctgttgacatcctcagctcctacctccacaggcctcgcactgtattccctgtggctcatgcccgtggacactctctacagggacttgctctaagcacactgttaactaattgacaaaaatgccagctattggccgggtacggtggctcatgcctgtaatcctaccaatttgggaggctgaggcgggcaggtcacctaaggtcaggagtttgagaccaatctggccaacatggtgaaaccctgtttctactaaaaatacaaaaattagccgggcgtggtggcgggcacttgtaatcccagctactcgggaggctgaggcaggagaatttcttgaacccagggggctgaggattcagggggctgaggattcagtgggtcgagatcgcgccatttcactccagcttgggcaaaagagcgaaactccgtctcaaaaaaaaaaaaaaaggcagttattgaagctcaaagtgtgacctcttctaggagtgttgagaggttttaaaacggcattcttagacctcaaaaatctttcaaagacacaaagctagacagtaaaaattgttagctctgtgaaaaccattagctctgtgaaaaccaaagtgcaaagcacttaataatagcaatagttgtttcttactgtgaaccatgtgtcaggcaccattctaaatatttcacaaacaattcatatagcagccctgtgtggtaggtactgaatcaagccaatttcacaggtagagacgctgaggctgagcttggtaattgtcagagcttgatttgaacccaatgccatgcttatatacctccaaagtcaggctcttttttacttcacgatgaatagtttttttttctgatatcacacacacatacacacactaaatatatattatatatataatgtatatattatatatattatgtatatattatatatatatatatgatttttgtagagagagacagggctcactgcattgcccaggctggattgcagtggtgcaatcatagctcactctaacctcaaactcctgggctccagcagtcctcctgccttagcctcccaagcagctaggactataactatgctcatccaattttttttaagagacagggtcttactatgttgcccaggctggtcttgaactcctgggctcaagcaatcttccagcctcagcctcccaaagtgctgggattacaggtatgagtcaccatgctgggcctcacatgttaggttttaatgaggtctcttagtttgccgctaggatcaagtcctctctctttttttttttttgagacggagtctcgcactgtggcccaggctggagtgcagtggtgcagtctcagctcaatgcaaccgccgtctcccgacttccagcgattctcttgcctcagcctcccgagtagctgggattacaggtgcgtgccaccacgcccgactaatgttttgtgtttttagtagagatggggtttcactgtgttagccaggatggtcttgatctcatgaccttgtgattcacccacctcagcctcccaaagtgctgggattacagtcatgagccaccgtgcccggcctcaagtcctctctcttacctctcactgattcagccacatacaattattttgatcacctgctatgcacccatggtgttcttggcactaggaatcctgctgtgagtgaagctgagctcctgcctgggtagagcctgggccacatgggtctcccagctgtgctttgaagtcactgtcaaaagtcctgggcactggagaatttcatgtgtctgttgctaaggcaagatgccaaattccacatttgcctccaacaggaacaaatgtcagtttccaccaagccccaccttgttcaggtgactcctgttgtgagtcttttcataccatctccccttcacccacaagtgccaccaacaggcagaggtggggagctgggtttggagatactggtctgatccttaggtgaactcctctcccctgatgttgcaggagaatgggtgctcagatggagaatcagcactcttctcaggattggaaggtgctgtggctgggggagtctgcattatgttctgggctgtgagcttttccagaattctgctccacaggcacacatctgctgtgtatgtatttcatggtataaatcagatgtccctgagttctctagtattgaatgtctatgtaaaaagtgtctagccccaactgaggatgctggaagtctagtctgttaggaggcccctgaatatgtgcttgtcttgtgtgaccttccaggaggtgactcagttctcttttgttctgtttcttgctctaggctattgctccatttttttgtaggtcatctcctgccacttcttctctagggtaatgctgtttgcaatacacagttccttgtcttggtttcccaagcatcttagttctgaaagtgagatatgggcttgtctgggacgtgggggacaaagatcaggtgcctccacaagtgactctcctcagctcccagccagctgacaactgcatggactgatggtctctttctttccttatctgcatgctggtttccaggactttgcgcaccctgaaggagcctcatatgacccagtagtttcattcctaggcagcttttatatcttttatcatttttctaagcttaagacacctttggtcagccacggtggctcacgcctgtaatcccggcactttgggaggccaaggcgggcgaatcacctgaggtcaggagttcgagaccagcctgaccaacatggagaaaccccctgtctactaaaaatacaaaattagctgagcgtggtggtgcagacctgtaatctcagctactccagaggctaaggcaggagaatcacttgaacccgggaggcagaggttgcagtgagctgagatctcgccactgcactgcagcctggcaacaagagaaaaactctgtctttaaaaaaaaaaaaaaagactccttttctttcctcattaatttggcggccacgtctgtccggaacttgtgggacgtcctcgtcttcatcaggttggcagatactccagcatggcctgccggccgccgaggccaccatccacaggctcaagggctccgtggtcgctccttcgtgctcccgcctccagagggagccagacagtgcatccttgcagtggacgccgcccgcccgcaaaagcctgtttttcaatgactgcctctacctctgaacctcagcttagatttctctctctctctctctccctccctctccctctctctctctctctctctctctctcccacccccacctcctctttttaagacaaagtcttgctctgtcacccaggctggagtgcagtggcgcgatctcggctcacggcaaactccgcttgccgggttcaagagattctcctgcctcagccaagcagctgggaatacaggcacctgccaccacgaccggctaattttttttttggaagaaaatgactttattctaattaactcacaaagaataaaatcataacagctagtttaaggaggccacacaaacatttgccctgtcacagattctacagagtaggaacaccccccttccatttcaattctgaagcaaggaagctaggaatgacaggagaggtttaactcatggttacactttataccctcactatcaattctatttttatactaaattaacttagttatgagagctgattttccatctctccaggttgaacttcttgattaggccaatccgtttgcaagtcggcactgtttcagcacctcattgaaaccctcacagagcttgatgtcaccctggttctgggcacactccagaaactgatctcatagaagcaaggctgctgctgctgtgccggctgggttccctgaggctcctggtaagtgatgtcaggcctcgcaggctcagcattacttcctcccctgaaagccccagtaatggcgtgacccacagcagagcccacagccacgccagctgcagtggttgccatctgggccatcagacctggctgccggggcgcagcagcagaagagccaactacagatgggggtgccgctgctggtggctgaacgactggtactggcctgggtgcagctctcatctgagggggcctggctggccggaggggccatgcgggaggtgcggcttcggcttccacgcggcatcctaggtacgcgacggctcggcctccggacgtgtgacgaccggctaaattttgtattttagtggagatggggtttcaccatgttggccaggctggtctcaaacttctgacctcaggtgatccacccaccttggcctcccaaagtgctgggttaacaggcgtgagccaccgcacctggcccgatctacccttctcttacaggattcctagagacttaatattttggttttggtttgtttcttttttgagacagggtctccactccgtcgcccaggctggagtgcagtggtcactgtagcctggatctcccaggctcacgggatcctcccacctgacggcctcccggcctcctgagtagctgggactacaggtacgcaccaccacacccgctactttttaattattttttttttttgagacggagactcgttctgttgcccaggctggagtgcagtggcacgatcttggctcactgcaagctccgcctcccgggttcacgccattctgcctcagcctcctgcgcagctgggactacaggcacccgccaccacgcccggctaatttcttgtatttttagtagagaagggttttcactgtgttagccaggatggtctcaatctcctgacctcgtgatccacccgcctcggccacctaaagtgctgggattacaggcgtgagccaccgcgcccagccctactttttaaattttttgtagagcggggtctcactatgttggccatgctggtctcgaattcctggcctcaagcgatcctcccgccttggcctcccaaaagctgggattacaggtgtgaaaccccgcgccggtctgaacctcaatgtttgaaccaccaaattttacctgtattgacacaggccccgtcttgttgtttttctaaatctcatgtcattgtttgcatattggttacccgtggttggctttggagctgaaggtggacagagctaacatcaggttgcacacaggaacacagtgaggtcgcgaaaaagtagcgcgagctgcctccatggcccagggcgacctcaccggcgtttcctgtctgggactgcgcccacgcggtcacgtggtggcccggaggacgcgcggcggcagcggcgcacgcgcacggagaggaggctacttgccaggtgagcgagctgagtggggcgccggggcggtaggagggtgctgttcgctgagctggagtccgggctccggtccccgccacggaccttgagagggtacccggggtcagacctggcaggtgggaaccgggagtggggaggacccagggcaggggcgggatgcgcagattcgtggaaactctgcaggttgtggacaaactgcccaaatccttttccctgaatgccagtttaatggcctcgtctgataagaaaaaaataagaaatagatttcagagaccctatttctctctctgcctctccacctgctttactttttttctcttctgttaattttgagccttataaaactatagcgccagtatcctggtttggatcctgaaacagaaaaagacattagtggaaaaaataataaaggctgtggtttagttaatagcacgtacccatgttaatttcttaatttcgacaaattgtacacaaatgttgacattagaggaatttgggtaaaaggtacacaggaattcttagtactatctttgcaatttactgtacatctaaaattattctaaaatgaaaagttaagaaacaaaatcctaaagcaaagtgcagcaggccattgttcaccagggagggctcaagttagttcctctttgtcatggagttaggcatgtttgaccaacttgtttgctaaggcagagttgtcaggctactgaatgtagattcttctgtccaaaggtttccgggcaggaatcggttttctctttcgattctgtcaaatatctttggaacacatgttgtgcataagcaaacgagacacacaaagtctctgcataagggaatatacagtcagtctaggtcaggtaggaagtaagcactattaaaaagattcagtaaaacctcccagaactgggaagactcagatgtggaagaaatcacatctggtccaagggagtcaggaaggctactggagggagtgctgtcctgaactgagggggctctgagaagaaacagcattcctggggtgaagaatggcaccaatagaggcttgcaggtgaccaagctgagctgagggaggagccctgggagcaagtgcagttcctcttacgtggaagcgcagagtacatccagggagtactgccagatgaaactggaggtgaaaactgtagctttgttgtagaaaacagggtgacacttcagttggatacattatttttatttttatttttttgaaacggagtttcggctgggcgcagtggctcacgcctgtaattccagcactttgggagaccggtgagcagatctcctgaggtctggaggtctagaccagcctggccaacatggtgaaaccccgtctctacaaaaatacaaatattagccgggcatggtggtgggcgcctgtaatctccgctactggggaggctgaggcaggagaatcgcttgaacccaggaggtctaggttgcagtgagccgagatcgcaccattgcactccagcgtgggtgacagacaatagtgctgtctcagctcactggaacctccacctcccaagttcaagcgattctcctgcttagcctcccaagtagttgggattaaaggcgcccgccaccatacctggctaatttttgtatttttagtagagacggggtttcaccatgttggccaggctggtcacaaactcctgacctcaggtgatctgcccgcctcagcctcccaaagtgctcggattacatgtgtgagccactgtgcccagcctacattttttttaaaaaggaaaacagggtgacattgactacaattatacatgccatgggagccatggaatgttttacagcaagagagagacatcattcggtttgcacttggatattattgacttggcagcagtatgtaggttggcttgaagtagaccaattaggaaattatcaggctagccttggggaattaaagagacgttccaccagggcagtgaaattaatgtgcaaagaatgacatagtttggggagatttttttgggtctagaagacctagcaactgaaggcatgtgaagaccaaagaggaaaaaacaattccaaagttttgctcctgagtgttttggagcatagttgatgcatttgcagaaatagaggactcagagggagacctggaatgggggctgggaggatagtgaattttttttttttagatggagtcttgctctgtcacccaggctggagtgcagtggtgcaatctcggctcactgcaatgtctgcctcccgggttcaagcgattctcctgcctcagcctcccgagtagctgggactacaggtgcacaccaccgtgcccagctaatttttgtatttttagcagagacagggtttcactatgttggccaggctggtctcgaactcctgacctcatgatccgcccgcctcagcctccaaagtgctgggattacaggcatgagccaccgtgcccggcggtgaatttgtttttgagcaagatgtgcttggattgctggtggaatatccagttggagatgtgtatttaagattagtaaaagaagccaaacatttacaaaagggacaggaaaaagaaaaagagccttagaggacagatatgagaagatatgagtcagggaaggaggaggatcagatttctatttctaggggcttcaggagtcaggtggacctggacttagtgagtcagtagtgtcacagctcctgcaaaggtagaggagactgaggaatgaaacttgatcttggatttatctatgaggaagtcactggtcatcttttaaagagttgttttagtggaaaagtgagacgactgctaacagactgtaatctattcatcctacagcctttcccaagtggccagaggactggacaaagagccagaaatattgtttctagtcctggctctgctgctaattaccattgtatttggggcaagtcacgtatgcctgggctggaatagaaaaaaatacatccgagctgggctcggtggctcatgcctgtaatcccagcactttgggaggccgagacaggtggatcatctgaggtcaggagtccgagaccagcctggctaacatggtgaaatcccatctctactaaaaatacaaaaattagctgggtgtggtggcaggcacctgtaatcccagctactcaggaggctgaggtgggagaatcacttgacccaggaggcagaggttgcagtgagccgtgatcacgccattgcactccagccttggtgacaagagcaaaattccgtctcaaaaaaaaaaaaaaaaaaaaagacttgaatcctggctgggcatggtggctcacacctgtaatctcagcactttgggaggccgaggcagaaggattgcttgagcccaggagtttgagaccagcctgggcaatataaggagacctcgtctctacaaaaaatacaaaaattagcttctacaagaacaaaaaaattagccaggtgtggtggcacatgcctgtagtcccagctactcgggaggctgagatgggagggtcacttgagcccagaggtcgaggctgcagtgagctgtcactgcactccagcctggtcaacagactgagactctgtccatataaaaataaatactttaatcctaaacgttgacacatctattttagacagcatatattgatatgttggttcaagtcgtcttttaaaagtcaaaggtaggccgggcgtggtggctcacgcctctaatcccagcactttgggaggccgaggccagcggatcatgaggtcaggagattgagaccatcctgcttaacacggtgaaactccatctctactaaaaatacaaaaaattagccgggcgtggtggcggacacctgtagtcccagctactcaggaggctgaggcaggagaatggtgtgaacccaggaggcggagctggcagtgaggtgagatggcgccactgcactccagcctgggtgacaaagcgagactccatctcaaaaaaaaaaaaaagtcaaacgtataaagtatgaaggaacctctgtgtttatctattcaagattaccatatagtacagaatcagctgtagatattcttagattttgtagtactgttaaaatacaatattataaaaatggtatatggaaaaatactctaatcctactaatttatttttatcttttgtttttcttctaatctttgttctagtacagacaactttgaattctgctttttatgttttacacttgtatatgtgagcatttatcatgttgctgcctagtctatactacatagtatttttatttttatttttattttatttttattttttgagatggggtttcactcttgttgcccaggctggagattattcttaaactatgttaaatacactataactctaatacttatttaattaattttgtttaattacatagtattttataaagttgttaaaccaagatttaactatttctttattgttcaacatattttattattttctaattttgtccaattagaaattaaatggtagagtaaattgctgaatgcattgaacataaaacaggcataaatacagactcattttaatttaaaaaattaaaacaaaaaaagtccaggcttggtggctcacgcctataatcccagcactttggcagacagaggtgagcggatggcctgaggtcaggagtttgagactaacctggccaacatggtgaaaccttgtctctactaaaatacaaaaattagctgggcatggtggcaggtgcctataatgccagttacctgggaggctgaggcacaagaattgctacaacctgggaggcggaggttgcagtgagctgagattgcgccattgcactccagccctcaataaaaccaaaaggacacttttattcctagcaaaacctaatagtctggagaacatgttccatggagcacactttggaaaatgctgatacagaaacaattttagagctctgaagaaccaaaaatctagtcccctaaattgacaattgaagaaaatagtattcaaattcaataaacattgatttggctaccatagttgatttcaaatatatcagtggtgcccaaaaatgtcccaataaagtagttatgcttaaacccctgttaagaaataaaacaggctctaagaagttaaatgacttacccaagatcaaaaagtggcaagtggtgaagtgagatttgaacccagacctctcgagtcagtgccttctccgttaacacatcctgctgcttccctggtcatcaaccctgaatacattaaactggttggatagtttagtgacttcaaatattttcactttcttggaagtaatgtgtttcaaaagtgaagtttaatttgtatggtatttcatgttaccttactatcagcatataaaaagtgggagaataggccaggcggggtggctcatgcctgtaatcccagcactttgggagaccgaggcaggcagatcatgaggtcaggagatcgagaccatcctggctaacgcggtgaaaccccatctctactaaaaatacaaaaaattagccgggcgtggtggcgggcacctgtagtcccaaccgctcaggaggctgaggcaggagactggcatgaacccgggaggcggagcttgcagtgagccgagatctcgccagggcactccagcctgggcgacagagcaagacgctgtctcaaaaaaaaaaaaaaaaaagtgggagaatatacagtcagcagtccctgaagttacattttattttatttatttttagagacagggtcttgctctgttgaccagactagagtgcagtggcgtgatcacagctcactgcagccttgacttcccacctcaggctcccgtgtagcttgggactacaggtgtgcaccaccatgcccagcagttttctttttttcctttttttgtagacatgaggtctcactgtgttgcccaggctggtctgaactactaggctcaagcagtcctccttctttggcctcacaaagttcagggattacagacatgagccaccattcccagcctgaagttaagtttaagaaacagtaggcagggataaaaaacaaacaaaacaacaacaaaacctcattatattcaactctgaatagcaggaaggcgtacccatgatgcctgaatttatgtggtgcattgaaaaatattcttagctaactctacaattgcttactctttccttttacagcttttcccccttatattgaccaattccattttcttctctgctgcctgcctaatcctgaccacacccttcttaacacaggccagaggttgcccttaacaagcaggagtctactgcactagaggtaaaacacagcctctcaagggattattctttgattcaataaatatcttcttatctaccttgacaaaataggtaaatctcctttttaaggaaataatcttgtaaaagaaccaagatgattttataaaaatctgggaaaaagtggatccagaatctgttagatgttgctcaaactagatattttagacttttactttaagttctatttgaagtcataaataatagaaacttggtatactctgatgttaatttcattgaaattctccaaataatacaaaacagtggctaagagtgttggctctgacatcagatatctggattaaaaatctgtctctgggccaggggtggtagctcatgcctgtaatcccaggactttgggaggctgaggtggaaggatcccgtgaggtcaaaagttcaagactggctggcccgagaccctgtttctacaaaatgaattaaaaattagcctggcaaggtggtacacatctgtagtcccagctactttggagactgaggtgggagaatcacttgagcctaagaggtcgaggctgcagtgagctgtggatgccatcactgcacttcagcctaagcaatgagcaacagagtgagatgctgtctctcttttttttttttttttttttttttttgagacagagggttttgctttttcacccaggttggagtgcagtgacacgatcttggctcaccgcaacatccaccttctggtttcaagtgattctcctgcctcagcctcccgaatagctaggattacaggcacctgccaccacacctggctaatttttgtatttttagtagagatgaggtttcaccatgttggccaggctggtcctaaactcttgacctcgtgatccgcccacctcgaccttccaaagagctgggattacagacgtgagccactgtgcccagcccgagaccctgtctcttaaaaaaaatccatctccacttctggttgactgtgttactcagtctctgtctgcttcagtttaattttcgtacttaataatggtattttcttgcagagtgtttgtaaagaataaatataatctaaggcacttaaaactgtctagcacatggaaagcaggcaacaagtgctaggtattattacatcttttttttttttttttttgagacagaatctcactctgttgcccaggctgtagtgcagtggtgcaagctcggctcactgcaacccctgcctcccgggttcaagccattctcctgcctcagcctcccaagtagctgggactacaggcatgcaccaccacacctggctaattttttgtattttttagtagagatggggtttcaccatgttggccaggcaggtcttgaattcctgacctcacgtgatccgcccaccttggcttcccaaactgctgagatgcaggcatgaaccaccacacccagcctaatgagttttgataagtggccactgtggtgaagatatagaagttttccattaccccagaaaacttccctcatgccctttgtggtcatttctccaatgccaagcaaccattaatttgtttaccatcattgtgtgttagttttcccagtatttcatacagtatgtgctgttgtttatttatttattgttttaattagtgatggggatctcgctatgttgcccaggctggtttcgaactcctggcctcaagtgattctcacacctcagcctcccaaaatgctgggattacaggtgggagccaccacatccggcctagtatgtgcttttttgttagcgtaatgtctgggaaattcattgcatatatcggaaatgcattgcatgtgtaatgcatatgtcagaaatgcgttgttctttactgacaaatatattctgttgtatggacagaccacagtttctttgttttactgcagatggacacttgggttgtttccaatttttgacaaattgagtgatgtatgaatattcatgcacacatctttgtacggacatggggttctgtttctcttgagtaaatcctgaagaatgcagttgccaggtcacatgtttgtaagaagctatcaaattgttttccacagtggttgtaccatgttttactcacatcaccaatgtatgagagtttcagttactccacatcctcagcagcacttggaattgtcagtgcggtgaggtggaatctcactggggtttaagttataattgcctgataactaatgatgctgagcatctttccatccatgtatcttctttgatgacatatctgttcaaatcttttaagggtatttgtttttaacattgaaaatatatggcattttgatcctaaaaatgacagaaattccttaatacatggtcagatttatttggtgtctacataaggtttaatagtggaagaatagagagatctccacaacaaatgcaagactgagattaaatgtctttcgaagttttggaagcaactacttaaacagcaggatatttagagaaaaatgttagacatgtttatacccccacaccccacttttttttttaatgagccttgagagaaggatgaaatatttctaaatagctatagcaaagcagctgttttgaaatgcctggtggtgaaagtccctcttaactgcactctgtcctggaggcacaaggttgagcatttctgcttctcccggctgcttcactgtcaccaggtaggtgactagggtggtctccacatggggagggctcagtgatactagttgatctgtaggcatttttgccaggagaagttttctgctgggaagaaaggcaggcataactcctctgtatctgctgtggagtcctgctagggtgccggttttgtttttctgccctaaaagcaagtacagtctaaccaaacctgctgtgcgtggcctgaggtgggataggagctccgtgagttccacattggttgattcaaccaaccagggttgaaaatatttggaaaaaaaaatccacagtgttccaaaaacaaagacgaatttgcaggactcagagtacgaggttaaatccacgggaatgaagtgatgtataggcagtgtattagatattatacgtaatttagagacaattgaaaatatatataaagtacacaggaggatgtgcctagataatatgcaaatatgatacctttttgattaacaaattaacaaatttttttttttttgagatggagtctttctctgtcgcccaggctagagtgcagtggcgcaatctcggcttactgcaacctctgtctcccaggttcaagcaattcttctgcctcagcctcctgagtagctgagattacaggcacacgccacaatgcccggctaatttttttgtatttttagtagagatggggtttcaccatattggccagactggtcttgaacttctgacctcaagtgatccgcccaccttggcctctgaaagtgctgggattacaggcatgagccaccgcgccaggccgaacaaaaaattttttgagatagaatgttgctctgtagcttaagctggagtgtggaggcacagttatggctcactgcagcctccacctcccagagccaagcaattctcccacctcagcctcctgagtaggcgtgtgccaccagctaatttaaaaaaaaatttttgggccagtgcggtggctcacacctgtaatcccagcactttgggaggccaaggcgggtgtatcatgaggtcaggagtttgagaccagcctgaccaacatggtgaaaccccgtctctgctaaaaatacaaaaattagccgggtgtggtggcgcgtgcctgtaatcccagctactcaggaggctgaagcaggagaattgcttgaatccaggaggcggaggttgctgtgagctgagattgcgccacggcactccagcctgggcgacagagcaagactgtctcaaaaaaaaaaaattttttttttgtagagacaggttctcactgtgttgcccaggctggtctcaaactcctgggctcaagcaatcctctagcctcagcctcccaaagccttggtattacaagtgtgagccaccatgcctggctaagaatttgaggatccaaggaaatacacaggggtcctggaaccagttccccttgaattccttgggatgattgtatttcagtttgtttctttattcctctcttcctttattcagttactaaacaagtatttattgaatgtagagtatatctgctccccacccccacgtggtgcctcactcctgtcatccgagctactccagaggctgaactgggagaatcacttgagcccacgagttggagaccagcctgggcaacatggttagacctcatctctcaaacaaacaaatgaaaaaaaaaacccagctgggcgcggtggctcatgcctgtaatcctagcactttgggaggccgaggcaggcagatcacctgaggtcaggagttcgagaccagcttgaccaacatggagaaaccccgtctctactaaaaaaaaaatagaaaattagccgggcatggtggcgcatggttgtaatcccagctacttgggaggctgaggcaggataatcgcttgaacccgggaggcggagtttgtggtgagtcaagattgcgccaccacactctagcctgggcaacaagagcgaagctccgtctaaaagaaaaaaaaaagagttctgaaatgttaaatacttataattggattgcaagggcatttatgtgcgagtgcattgctaggatattcatgcctgtataatacagaaagaaacttttttccctgaaaaattcagctttattatacagttatgcaccaaattatgtttcagtcaatgacagaccacatagacagtggtggtcccataagatactattgtatttttactgttccttttctatgtttaggtatgtttacatacacaaatattgacccatgtgtaacgatttcctacagtattcagtgctataccatgttgtacaggtttgtagactaggaactataggctctaccatgtagcccaggggtatagtaggctataccatctaggtttgtgtatgtatgctctatggtgttcacacaacgacaaaattgcctaacaacacatttctcagaatatattcccatcattaggtgacacatgactttactgatgggttttcttcattttgtttgttaggttttttgtttttttaattgaaaattgacagattatggctgcctatatttatgaggtacaaagtgatgttatgatttatgaatacaatgtggaataattaaatcaagttgattaacatatccatcatctcaaatacttatcatttttgtggtgagaatatttgaattttattctatgagcaattttgaaatgttcaatacatttttgttatattcaccatgctgtgcaatgtattgcaaaggaaaaaaccttattcttcctgtctaactaggactttgtgccctttgaccatcatttccccattcctcccatcccccagcctctggtaaccaccatttttctttctgctcctttgagtttgattgttttttattttatacataaggaagaacgtggtatttgtctttctgtgtctggcgtattacacttagcataatgttttctagttccatccatgatgtcccaagtgacaggatttccttctttttcaaggctgactagtatttcattgtgtacacacgcacacgcacacacacacacacacacacaccccacaccatattttcttcacctgttcatctttgatggacacttaggttgattccatatcttggctattgtgaacagtgctacagcaaacatgggaatgtagacatctctttgacatactgatttcaaatgttttgggtaaatatcgagaggtggggttgctggatctactgatgttttcctaactactgtttttcttaactacagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactggtaagaatgctgaatttcctctcctttctttctcctgtgcatagtatcaaagctataacccttccaaaatctaaaataaataaccatattggattttagattttcttttttttctggacggagtcttgctctgtcacccaggctggagtgcagtggcacgcgatctcggctcactgcaacctccaccccccgggttcaagcgattctcctgcctcagccactggagtagctgggattacaggcatgcaccactacacctggctaatttttgtgtttttagtagaggcgaggtttcaccatcttggccagactggtctcaaactcctgacctcaaatgatttgcctgcctcggcctcccaaagtgctgggattaccggcatgagccactgcacccagcttttagaaatttatctttattcatctcttgggattggtggtagtataaaagtagttgatagccgggcgtggtggctcacgcctgtaatcccagcactttgggaggctgaggcaggtggatcacaaggtcaagagatcgagaccatcctggccaacatggtgaaaccctgtctctactaaatatacaaaaaattagccgggcgtggtagcaggttcctgtagtcccagctactcgggaggctgaggcaggagaatggcatgaacccgggaggcggagcttgcagtgagccaaaatggcaccactgcactccagcctgggcgacagagcaagactccatctcaaaaaaaaaaaaaaaaagtagtcgatgtttatatttctaaatattgtacagtacagtagttatgcatctaatatattaatgatatctataaatgattaccaaccttgccttttttgtgaagtacttttttttgcagtcaaatatttactgggcatcattaggtgtcaggcacaggtccaatttctgagaataatgtcagtaaacaaaatagacaaaggccctaatgtcatggatttcacattctaatagaggagatagaaaataaacctgcaggccgggtacagtggctcatgcctgtaatcccagcactttgggaggctgaggcggatggatcacttgaggtcaggagcttgagaccagcctggccaacatggcaaaaccccatctctactaaaagtataaaaattagctgggtgtggtggcacgtgcttgtagtcccagctactcgggaggccgaggcacaagaattgcttgaacccgggaggtggagccaaaattgtaccactgcactccagcctgggcaacagagcaagactttgtctcaaaaaaaaaaaaagaaaaaaaaccaaaaccctgcaaatcaacagatgtgtaacattgggcagtggtaagtgaagggatagtgagtgattatggggaatggggtgctagtatttcaggccagggttaggaaggcttctgtaaggaggtgacattttttttctttttacttttctttttattttttatttttatttatttattatgaggtggagtctcactcttgtcgcccaggctagagtgcagtgtcacaatctcggctcactgcaacctccgcctcctgggttcaaggtattctactgcctcagcctcctgagtagctgggattacaggtgcccgcccccatgcctggctaatttttttttttttttgtatttttagtagagatggggtttcaccacgttggccaggttggtttcaaactcctgacctcaagtgatccgcccacctcagcctcccaaaatgctgggattacaggcatgagccaccgtgcctggcctttttcttttttaaaaagagacagtctcactgtgtcactaaggtggagtgcagtagcatgatcacagctcactgcaacctcaaagtcctgggcttaagcaatcctcttgcctcagtctcctgagtagctgagactacaggcatgttccaccatatccggctaatttaaaagaaattttttcggccaggtgctgtggctcacgcctgtaatcccagcactttgggaggctgaggcgggtggatcatgaggtcaggagtttcagaccagcctgaccaacatggtgaaaccccatctgtactaaaaatacaaaaattagccaggcatggtggcgtgcacctgtaatcccagctactcaggaggctgaggcaggagaatcacgtgaacctgggaggcggaagttgcagtgagccgagatcgcaccactgcgctccagcctggcgacagagcaagactcagtctcaaaaaaaaaaaaaaaaaaaaaaaaaaattctagagacaaggtctcactatgttacccaggctggtctcaaactcctgacctcaagcagtcctcccaccttggcctgagcaccagaatgaaggggagagtaaggcagtggatctttgggaaaggagtgttccaggaagaacagagatgcttctggttattttaggaggtcatgaaactctcaaaaattgtcaaaacagttagtcttaatttatcataaccaaaaagaaattataccttaccttatggaaataataaaatttagcatcgtattttgataaaatgttacaactccaaaatgatcgggagtctgtggataagcccatgcctgtaccatggcaccagctgttatctggctaaatattttgtaatctatgttgtaaaacttcctcttctgaaacttcccctcaaagttgaacaaacacaaattagaacaacatgagagtgatttaagaaacatggtttcagatttacaaaaatacgtggtagctcgtggtagctcagggttcatccccatccttcaacatccctcttgaaatcagaatgggattatttttatatttttcttccaattccttattgtgtatagagaatggatactgttttgaaagcaaaatgttggaaactgagcatgatgctaagatgcctttataaaaacatgaagatgccaggtgcggtggctcatgcctgtaatcccagcactttgggagactggggtgggtggatcatgaggtcaggagtttgagaccagcctggccaagatggtgaaaccccgtctctactaaaaatacaaaaaaattagctgggcatggtggcaggtgcctgtaatcccagctacttgggaggctgaggcaggagaatcacttgaacctgggaggcggaggttgcagtgagccaagatcacaccactgcactctagcctgggcaacagagcaagactccatctcaaacaaacaaacaaacagcatgaagaaacactggggtataaataagatttaaatagtaatagtatgagttcccattttgttgggttatgaacttttctttttattaaagttggccctatcactaatagataatttccaaaataccacacatttaatggcttaaaacaacacaaatttattattttacagttctgtaggtcagaagtcccaaacaggctacgtctggtagctgatgcctataatcccagcattttgggaggccgaggtgggagaatcacttgaggccaggagttcgacaccagcctggtcaacatagaaagaccacactccacaaaaaaaagtttaaaaattagcaggtgtagtagtgtgcacctgtagtcccagctacttgagaagctgatgcaggagcactgcagcctgagcaataaagcaagaccctctctctgtgggaaaaaaagtcccaaataaatttcagtgggctaaagccagggtgttggcagggtgcgttccttctggaggttcagtgggaagactctactcctttgccttttctagctccagaggctactgcattccttggctcatggccccctccccatcttcaaagccaacgatggctgagtctttctcacatcatatcactctaacatttaccttctcgtctccctctttcatgtataaggactcttatgagtacactggactcacttggataatccagagtactctcccatctcaaaatccttaatctcatcacatctgcaaagttccttttgccatgtgttcacagcttctgggaattggcatgtggacatcatattctgcctaccacaagtattaatagaacagaacttgtcactgccaacccagagtcactctgccctccttggaagcctgtatcatcaatcacagtacaaacatgatttaggttttgccttagatactgtcatgttaatgaaatttcagaatagcaaagaaagttgttttgagaaatattttttcaaagcaaacattcttctcaataaaattttttttttacttcctatactcttgcttataacttgccactttaatttttttttttttttttttttttactgccgttgaggcagaaaggaaaatgaagctcttaggaagctcaatttaaattctcagttgatcacattaaggagcaaataattgaagttacaggactcttctagtcattctttttggaaagaaattaaatttaggtttttttttggtttcttttttttttttttttttgagacggagttttgctcttgttgcccaggctggagtgcaatggtgcgatcacagtgtgcactgcaacctttgactcccgggttcaagcgattctcatgcctcagcctcctgagtagcagggattacaggcgcccgccaccatgcccggctaatttttgtatttgttagtagagatggagtttcaccatgtaggccaggctggtctagaactcctgatctcagatgatccaccctcctcagcctcccaaggtgctaggattacaggtgtgagccaccacacctggccttttttttttttgtttttttttttgttttttttttttgagacagaatctcgctctgttacctaggctggatttttagtagagacagggtttcaccatgtagacaggctggtcttaaactcctgacctcaggtgatctgcctgcctcagcctcccaaagtgctgggattacaggtgtaagccaccgtgcccagccttcaggttattttttttattttttcgagacagagccttgctctgtctcccaggctggagtctaatggtgcaatctcagctcactgcaacctccgcctcctgggttcaagcaattctcctgcctcagcctcttgagtagctgagactacaggcaggcaccaccatgcccagctaatttttgtgtttttagtagagatggggtttcaccatgttggccaagctggccttgaactccttacctcaagtgatccacccgccttggcctccgaaagtgctgggattacaggtgtgagccactgtgcctggccaaagttatttcttacatatttataccactacatcattcaagcttaagccaaaacaccaaaatctatttattttactcaccaatattcatgtttttctttatttttgtttgaatgcagtaattaaccaactcattaacatcagttttattttagagtccttttttgttttttttagatagtcttgctctgttgctcaagctggagtatagtggtacagtcatagctcgctgcagcctcgaactcctggacttaagtgatcctcccaactcagtctcccacgtaactgggactccggcacatcaccacatctagctaattttttattttatattttgtagagacggaggtctgtgttgcctaggcttgtttctaactcctggcctcaagcgagccttagagtctattcaaaaaatttttttattcaaaagtacagtatatgtcttttcatttgtgaaatgttttacactcctatttttaccataatttggtctgttataatttttttttttttgaaacagagttactctatcacccaggctggaatacagtggcacgatctccgctcactgcaacctccatgtcccgggttcaagtgattctcctgcctcagcctctcaagtaactgggactacaggcaggcaccaccacgcccagctaatttttgtatttttagtagagacagggttttaccatgttggccaggctggccttgaactcctgacctcaagtgatctgcccgcctcggcctcccagagtgctgggattacagatgtgagccaccgcacctggtgttctattataattctcttctctttgcaatttaggggatacctgtatttggtaatttgtaaacaaatgtcctatgtttaattagttaaaatattcaaaatttttcccctaatagattcttttctcctccctcccaagtagattcgaattcagaattgtcaaatgaagaattaaggcaatgtcttaatgaaactttagaggtaggtactctggctaatataaaaattatcagtttagctgggtcccagcagcggctgcagtgctctcgtcttctgcagctctccatgccctctcctttttgcttctggaaacatggcctctgttgtggctgtctctgatggtgtcatcaaggtgttcaacgacatgaagttgtgtaagtcttcaacaccagagaagttgaagaagcgcaagaaggcggtgctcttccgcctgagtgaagacaagaagaacatcatcctgaaggggagggcaaggagatactggtgggcaatgtggaccagaccatcgacaacccctatgccacctttgtcaagatgctaccggataaggattgcctctacgccctctatgacgcaacctatgagaccaagagagcaagaaggaggacctggtgtttatcttctgggccactgagtctgtgccccttaagagcaaaatgatcaatgccagctccaaggacgccatcaacaagaagctgacaggaatcaagcaagaattacaagcaaactactatgaggaggtcaaggaccactgcaccctggcagagaagctggggggcagtgccatcatctccctggagggcaagcctttgtgagccccttctggccacctgcctagagcatctggcagccccacacctgtcctcgggggttgcaggctgcccccttcctgccagataggaggggctgggggaatcccagcaggggaagggcaatcccttcaccccagttgccaaacagacctcccaccccctggattttcctcctccctccatccctgatggttctggccttccgaaactgcttttgatcttctgattcctcttgggttgaagaagaccaagttccccccaggcaccccagttatgggggggcctgtattttctttaacaacacccccactccccacctgttcctccccctcttcccttgctgctgacttgtaactgcaatagtgactctgtgcttgtctgtttagttctgtatataaatggaatgttgtggagatgacccctccctgtgctggctggttcctctcccttttcccctggtcactgctactcatggaagcaggaccagtaagagactttcgattacaaaaaaaaaattctcaagtgaataaagtccattgatagatattttgtttaaatggtaccaaatctgtgtggaaggcaaattttggctttccagacattcttgctgaacttgagagctcatctttttcaactggcctcctctgtttcttatccacctcatctcttaaaagaagctacttatgtaaacatgcccaccggttctcctttccaccccacttctcttatctcctccttgagaaagtaagttatcacttccttccaccggccttccccgtatgtgtggcttcaaacaatctgacttaatttaacctcattaaagtcagaagcccagagtctcaggtggcctgagtagcccactgccttggtggaaatagcagtttctgcgaggggtgtctgtcctttgggaaataggaagcccaccttactgtgtgtttgggactcttcccgtgaaagctactgtatttggctgccgagacaatgtaccacaaactggtggcttaaaacagcagaaatctgtttgcttttagttctggaggctgaagtttgaaaccagagtttcagcaggccgtgctccctctgaaggctttagaggagagtcctttgcctcttcctagcttctgatgcttgctgcaatccttggtgttccttggctggtagctgcagaaatccagcctctgcctgtcacatggccttctccctatgagtctgggtccaaatttccctcaatttataaggacactagtcattggattggggcctgcagctgcctcctcaccttgagtccctacataaggaactacaacctcagtatgtaaacaacatgaaagccaactgaggctgggggcagtggctcatgcctgtaatcccagcactttgggaggccaaggcaggtggatcatttgaggtcaggagttcgagaccagcctggccaatatagtgaaactccgtctctactaaaaatacaaaaattagctgggcagtagtggcacatgcctgcaatcccagctactcgggaggctgaggcaggagaattgcttgagcctgtgaggcagaggttgcagtgagctgagaccacgccactgcactccagcctgggtgacagagtgagactctgtctcagagaccttcctggttcaagcaattctcatgcctcagcctccggagtagctgggattacaggtgtgagccaccatgcccagctattttttatttttttaattgagacagagtcttgctgtcacccagactggagtgcagtggctcagcctcggctcactgcaacctccgcctcccgggttcaagcgattctcctgtctcagcctccagagtagctaggattacaggcatgcaccaccacgcccagcaatttttttgtatgtttagtagagacggggtttcaccatgttagccaggctggtcgtgaactcctgacctcaggtgatccacccaccttggcctcccaaaatgcagggattacaggtcacaccaccttgcccggccgaggctttcaattttagtatgtctggttcactcactaagtctagaagaattttcagccacatttgtaagtggtttgagccaagggtaaatgtagactagccaaactgataattttagggttgcatatcttgcagataggaagactaattttctttctgtcctcaggaggtagaaatgttaaaaactgaacttgaggcatctcaaagacaactcagaggtaaagaggaagcattgaaaattcttcaaagcatggtaagaagttgtttttaaactttcaccatttacacattccaataataatgttggtatggttttaacttttaaaaccaaggcagaaggacttaatatagttgagggtttttttaggtatgtatatttttaagagctttataatttatatatcctgaagttcacatgtaaatgtacactacaattcatttttactagatataagagttgtaccaccatcattataatctaattttagaatatttccaacaccagaaaagggacttggtgcccatcagcagtcattcctcattcccacccctatccccagtaatctattttctgtttgtagatttgccttttctatttaatataaatagaatcataagatatgtgactggattcttttgcattgagattcttttagttagcatgttttagaggttcatacatgtcgtagcgtgtatcagtactttcttcctttttattgccaagtaatactccattgtgtagatgcaccatgttttgcttatgcattcaccagttgatggacatttgggtggtgtattagtccatttttatgctgctgataaagacatacccaagactgggggaaaaaaagaggtttaattggacttacagttccacatggctgtgaaggcctcagaatcatggtgggaggtgaaaggcagttcctacgtggcagcagcaagagaaaatgaggaagattcaaaagtggaaacctctgataaaaccatcagatctcatgaaacttattcacataccagaacagtatgggggaaccacccccatgatccaaactatctcccactgggtccctctcacaacacgtgggaattatgggaatacaattcaagatgagatttgggtgaggacacagagccaaaccatatcattccactccagcccctccaaatctcatgtcctcacatttcaaaaccaatcatgccttcccaacagtcccccaaagtctgaaatcatttcagcattaacccaaaaatccacagtccaaagtctcatctgagacaaggcaagtcccttctgcctatgagctggtaaaatcaaaagcaagctagttacttcctacatacaatggggatgtaggtatatagccattccaaatgggagaaattggccaaaacaaaggggttactgggctcatgcaaatccaaaatccagcagggcagtcaaattttaaagctccaaaatgatctcctttgactccaggtctcacatccaggtcatactgatgcaagaggtgggttcccatggccttgggcagctccgcccctgtggctttgcagagtacagcctccctcctggctgctttcacaggctggcattgagtgtctgcggctttcccaggtgcacagtgtaagccatgggtggatctaccattctggggtctggaggatggtggccctcttctcatagctccactaggcagtgctgtagtagggactctgtgtgggggctccaaccccacatttcccttctgtagtgccctagccccggttctccatgagagccccatccctgcaggaaacttctgcctggacatccaggcattgccatacatcttctgaaatctagtggaggttcccaaaccccgattctttacttctgtgcacctgcaggctcaacatcatgtggaagctgccaaggcttggggcttgcaccctctatattcacagacggagctgtaccttggcccctttcagccaccgctggagtggctgggacgcagggcaccaagtccttagactgcacacagcacggggaccctgggccctgcccacgaaaccattttttcctccgagacttctggctctgtgatgagagaggctgctgcaaaggtctctgacatgccctggagacattttccccattatcttggggattaacatttggctcctcattacttatgcaaatatctgcagctagcttgaatttatccttagaaaatgggattttcttttctattgcattgtcaggctgcaaattttctgaacttttatgctgtgcttcccttttaaaatggaatgcctttaacagtacccaagccatctcttgaatgctttgctgcttagaaatttcttccaccagatactctaaatcatctctctcaagttcaaagttccacagatctctagggcaggggcaaaatgccacaaatctctttgctaaaacataacaagagtcacctttactctagttcccaacaagttcctcatctccatctgagaccgcctcagcctggatttcattgtccatatcattatcagtgtttttgtgaaagacactcaacaagtctctagaaagttccaatctttcccacattttcctgtcttcttctgagccctccaaactgtcccaatctctgcctgttacccagtttcaaagtagcttccacatttttgggtatcttttcagcaatgccccactctactggtaccaaattactgtattagtccatttttatgctcctgataaagacatacccaagactgggaagaaaaagaggtttaattggacttacagttccacatggctggggaggtctcagaatcatggtgggaggcgaaaggcacttataacatggcagcagcaagagaaaatgagagagatgcaaaagcagaacccctgataaaatcaacagatctcttgagacttattcactaccatgagaacagtatggggaaaaccacccccatgattcagattatctcccaccgggtcctctcacaacatgtggtaattatgagagtacaattcaaaatgagatttgggtggggacacagagccaaaccgtatcagatggtttccactttttgactgatgaatagtactgttctgaacactttctttgtgtggaaaattcatccattaattcccacattcattggaaaagagccaaaccaagatctcctgacttttgaactatcagactctccataaaaggtggtcactgtgaaattcttatgtcaattcatcttaattttccattgccttaaaataaaagagaacttcatgatgtacataggagtgattacaaatttaatttatactgatgctagttttatttttcttaggcaatactgggcaaagccacaagtcatacgcaggcagtgcttcaaaaaactatggaacaaaacagatccttggagaaggtatttggtgcttttagtgtagacttattgaatccaataagctgttaaatataatttccctaaactcaccatactaatggatctgtcacttgtgcctaccttctgctaggtgtgcttcagttctgatggtcttcccttttggagtttacaatctaaaacagattgtcatgtgcacaatgaattcaggttatttttatttccccatgttaaggtagtaggaggcctgccaaattggtacttctcatttcttcttctttttttttttttttgagatggagtcctgctctgtcgcccaggctggagtgcagtggcgcgatctctactcactgcgagctctgcctcccgggttcacgccattctcctgcctcaggctcccaagtagctgggattacaggtgcccgccaccacgcccagccaattttttgtatttttagtagagacaggatttcaccatgttaaccagaatggtctcgatctcctgaccttgtaatccacccaccttggcctcccaaagtgctgggattacaggcgtgagacaccgtgcccagcccatttttcttcttaaaaaaaatttttttttttaaatccttatcgttgcctggcaggacgtacgtctttctgaccatctcatcttcactataaaggtagttaggaatcatcctagatggtcatgtctcctgtgcttggtgtgttctcccttgatgggaccattgagttaagatttccaggagtggattttgcttgaggtctctacatgcagcggaggtgggcactgagaaatctaggtgtagcagcccagcaaattttgaaggcaaacaatttgaaattttttctatattaagtgagttttggcagagttgttttgaatgctaaagaggcatgttatatgtgtttgcaaatgtcagagatacttttagagcaataattaattttttctctttaaaccatttctgagaactgattatatgatttatttcagctattcacaatgtcctgaaatgatttatttgtagtaatttgccatgaaggtactattttctttccataggaaataaatgccttgcagtgggaaatagaatttgatcataatagatttaaaaatatagaggaatcttggatccaaaaatatgacaggtttgtatattactccattatttttctttgacaacctttaaaatctatgtaattcaaaagtaatttatgctttcttctttgagccaagtgcaaaatattacaaaatttttattgcttatccacttactagtcgcatatttttgttagtgttaattttccttaaagaaaaaaaatagcataggctgggtgtggtgtctcacacctttaatcccagcacttttgggaatctttggcacttggatctgaggatcacttgagtccaggaatttgagaccagcctgggcaacatgttgaaaccctatctctacaaaaatacaaaaagtaactgggtgtggtggcttgcacctgtagccccagctacatgggaagctgaggtgtgaagatcacttgggcctgggagttggaggctgcagtgagccatgattgcgccactgcacttcagcctggatgatagagtgagtccgtgtctcaaaaataaaacaaaacaaaaaaacaaaaaccaaaatagtataaactctatcttaaaatacagtgtaagaattattttagaattggaactatttgtttttttcaaacaaaatcttttgaggggctgggcatgatggctcacacctgtaatttcagcactttgggagcctgaggtgggaggactgctttggttcaggagttcaaaaccagcctagatgacatagcaagatcctcatcttgttaaaaaaaaaaaagatgaaaaataagatggttaagatggtaaatgtttatgttctgacaatcagctccaaaaagagaaaaaatatctttggaacaacttttatttgtgtgagtttatttaataactttaaattatacacttactataaagtcagtcatttcagttgggtatggtggctcacacaatcctatcgtggccccaatccctgttggactgaacaaagggagacgaacgtgggaataaaaataaagacaaaagagtatatttggaagaaggggtcagggggctccttgctccagtgaacaagggtcctgagcttttagcacccttcgtatttattgagtaaaggagatagggaggaggtggttgtcagtcagctgcttgactcggtgcaggcttgcacaactgcattctctgaacagtagtctccagatgttccagtagataacctcaaggagcacggcgccagagagtgactgccctcagcaaaccttctggcggcaggtgcagatgtgagtttgcctacatcctgcattcatgataaacagtttgctgtttgatcatatagcctcagtggaatgctaagttggtcacgatcctctggctttcggctctctacataatcccagcattttgggaggctgaggcaggtggatcacttgaggccaggagttctagaccaacctggctaatgtggcgaaaccctgtctctaccaaaaatacaaaaattaactgggcgtggtggcacacacctgtatcccagctactcaggagactgaggcaggagaatcgcttgaacccaggaggtagaggctacagggacctgagactgggccactgtactctagctttgatgacagagcgagaccttgtatccaaaaagaaaaaaaaaccagaaagactgaataatattccatgttatgtatgtacgccattttgtttatccattcattcctgatggacacttgagttaactctaccttttggctattttgcatgatgctgctatgaacatgggtgtaccctatgtatcttttttttccatgaaatactttgttggtttttttttttttagagcagttgtagattcacaacaaaattgatcagaaggtacggagatttcccatatacacagcctcccccactgacaacatcccccaccagagtggtacattttttataaccaatgttgatacatcattattacccgaagtccatagtttacatgaggacctgtgtatgtaagtttctgaaggtgacctaagcatatagttgaaattcaaatggttattaagtaaagagaatgagtatgcaaaatggatggtttaaaaatatttctggttctgattatgtctcagctaagaagggttaagagtatgtttagtccaggcgcagtggctcacgcctgtaatcccagcactttgggaggccgaggtgggcagatcacttgaagtcaggagtttgagatcagcccagccaacatgatgaaaccacttctctactaaaacacaaaaattggccgggcgtggtggcgggcgcctgtaatcctagctactcaggaggctgaggcaggagaatcacttgaacctgggaggcggaggttgcactgagtcgagatcacatgactgcactccagcctaggtaacagagcaagactccgtctcaaaaagaaaaaaaaaaaaaaagggtatgtttaaaatcctggccgggcatgatggctcacaactgtaatcccagcactttgggaggctgaggcgggctgatcacttgaggtcaggagttcgagaccagcctggccaacatggtgaaatcccgtttctactaaaaatacaaaaattagccaagtgtggtggcagacacctgtaatcccagctacttggaaggctgaggcaggagaatcacttgaacccaagaggtggaggttgcagtgagctgagattgtgccactgcacttcagcctgggcgacagagtgagactccatttcaaaaaaaaaaaaaaaaattcttaccacattcctttaaattgtttttatttttgtgatacgtgtaaattccagactattttgaagtaggaaaaactatatttagatttttgtgttccaattatggcaataaaaatattctcgctcagcaaggaaatattaatgttttagttatttgaaagccacttttttccaggctaaactgtgaaaatgcagtcctcaaagagaatttgaaagtgaaaacagaagaaattaaaatgctgaagtctgacaatgcaggtaatgatgatttttgtattaagagcacatgtatcaataaagataacatgctagtattttgaaataatatacattaagtataatagaggggagaaatgtatcatttaggttttttaaatttaagaaaatttatcaaggtgaaattcacataacataaaactatttaaaagtgaacaattcctggctgggcacagtagctcattcttgtaatcccagcactttgggaggccaaggtgggcagatcatctgaggtcaggagttcaagaccagcctggccaacataatgaaactccatttctaccaaaaatacaaaaattagcgagacatggtggtgcgcacctgtagtcccagctactcaggaggctgaggcaggtgaatcgcttttactctggaggccgaggttgcagtgacccaagattgtgcctctgcactccagcctggacaacagagtgagactccatctcaaaaaaaaaaaaaaaaaaaaagtgaacaattcttgccaggcacagtgactcatgcctgtaatcccagaactttgggaggccaaggcaggaggatcacttgagcttaggagtttgagaccagcctgggcaacatagcaaaaccttgtttctattagaaacaaacaaacaaacaacaacaacaacagaaaaaccaaaattagccagatgtggtggcactggcctgtagtcccagctacttgggaggttgaagtgggaggattgctggagcccaggaggttgaggctgcagtgagccatgattgtgccactgcactgcagcttgggtgacagagcgaaactcggtctcgaaaaaataagttaacaattcagtggcattcacaaagttgcctaaccaccacctctgtctagttccagacagttccagtactccaaagtaaaatctcctacctattaagcaatttctccccattttctcctttttatttagttttcacttaaagcaaaatggtagagcacctgatatttgaagaacctaagtagaaatgatatatatgtgtgtatataatttatatgttatatatctcttatataatggtctaccttacgatgaaagttgatgcaaggataataagatatttaatgttaactttttttttttttgagacagagtctcactttatcgccaggctggagtgcagtggtgcaatcttagctcactgcaacctccgcctcctgggtttaagcaattcttctgcctcagcctcctgagtagctgggactacaggtgcatgccaccacacccagctaatttttgtatttttagtagagacaggggtttcaccatgttggccaggatggtctcaatctcctgacctcgtgatccgcccgcctcagcctcccaaagtgctgggattacaggtgtgagccaccgcgactggcctttttttttttttttttttttttgagatggagtctcactctgttgcccaggctggagtgctgtgacgccatcttggcttactgcaacctccacctcccagttcaggtgatcctcctgcctcagcctcccaagaagctgggactacaggtgcctgccaccacacctggctaatttttgtatttttagtagaggcagggtttcaccatgttgaccaggctggtctcaaactcctgacctcaaatgatccacccaccttggcctcccaaagtgctgggattacaggtgtgaatcaccatgtccaaactgatgttaactttttacatattttatttatttatttgtttatttatttatttattttcacacagggtcttgctctgttgcccagtttggagtgcagtgacacaatctcagttcactgcaacctccactttctgggctcaagagatcctcccacctcagcctcccaagttgttggtactacaggcatgttccaccatgtccagctaattaaaaaatatattattattattattattattattttgagacagaatctcactctgtcgcccaggctggagtgcagtggcacaatcttggctcactgtgacctctgcctcccaggttcaagtgattctcctgcctccacttcctgagtagctgggattgcagacacccaccaccatgcccagatttcttttttttttttgagacagagtctcactctgtcacccaggctagagtgcaatggtgcaatctcacctcactacaacctcctcctcccgagttcaaggattctcccgccttggcctaccacgtagctgggattataggcacctgccatcattcccagctaatatttttgtctttctgtagagacggggtttcaccatgttgacaaggctggtcttgaactcctgacctcaggtgatctgctcgccttggcctcccaaagtgcaacattaaaaaaaaaatttttgtagacatgggggtgactcactttgtgagggctcaactcctgggctcaagcaatcctcccaccttggcctccaaaagtgctgggattacaggtgtgagccactgcacccagccctaaaaatttagagaagaggctagttcttccttcttagcagaaattaaagaggtggcttgaagaggacaaatcacaagccaggcgctgttgctcatgcccgtaatggccagtgctatggaaagccaaggggagaggattgcttgaggccaggagtctgagaccaatctgggcaacataacgagactcttcctctacaaaaaataaacaaaaattagccaggcatggtagcatgcacctggttttttttttttttttttgagagggagtcttgctctgtcgcccaggctagagtgcaatggcgcaatctcacctcactgcaacttcctggctgattgggaggttaaggtgagaggatccctggagcccaggagtttgaagttgcagtgagctatgattggaccactgcactccagcctgagtgacagagcaagactctgtctcttacacaaagaaaaggaaggaaaaaaagaagaaaagaaaggaaaaaagaagaaaaggacaaaaaaagctctaaattaggccctggggctgagagcggcactttatgctgtgtcttagctgagttgtataaacgcctccagctgagatctgcacacacagctggagcttctcagcaccagggactccagctgataaagatgtctcctgtgtgagataagttcaggacagaagctgctcatgatcataagtcctccccttctgtcctaccactctaccctgcagtgacagggaaaagatactgttttctgctctccagtagacagcaggacccctctctaaatgtttggtttgagatcttcttgtgaaaactcctaatacaaaaacctgatagagcttggatagctggtatgtttgatatggatacaatatatgagatctcaccatccagttttctcactaaccataaagtctctgaataatttgcttttacatattcccttttggaaaaatcctacaaattttccaagaggaaacaggaatccgacttcagttgcaaagttaagatgcttttccattaaaaatgacaccatctcatctagtattacatatatatgatcttacgtgatactcactattctatcagataggttttctgaatggagcccgatgttgtgggtagtgtattgcttgtacgaaatgaatatgtcatgttggggtaactagattggatgagggtggagttaggcttcataatgaatactttctcatatggcccttcctagttttgaatcaacggtatttggaggccctcgccatgcttgatatcaaacagcagaagatggctcaggaaaacatgtgctgtgataaaagtggctttgcagaggcttcaggtcttgaggtaggtaagcatgcaggaaagctgaacagaagggacatttgctactttcctttctttctcccattgcccttgtgtacacattgtaggatagcacatacttagcaatttgaggatgggagtgagagacgcccctgggcccaggttggttcttccagttctgctggttccatgcccttcatacaggacattcttggacatgagggaatgtgctggccacttctgccccgtttatttctcatctttacagttctagcggaagctgtgttgggtaatgtctcacatgtgggtcggggcttaccgtttgagtgctttcatacaaattgttgtatctgatcttcatcggagtcttgtgagggctgcaaagcagatattatccccattttagagaagaggaaactaaggctcaaattagttcagttactttcctgaggtggcaaggtcaatctgtggtaaagccaggttcagaacaaaaatctgctggtgcaatgccaatggctggcaatgtgggagtttggctaatgaggtcagaaggggcctcacaaaaaaataatggagcagtagagtgatagggggcagccatgcacttcttgtagaacttaagaaggccgggcacggtggctcacgcctgtaatcccagcgctttgggaagccgaggcgggcggatcacaaggtcaggagatcgagaccatcctggctaacatggtgaaaccctgtctctactaaaaatacaaaaaattagccaggcgcggtggcgggcgcctgtagtcccagctacttgggaggctgaggcaggagaatggcgtgaacccaggaggcggagcttgcagtgagccgagatcgcgccactgcagtctggcctgggcgaaagagcgagactccgtctcaaaaaaaaaaaaaaaagaaagaaagaacttaagaaaaattggtaataataatagcaaatacctgcatagtcctgagcaagttcagatgatgttctaagaactttacatacattgacatatttagtctacacaactaccccataaagtgggtactgttaaaatccccacttcacaaatgaggtaacagaggcattgcggggttaggtaatttgcctggtgtcacacagctagtgcgtggtggagctgggatttgcagcctgtagacagagcttagagtctgtgcttttgagcaccatgttctactgccatgggtggaaaactagtataatagcaaaaaggaaaaatgcaagaaacagcttaaagaaagtttagggacagggtgttttatgatagtctcgagtagactatgggccagccttacctccagccaggcaggaacaagggccccgacacagctggtgagggagcactgaggtgaggaagtagcaccgggagtcaggggtcctggccgcaacccgttgtgattgatattggcccttcccaggtcttagttgcttttggcaacctaggcatgggagattatcaggagtaggaaaatgaaaagggaaaagacctttctgccacagatccaccatttgtacattcagctcaactgaaagctcactccgtgcttcacggttatcactgatgtgagaaagaatgttccgaaatggcctttacactaagggaggcagtggaattttcctctctgaaaagcctcttaaaaaggattgtattttatgtcagctcatccatgtgaaagtacagcaacaggggccgggcgcggtggctcacgcctgtaatcccagcactttgggaggccgaggcgggcggatcacaaggtcaggagatcaagaccatcctggccaacatgatgaaaccccgtctctattaaaagtacaaaaattagctgggcgtagtggcgtatgcctgtaatcccagctactcgggaggctgaggcaggagaatcgcttgaacccgggaggcagaggttgcagtgagccgggattgtgccactgcactccagcctggtgacagagcgggactccatctcaaaaaaaaaaaaactttatttttagtttaattttatttatttttttgttttgttttgtttttgagacagggccttactctgtagctcaggctggagtacagtggcacaatcatggctcactgcagcttagacctcctgggctcaagtgatcctctgacctcagcctcccagccaagtacctgggactacgggtgcacaccattatcatacccagctaatgttttttttttattttttgtagagacagggtctcatgttgcccaggctggtcttgaactcctgggctcaagctatctgcctgcctcagcctcccaaaatgctgggattacaggcgtgagccaccatacctagcccatatgaaactttaaaatatatgggccaggtgcggtggctaacgcctgtaatcccagcactttgcgggggctgaggcaggtggatcacctaaggttgggagtttgagaccagcctgaccaacacggagaaaccctgtctccactaaaatacaaaattagctgggcgtggtggtgtatgcctgtaatcccagctacttgggaggctgaggcaggagaattgcttgaacctgggagacagtggttgtggtgagctgtgatctcgccattgcactctagcctgggcaacgagagcaaaactctgtctcagaaaaataaataaataaataaataaatatggcacaggccagccgcagtggctcacatctataatcccagcgctttgggatgccgaggcaggtggatcatttgcggtcaggagttcgagaccagcctgaccaccatggtgaaaccccatctctactaaaaatacaaaaaaaaattagctgggtgtggtggcatatgcctgaaatctcagtttgaacttgggaggcagaagttgcagggagccgagattgtaccactgcactccagcctatgtgacagagcgagactccgtctcaaaaataaataaataagaataaaataaaatatatggcacgctatgttgtgtagattgcccctgtgaaattggtacatactggaatatgttgggaaagtatttgtggttagctttgtgtttgagacagagtcttgctctgttgcccaggctggagtacaatggtgcaatctcagttcactgcaacctctgcctcccgggttcaagcgattctcctgcctcagcctcccgagtagctgggattacaggcacccaccaccatgcccagctaatttttatattttttagtagagacaggtttcaccatgttggttaggctggtctcgaacttctgaactcaggtgatccacctgcctcggcctcccaaagtgctgggattataggcataagacaccctgcctggcccacttgtagttagcttttaaagtggagttttaaaaagtaaaattattatactacttttcttccaactacagtggtcaaccaagtataaaaataaaggaatcagaatctagtttattatttatttatttttgagacagagttttgctcttgttgcccaggctggagtgcaaggcatgatttcagctcactgcaacctctgcctcccaggttcaagtgattctcctacctcagcctcccaagtagctgggattacaggcatgagccaccacacccagctaatttttgtattttcagtagagatgggatttcaccatgttggtccggctggtttcgaactcctgacttcagatcatccacctgccttggcttgccaaagtgctgggattacaggcatgagccaccgcgcctggccagaatctagtttaaagagtttattcaagtacaaaagttgaggatggatcacccaaggagccacagattccaaagaagtcagtgttttaggccgggtgcgatggctcatgcctgtaatcccagcactttgggaggctgaggcgggcagatcacgaggtcaggagatcgagaccatcctggctagcacggtgaaactctgtctctactttaaaaatacaaaaaaattagccgggcgtggtggcgcctgtagtcccagctactcgggaggctgaggcaggacaatggcgtgaacccaggaggcagagcttgcagtgagccgagatcgcgccactgcactccagcctgggtgacagagcgagactccatctcaaaaaaaaaaaaaaagaagtcagtgttctaaagtgtagaagtttgtgctggcttatatggacaatgtttagggaagtatggacaatgtttagggaagtttaacagaatttcaacatcttttgatggtatggtttagtgcatagttacagagatattagttgaggtgatcgttttcttttggggaaggtatatttaacattccacactgaagatgtaacagccatggggttcttttcgaagtcatctgctctgagttaggtataagaagataagacagctaatctgtaacggaggtcagtgatggaagcagaaaggtctggtctctggtctctcctcctcatttacagaacaagagcaacgaggaagagggttactctctaatctagaagcagcatttcaaacatgctacctgactgagtctccagggcttaacttcacccttggcataagtttggatggtgctgaagttttattcttttacacaggaatcaatcgtatttttttattttttttaggagtggagggatgactgtttttctcattatatattacaattccctcgtcatttctgagtagatgactcagcttagaggaaactggcagtagtgaatgccgggcatcagggccacactgttacaggaaaggtatgctgtggatgttagcgttaaccatattgttaggctaaactcctgccaaggactcagacctataggagagtggcgccaggattaaaggttttaagagtgagatgaaggaaggtaaaattcccttttgtttgtgttccaagtcatgacattctttttgtcgtttgtagttaatttctatttgtattctgagatcccagtctcagctttcttctattttgtttttcctttccagtttttttggatcagatgcctgagtagtagtgtgcatgggtatgtgtgtaaatgcccctgtgtttgtgtgcagctaaaacagtgtgacacttaataacaggagcaatgcttttcaatttaaagcttgcggtcctcggagcctgcctttgtcatgggcccggagggaacccctgttcttgtgccagaatggcagcatccactcggaaactgcttcttcagctcaaacaagaggtattgcgttatcacaacagcaaaagctttagttttgtttctctgttaatagtagaataaatggaaatgtttgcaataattaacttcattttagtagttattgcctatggaacttatgcttagtttttatgtgatagcatcaacttatcaactggattttgtttacctggttccaaaatacaaatattaatagtacttggggcagggtgcggtggctcacgcctgtaatcccagcactttgggaggctaaggcaggcagatcacctgaggtcaggagtttaagaccagcctggccaacatggtaaaaccacgtctctactagccaggcatggtggcggtcacctgtaatcttagctacttgggaggctgaggcaggagaatcgcttgaatccgggaggcggaggttgcagtgagccgagattacaccactgcactccagcctaggcaacaagagtgaaactccatctccaagaaaaaaaaaaaaagtacttggcatgatatttgaagctacctaaagtcatttgcctaagttcataattaatattcctaaaatttatatgttctcatctatacatgtccctaaaattactatataatagaaggaaaatgtacatttatgcttaaaatcactaggatcagcaacactgattaatggagagataagcatggaatgtatttgaacagcagcaaggcacagtgaaaggaacctttgtcccagccagacctaggtttgcatctttgctccaccatttactagctgtgtggctttggacggggtaggtcttagttttcctactatattaagtggagggtaataactaccttggatgattgttgtgaggaaatagacataaaatgtttagcacagcaccatgaacatgccagacattaattcaaatgatagctgccattatatttggtctttacttacaaatacagtagtacatggaccataattctaaaatgttttacctttattgaaggtatggaatttaaagtccttaggtgtggcaaaccaccatggcacacatttacctaggtaacaaacctgcatcctgcacctgtatcctagaacttaaaatagaataaaataggacaaaattaaatttaaaaaaattaaagtgtttgggtttttttttttttttgagacggattcttgctctgtcgcccaggctggaatgtagtggtgcaatctcggctcactgcaacctccacctcctggttcaagtgattctctgcctcaggctcctgagtagctgggattacaggcgcctgccaccactcccagttaatttttgtatttttagtagagacggggtttcactatgttggccaggctggtcttgaactcctgacctcgtgatccacccgccttggccccccaaagtgctgggattacaggcgtgagccactgagcccagccaaaataaaatctttaaagtatataggaaagccaacatttggacagtagccattcattaagaaaagcatgagggggcaatgggttacacctgtaatctcagcactttgggaggctgaggtgggagaatcacttgagcctaagacgtcacagttacagtgagccgtgttcacatcactgcactctagcctgggtgacagagtgagagaccctgtctccaaaacaaaaagaaagaccgggcgcagtggctcatgcctgtaaaccagcactttgggaggccgaggcgggtggattacctgagctcaggagttcgagaccagcctgggcaacacagtgaaaccccatctctactaaaatacaaaaaattagccaggcgtggcaacatgcgcctatagtcccagctactcgagaggcagaggcaggagaattgcttgaacccaggaggcggagcttgcagtgagccgagatcacgacactgcactccagcctgggcgacagagcgagactccatcaaaagaaaaaaaaaaaagaagaagaagaaaaaaatagaagaaaagaaaaacatgagattacattgatcaaagtcaaggtcatctataagacgtatttgaaaggtcgtattcatcattattttcagtggtgtggtctggaatggcccaaagctgagttgaaatgcagcctttggtatcctcttatctttcatgctgggccctttgtcccaggacttgagcaggacacacacacagggcctgcatggggtagtgaggtccaggggttaggttagcaggcagttgacaggcaccacaagggaaactgataatctggatcagagtaagttgctactgcagaaatagcaagcattaattagcgtaatcagataaactagatcagaccacaggcaataaaccagtgctaggcagtgagattgcatatgttaatttgattccccattcagcaagaattgttctggttttgcctctgacacctcccaaactgtctttcaaaatcagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggtaactatgaattataatggcaataagtgggtgtaattttagttgttttgtttataatccaagttgatgaagcacacttaatccaatgtgggcaaaaataattgaaacttcacatatggttgtggtttacttaaaaacttagcaactatggaaaaaaaggagtcattggatattacatgtgcaggtgaactactggaatccataaaccataacataacaggaatatttattttctagtactcttctgtttcatttaaataagaccatgtttagtgaaaaaactttacaataaaagtgctaggtgattaaaaggaaactgccaagaaggaagtaatgtgaaaaatgtcacttaaacatgacattaaatgtatctatctaattaaactttattgaaatgtatgcttttgagaaggaaattgaggaatagaggaaaaaccttaagttggacaaattaataaaatattcttagaaaaaatgaagcagaagtttaggtttaggttttggttcacgaacccatcaaaaatttatggccaggctgggtgtggtggctcacgcctgtaatcctagcactttgagaggccaaggagggtggatcacctgaggtcaggagttcgagaacagcctggccaacatggcaaaaccccatctctactaaaaacacaaaaattagccgggcgtggtagcacatgcctgtaataccacctgctcaggaggctgaggcagaagaatcgcttgaacccaggaggcagaggttgcagtgagctgagatcgcgccactgcactgggcgacggaatgagactccatctcaaaaaaaaaaaaatgatcagtattgagtattattatatctgtgtattaaaaaatatattaaaatagcatgagagaattgaagtagatcttccagtatgaacaaagtagctgttattttttagaaatctgtttctctaagtagttcataccaatttttattcatcagtattattctgtagaattcatattgcttcagtttaaaatgtcaaattataatttgaaaccatttatcagttgagaaagaatcaagtgaagtttataagaattttaaatgttttgtagaaaaattctaggatgactgtatttctaaatattttcttatctgtcagatctataattctaacatctcttatattcaggtgaatttagaaagactaatacacatcttgtaatatttaaaatgatcttaggggaacaccatcatagaaaatatttaaaatggaacctgttggctgggcgtcgtggctcatgcctgtaatcccagcactttgggaggccgaggtgggtggatcatttgaggtcaggagtttgagaccagcctggccaacatggtgaaaccctgcctctactaaaaatacaaaaattagccgggcttggtcgcaggcgcctgtagtcccagctacttgggaggctgaggcaggagaattgcttgaacctgggaagtggaggttgcagtgagccaagattgcactactgcactccagcctgggggaaagagcaagactgtctcaaacaaaaaaaaaaaaaaaagaaaaaaaagaaaaaaaaaagaaacctggccatgtgcggtggctcaggcctgtaatcccagcactttggcaggctgaggcaggcagatcacctgaggtcaggagttcaagaccagcctggccaacattgagaaaccccatctctactaaaaatacaaaaattagctgggtgtgatggcactcacctgtaatcccagctactcgggaagctgaggcaggagaatcgcttgaacctggaaggcagaggttgcagtgagccaagattgcgccactgtactctagcctgggtgacagagcaagactctgtctcaaaataataataataatagtaataataataataataataaaatgaaagctttatagtagatagccattttgtttgaaatatttattttcaaacagtatatattactaatagtataggagtcagctgtcgtgaattttagtttcattaactaagctttcccccttttctttgctgaaaagggtaagaagtgatgcagagggatgatagaaatagaagcagtaaatcagaactacagagtagggaaatgcagatcatagaagctacatgtttggagtgttcattagatggaagccaggacaaaacaggaaaatataatgttttgtaacacttattctgagaaagtcattcatattttcttgaaattaatttctaaaaatgttttctgacacgaaacttttgagaaaatataatggctaaattcccgacagtgttttagtagcttttttttttttttttttgaggcagcatcttatcctgttgcccaggctggagtgcagtggtgtgatcatgactcactgcagcctctacctcatgggctcaagcaatcctcccacctcagcctccctagcagctgggacttcaggcatgtgccaccatgccaggctaaattttgtatttgtttatagagatgaggtctcactgtgttacccaggctggtctcaaactcctgggctcaagcggtcctccctcctcggcctcccaaaatgctgtggttacagatgtgatccactgcacctggccaacaatgtcttataataaatacaaaataatgtatttagataatatggtcattttctataataaactcttcataaaagctgaaggtacaactttaatgttcaatccaggttaggtgattttgccagggaaaaagctaacatggtccatgtatttagccttttaggaaccagtggaaaacactaagaatacctggttctaccacggaccacagctatgtgtagataatcttcctcagacacctcctctctcagctaagcccttaatagcagttggattgtaaaatcctctttgaggacagccctggtgttttgtgctaattgaaggcagatcttcttagaaagtcagattgtaaatatttgtttgttttgatagaggtggaaagaaaagtgatgggaaaaagaagagacgaaggggaaagtcagggttaaagtaatcttaatcttacgaatgcctgtcagaccctgtcacctgcctgcaaggcctgcaaccctgtgtggagcttggccattaggatagtgcagtgtagacaaagctgcatttttctcaagagctagattcatactcatttcagcacttgagaatatgtgcatttgatgttccataattcctaccttccacagtgtaagagacaggggaaaccaaagtgttttcctattcacacagcacttaccactcagctcagcgcttctgacaccagatgctaggggtgggggattccccacacaccagctgggtatcctatcatttccctcaattctcacactgtctacctggagttagagtcagatcccataagttaaaggctcagtcccacaagatggcctgcactccaaatgccagtcaaaagcacagagttgtctctgctgctcctgactgactggctgtatgtacattgggactcccatgacgccctcctcaggctccattgatttgctaggatgcctcacagaactccgggaaacacttccgtttaccagtttattataaaggatcttacaaaggatgcagatgaacagccagataaagagatggacagggcaaggcacgtgggaagggatgctctctttggcgtaccacccctcaggaacctcacatgctcagctatctggaagctccccagacccttttgggtttttatggaggcttcattacatggacacggtacatcactggccattggtgattacatcattggccattggtaatcaactcaaccttcagcccctctcgcttccctggagtttgggggctagggctgaaagttccagctttctaatcacaagattggttcccctggcaaccagcccccatcctgaggctatccaggagcccatcaagagcctcattagaacaaaagatgcttctattacccaggaaattccaagggatttaggggctctgtgtcagatgctcctagcactgaggaaattacagtcttaagaattgtgtgttaggaactggggtcaaagaccaactatgagaaaagattcacctaacacccctatctactaggattttaggagctctatgtcaggaactgagggcaaagaccaaatatatatttcttatattacaatatcacattcagctattgacaaatctaaggaagattcccacaaaaaatgcaattcagaggggtatagctcccaatctctgagttccagtaaggcactgagagagactgaaggcagaattttaaataattgatataggcagggcacagtggctcatgcctgtaatcccagcgctttgggaggctgaggcaggaggattgcttgagctcaggagtttgagaccaggctgggcaacatagggagaccctgtctctattaaaaaaaaaaaaatagccaagtgtggtggtagatacctgtggtctcagctactagggaggctgaagtgggaggatcgcttgagcctgggaggctgaggctgcagtgagtcatgatcccaccactgcagtccagcctgggtgatggagcaagaccctgtctcaaaaaaaaaaaaccaccaaaaactgatggccgggtgcagtggcacgcctgtaatctcaggactttgggaggctgaggtgggtggatcacttgaggtcgggaatttgagaccagcctgaccaacatggagaaaccctgtctctactaaaaatacaaaattggctgggtgtggtggcacaagcctgtaatcccagctactcgggaggctgaggcaggagaaatgtttgaacccgggaggcagaggttgtggtgagccaagattgcgctgttgcactccagcctgggcgacaaaagcgagactccatctcaaaaaaaaaaaaaaaaattgattaatctcgcacagcttttataaatctatacaagtttgagtagttctttctcagtttctcagtgacaagactttaattcattttattagtatatttcagtaatcttaagaggtacagggtgatacagattattttatgtttagtaacacttaatatcaactttctttttgatatggcagtttagacaagtttccggaagtagtttataggcatacttctttctttctttgtatttttgcttttgggtttttttttttttttttttatcttaaactcctgggcttaagcaatcctccagactaccagcttgagccatcacaccaagctatttctttttttagactgaaaatagggacacagattcatctactcatcaaagtgtcagtttctctgacttctgtttgccacagctcctcgtggaaggggtcagggccgccctcgtcactgtggtctgtcaggattggtgggaaggggatctcccctcatctgctctcagtttcccactaaaccacttttggagaatattccaaaaacattcttgaaattttccttgtacaatctgagattttataacttctgcaaattactttccttcaatggatgaagaaggacatcaatgatgtcagcacgtgaaatattaaatattatgctaatacctgagcagggcctttgacaattgtggtattttttgttgttgtcgtgatggtggtaaaatatatctaaagttggccgggcgcggtggctcacgcctgtaatcccagcattttgggaggccaagagggggcgaatcatgaggtcaggagatcgagaccatcctggctaacacagtgaaaccccatctctactaaaaatacaaaaaaattagccggacgtggtggcgggcgcctgtagtcccagctactcgggaggctgaggcaggagaatggcgcgaacccgggaggcggagcttgcagtgagccgagattgcgccactgcactccagcctgggtgacagaacaagactccatctaaaaaaaaaaaaaaattatatatatatatatatatatatatatatatatatatatatatatagtttaccatttgaactgtttttaagtggtattaagtatattcacattgtaatgtaaccttcatcaccatccagctccagaacattttcatctttctttacagagaccctgtcccatgaaacagtaactcctcacttccccttctccagcccgtgtgatttattatttaatggcacagttccctgagaagaaggtaatgctattctcattttagagatgaggaaatcaagctgagaaaagtcacccgaggtcatacagttagtaagtggctgaatgaggattcaagtccaggtctttgctgttcggaagcagagtttgcatggctcagaggccccctgtggcctgcagacatgttttgttaggttggcttagtgtagtcaaacaataagactagtggctgacatttagaattggaagatgtcatgacagatctgcatttctggctgctcttgaagactgtgatgatccagtgacatggactgtgttcttgtgtggcctgtgtgtcagctggcacagaggggtggctgtgccgcatggcagggcggcactcttgctgcctctcacctgcattgctcctggctctgaaggctgtgctctgctcactacattccactgtgtgctcctggactcacttgtcctagagatcaagttacctcttttgctggaagtatatcagtgaggatattttaatgtctcagctggattctcatgttcaattttaggatttccatcaccaaggagtaagaagaccttcgggcagagactgttgggtatgctcccttcagaaaacagttctaagaggatggaagaccaggacagtcctcaagaggtccttaagatgctcatagatttggttagtgtctttgcttttttttgcaggttatggttaagccaagcttgtccaacccacggtccgtggggagcatgcagcccagaacagctttgaatgtggcccaacacaaattcgtaaactttcttaaaacattatgagatctttttgatatatatatatatttttttagttcatcagctatcattagtgttagtgtatttttttgttttgtttgttttttggtttttttgtttgtttggtttttgagacagagtctctgtcacccaggctggagtgcagcggcgcgatctcggctcactgcaacctccacctcccgggttcaagcaattctcctgcctcagcctctagagtagctgggactgcaggcgcccaccaccacgcctggctaattttgtgtgtgcgtttttagtagagacaggatttcaccatgttggccaggctggtctcaaactcctgacctcaagtgatctgcccacctcggcatcccaaagtgctgggattacaggcgtgacccaccatgcccagccagtgttagtgtattttatgtgtggcccaagacaattcttcttcttccagtgtggcccagggaagccaaaagattggacacccctaggttaagctaatctatttgcttcctgttaattcaactctttatctctctagacttgcacttgccttctatgtccttttcccagttggagtaccagactctaccttcatgatctttatctccctcagctcatcttttctcgtcattcatattctttctgtgcaggtttaaaggctccatcttggaaaacagggggctcctgtagttaactccagccagctttgccatctacatttatatatatacagtttgtgacaagtctgcctgtttattgaggcatttttaaagtgttcaaggcatttcctcacacattatatcctttacagtcctgctacccacattccacatggaatgactaaactaagacactgagactcaggttatatgaacatacttatctctagactgttatatatttgcatacaaatatatgaaagcaattttatatacaaataacttcaacattattttataaatatgcacgttgatatattttttatatgttgatattatatacctatatatacacacttcatatagatctatattttcccttcatttccagatgacttgcaaaattttcaatgctgtcttctgtttttttttttaaaaaattatttttaaaaaataatcgtcggggctgggcacagtggctcatgcctgtaatcccagcactttgggaagccgaggcgggtggatcatgaggtcaggagatcgagaccatcctgactaacacggtgaaactgtctctactaaaaatacaaaaaattagccaggtgtggtggctggcacctgtagtccctagctacatgggaggctgagacaggagaatggtgtgaacccaggagagcggagcttgcagtgagccaagatcatgcaactgcactccaacctgggtgacagagcgagactctgtctcaaaaaaaaaaaaaaattgtcagcctggcatggtggcacacatctgtaattccagcactttgggaggccgaggcgagtggatcacttgaggccaggagttcgagaccagcctacaaaaattagcaaggtgtggtggtgcacgcctatagtcccagctactctactcgggagggtgaggcccaagaatcacttgagcctgggaggcagaggctgcagtgagccaagatggcatcactgcattccagcctgggcaacagagccagaccctgtcttaaaaaaaaaaagaattggccgggcacggtggctcacgcctgtaatcccagcactttgggaggccaaggtgggctgatcacaaggtcaggagattcagaccatcctggcaaacacagtgaaaccccgtctctactaaaaaatgcaaaaaattagctgggtgtggtggcgggcacctgtggtcccagctacttgggaggctgaggcaggagaatagtgtgaacctgggaggcagagcttgcagtgagtggagatagtgccactgcactccagcctgggtgacagagccagactccgtctc

SEQ ID NO: 36106 - DNA, 16706 bp, Homo sapiens
gtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccaggtactgggggcccccccgggggggcacgggggggacaggggggccgggccccgggctggcgggcgggcgggcgctcctcctcccctccctcccggctccgctctccggcccggccttaatccccctttgtttttccgcccgcccgccccggcgaagcggggctgctgaggtgaaaggaggcggcctcacggggtgcgggggagatagcaggccgcggggtgaacccgggggccccccagcacacacacgcacacacacacactcacacacacccttccctctcgctctgaaggggaagggaggaggccggtcgctgtcaccaccccgcggcccagagaaaggagggcgccgggccgctggatagcgcgggctgctgggccattgcgtgccggcccggtcccccacggtggggtgaggaggtccccaggtcctgccctgagtctcctccccgccacttcatccatctttcgcttgttctcttttcaccttcctcgtctttttgtgtgtgtgcgtgcgtgtgttgactttctgaccccctcccgtgtccccgcgaatagcgggtatccccaggttccccgccactccccctcaccgccaccacccctctcgtgtttacccagttgggggggcggatgttgtgagtgtgtatcccctccccaaactttttcactggatttacatttttttttcccaagtctcagccgagccttggcagctgacaccttctccctctgtccagctctcccgccgtcccattcagcctggggaatcccccagccgggccggcccggggcaggcggggagcggtgggggccgggactcctggaggcccgaccttctcccgaagcgcttttctttctcgcccacctcgaacgtttcctccaaccaagtggagagagcaaacaaagtccgcttacaaagcccccagatgagtcactctctgggatgttggtcttcgcttttttgcaagaaacttgaaagtgactgtagccgatgtgttttggcaattctcttgcccgcccactttagatgggggacccctgtttggcagatctaggctggaacttatttttttcctacttcgtttctgtttgcaaaacgaagcattcagtgggcagtagcgatgagctcacggggaaacttcggaactggaggaggttaggaagctcgtcacttttaagtgcgttcttcccgcctctctgagttattttcctttgaatacttcgtgaaatcccaaacgcgtagctggggcgcttgataccttttgaaactaacaggaacggatgcagaattttcaaaaaattattctcccagccactggattcatcctagtggagttaatatagagaattggataactcagaaattacctactgtgtagactggcctgttgttttaagacatattttttcaaatgtgggcaatttgatctttaagtagttatggaaatatatttgggcttcttaaaatctaaaatacccaacattatggaattcatgaacttcccccttttctcattctgatcagtgttgttttattgtactttgatgagcttgctaataatgtgataaaccaacttgaaaatgcattggaaaagaaatgatatataactagcatgcatccaggttggtgtaaaggtggcaaatactttccccagaaaaaagctcaaatggttattttaaaatatgggattgatgtgccactgaagtgattttcgtgtgattaaaaaccatattaagcatggtgtctatagagattgaaaaaaaaaagtgttcttcatgtaaaggaaaaacccataacacatctttggaaagctggttgaaaaatcttttgaaatacttttttaaagattatttttctcctgggtaaaacaaatgccaagcgtttattgatcaactttttaattagattttatattatttaatttttttcagctattaaaatctttttttccacctgatggagaagtgtgaaaacaaatatttaatcctgggcttggcaatgtgtgcagtgaaatttgttggaaaacttaaaatttagagccgagagcagttgaatgggtaaagagaatatttcagtcttttctatggaaaggtatgaatagacttaatcagttctggttttaagtaattttcactggggatatggagttaaattatcttgtttgtttcctggagcatcctgttgaatttatattttgaaacaatttaatacctgcttgctttccagataacttggtggaaagtgaaagctatagctattaaaatgtttgatggatgattcttctaacaggacattcaagatgtgactcaccgatgttaatttgttcagtacaaaatcttttaccctctggcactggagatttcatggtgccatatcctactaccctgggtgatgaaataacatttctgttttgtttcttgccagccccaggaaaaggaaagcttgggcagggttaaaaagccttgcagttgaaagagatgggatataaaattaaaactttggtttgatgatgctagtcaaataaaagcctacccagaagttatatttttaaaataaatcacttaactgaaggctggccgtggttgttattttactctgtctctcccccagagaagaagttgggaaaacccagttcccccttagaaggcttcttgtagaagtgtggggatcctaggaatcctcagagagtgattcctgtagtggttctgcagcatttcacccaagaagcagggacctggtgtgaccctcctgtgagagtgagcttcagcaatgctgtaaaaatactttatgttgccacagacatctgaattggtaaaatggcagtaagtgcttttagtactccatcgtactaatggttgtttagagttgaaaaatgcctctaaatgctataagtctgaactttgtccagaagatctgcattccctattatctgatctgttagcctttgaaattgtatatcttcagctatcttcagctattaactatttgtatactgtatggaaacgagtatcctacagccaggttggaaaaggggttacaactggagtccaaattctgtaaagtttctgctgatgtcacctgggtagatagacccttacatttacaggagcttcacaaattagattaaaagcggactgtaatttgctaggagcagttaagtccagaaagagactcataagtaaccacataatttctgagaatgcttccaggactcaaagggtgattacatcaaaattattaaattgaaactgagaactctggataccacacctcctaatcgtttgggggagactagttccaggcttaactgttatgctgccatcaagtaaacatagaagcaatgtgtggtagatgttcttacccatcagaggaggagctgtgagtgtgtgtgtgtttctctttgtttttttgtccttaagttagctgtgggacttgtggttatagagtaagaagggtaagtaaccgtctaaagtgtctaaaatgatgggatgggcccctagtaggacattgtatgcttaaaatatttgaaactcctcttgagtgcatgcatcttattaggattacaaaactcaagcataggggcttgggctcactgtcaagagtttcaaaaataatgttggtaaagaacaacgtattaggaagaactatttcaggaattttttccatcatttcctaaatgtttatcagtatggagaattttgaaagtatcagaaccaagagagtaactactcataaatgtcaagaacctgatccatggtgaaattttggtttcattgcggctaaaagaatttccagtgtgcagcctccagttttgggagtggagaagcacatcataagagcaaatgtctaatactttattgaaacctacaactgctggaagaagatgaatatgaaaggaatttaagtgtttatagtttgtttttctcattagtctgtctttgagagtttgggatttgaacagatagtgttgctgaaagatgcagacttcagtatacaattaaatgacctgagaaacaactgacaggtgtttgctatgggctgccttcacagatgccttccaggttgcttcatagcagattttgtttcaaccaaaccttttagtagagtcaagtgaaaacttaacgttaacgactagcaaatgtatttagagaactagatttctttcatcacttagcaacagccccttcctcaatctgagttttctgatagaaagacatgatgcttttcttctggataatagacaaatagatgattgtgttattgcatgtatgtgagtgtgtatgtgtgtattgctgcagtaaggtactattaaatacttaaatctggagtggtttttttaagtaagttatttaaacttggtttcagcgctgacagactaatgcaaactgatttcatcagctggtctgtcccttatgaaccaggatagtgtgtagtttagtcagctgtttaaaagcaagatcactgtcagcaacttagttgcaaaagttttgtgtctgcacagtgatttttcaatgctttgtattgtgagctcttagagtaactaggtggttgctggattaccactgcagagtagcttataggttctttgactgtttcttctggtctctattgtctggagcatgttgaatttcgaaggccattgtgagaggctgagtttctgaagtgtaaatgtttggttttaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggtactgcattttgctttgctttgctttgcttcattatggtatcagtgtacttcagttttgtctccatgtgatctagaatgtttatgtgagaacagatgtgggcagacctgtgttattagaggagattggtgatagataagtattaacacctccaggtctaacctcagtttggtgtgattgacaagtggtgacatagtgattaacctgtttttttcacttaacaagtgcctcggtggactcaggctttcatttggcacatggatacttatcactgcaaaaccaccagttttcagttcagttgggggactagacatgaggctcactgggcaaattaaagtaacatttcttggaagttgggatgaccttggatactcttaattaaacttttagaatgttttttcatttttctgagagcaccaacatttcactaattttcatttataaaagcttttagagttaatatagtggtagctgtttctggcaagtgttaagactaaaacttcgggtattttgtaattgtaaagaatcaagacctaatatgatttgatgttgactaggagagaaaattaacaggtagaggcctaagactttgttcatggtaagagagggaaggagacttgcaccgggggagggaggttggtaattctgctagctttccctaaaatgcaccccttcccaatctgccaagcatgtgagcatcacataagtagcatttctctatgtgttcgattatatcttctgttgaaactctctttttcacaggcctgaccacttaagctgtcatgtaaaacatgtccattcaacagaaagacccttcaaatgccaagtaagagttaaaatgacttatccttagtgtagcacttaatgcacattatccagaaggtctgagccagttgaatctcaccattcttgaatagtcttaaaatcactgacctgagtaaatgtggcccatttgacttctagttttataaaatataactgacagcttctgtttctgtaaagcaagatcatttaaaaatttaagcgtgttgttttttttaagctatatttccctttctttgggcaatagtattttttgttaggaaaaaaaagttacagtcttgcaaaggtggttgtgtatttgaaatgaataaaagaataaagggctttaatttctgggttgattattgaagttgttttaactgtaataggagaaaataatgaatttttctcccaaatgttaccacttactagatttttgtttgttattaccaaattggaacactttctagttgtttaaaaatctattccagttaatgattttatttgacatcaattataataacgaaaacattaagaattttgctaaatcaaatgactgttttaggcattggtaattttagtttgttgctggaagtcttttagtacacctttcagttaagtttgttaatgactgattttattaagtaaatgatttgaatgctaagaaagatctaattggaggaaggaagctagtgtcattgagtgagtgcctgctgtgtataccaggcttttcttaatccaccagtaattttgtgagagatgttatccccattttacagatgaagaagctttcagataggttaaccaacttgttcaacattacaccatttagtaaattgtggagctcaacttaaacccaggtttaacttaccctaaagcttacattttttgtgctactctgtgttgatgtattttcttccttcaaaatggaagagtctaaaatttatcaagagttttattatgattatgattctaggtaacatatgcaattaaaattcaactagttgtcagcttgctgatgtggatagggtaatgcacagaatataacgtacttcaaaatgagtagaacaggatagtctatatttaaaaaaagttttcctccctcatgcagacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaagtaggtggtgcttcagattttctttcttttatatttcagatgggtgaaatatgcatgttttcatattgtatcaaaggtattaatattcaccttacgtgtttcctcctattgccaacatgtgcaaacaggcaacaatggacagagtatattaatgtcagaactatgctttactttcatgtatgcaaacagcattgataagctaataataacctttaaggtgaaagcagtattaataagcttgcttttcaaacccaaatctgtagagaaatgagatatcatatccacttgaaggtttaaatgctttgcttgccttaaattcagagttgaagatagaatacttgcatttacccaggctttttcttttaagattgccctaaccactagaagaaggcattttcctaatcctttattctattatatatgtactttatgcagtagaaacatcaaattctcaaaaaaataggtggccacaagagaatggggaagaaagcttaatgtgtgttaatctatccatttttacttctttgtaagtacactgggtttgtaagtacacttctttgtaagtacactggtatgttgtactttataagcattcacttctgttttttttgtttttttttttttttttttttgagacggagtcttcacactgttgcccaggctgaagtgcaatggcacgatctcggctcactgcaacctccgcctcctgggttcaagcgattctcctgcctcagcctcccaagtaactgggattacaggtgcacactgccatgcccgattacctttgctactttttttgtattttcatagagacggcgtttcaccgtgttgcccaggctggtctcgaactcctgagcccagacagtccacctgcctcggcctcccaaagtgctaggattacaggcatgagccactgcacccggcctataaacattcacttttagtgtacattattgtgatcaaataaaaaattttgttgaatgttgattagtcctatattaataatatcaaacttccatttttaaagacacttgctttttttttttttgatggttttttttttatagcaaagagtccttttctcttttatattgatttttgctagttctctagactttttagtgcttgtttattttgaccaatatagacacagcagcaaaaaagatgcacttactaagagctatcaggttaaatggttaagatcacagaagcatgagaagtcaattttgaaaaaaaacggcaacagttttacaggtagatacagtgtttttggtttgtctttgtaatagcatgcatgagtgaagagaccagtaaccaaaagcagcagcagcagcagcagcagcagcagcagcagcagcaacaacaacaacaacaacatgtgacaagctggccagggaagcaagtagaaacactgagactgtgggaagaagctgttaaagcaaggaagaaaggtaaggcacagcttccagtgttgaaaatatggctagagaagtgttttcatttagtatgccaagtgatcaaagtagagaagccacagttttaggaaatctagcttaatggaaacatggaaatagtgcatgctgggaaatatctggtaaagtatagttattggcaataaagtgtccagataagttattactaggaattaaaagttctcagtacttcctatcatgttctttcttttgatgtactttttgctacaaacctggatccaaatttggtcctttgctatgctcagagttgcatttttatattcaatttgatgtcaacctccatgcattatgggctttttttttcctttctaaaatattcccacttttagaggtggatatccttgtgtgtacataagttcattttcttacaactgtgctatttttgctctgtagtgttctttttcattgtattatttattacatgtttcagattctgtagtgttgatgtcttttctcttggtcacacccttaatctccttcagtctatcactggctggccttaacatatctagtcttctgctgctgaggactttactgtaattgtttaaaaaattttaaatggtttgcttttctctcgtgtatattttctaacgaatcagttggagtatcagttttcaacgtacttttcaacttactagtacagctttggcttctggactattgtgcagccatttcaaatgaatcattttgtcaatgtatcatgagccaaaggacagatttgtaaattccttcttcctcctccacctctacaatgtcttactatgttaaatgttaaggaatcctctatctgtgggctcctctgtatgtaattccttttctgtgtagtttcttccatcttttgctttcatgtagtgtggctcttcccttcctcagagtgatcccttctgttttttttttttcttttttagacagagtctctcgctctgttgctcaggcttgagtgcagtggcgtgatctcggctcactgcagcctccgcctcctgggttcaagtgattcttgtgcctcagcctcccgggtagccaggacgacaggtgtgtgccaccacacccgactaatttttgtatttttactagagacagggttttgccatgttggccaggctagtcttgaactcctgatctcaagtgatccacccgcctcagactcctaaagttctgggattacaggcatgagtcaccacacctggccagagtgatctctaaacctcctatacttggataaaaataaaaggaatagcattctttttttttttttttctttttttgagatggagttttgctcttgttgcccaggctggagtgcaatggcatgatcttgtctcaccacaacctccgcctcccaggttcaagcgattctcctgcctcagcctcctgagtagctgggattacaggcatgtgccaccgcgcccagctaattttgtatttttagtagagacagggtttctccatgttggtcaggctggtctcgaattcccgacctcaggtgatctgcccgcctcaccctcccaaagtactgggattataggcgtgagctactgggccctggcgacattctttttcatacatttactggcattggaagaaaagaatgcagcagtccgtataggcttttcatcattcctcaggtgctgcttgttcctagcttccatctgaagatttgtcattattttaataaaatgttttggccaggtgtgatggctcacacctataattccagcacttcaggaggccaaggtgggaggatcacttgaggccaggagtttgagaccagcctgggcaagatggcaagaccccatctctacaaaaacaacaacaacaacaaaaaattagccggacgtgacagtgcgtgtctgtagtccccgctactcaggaagctaaggtgggagggtcacttgaacccaggagtttgaggctgcagtgagctacaattgcatcactgcactccagcctggacaacagattgagacccccatctcaaaaaaaacaaaacaaatgaacttttgtgttagaatggggagaggggacgggcaatggggaggaaaaagtgtagtgctgtgataattgtatagtgggttgaaagtatattatgaagggtattttacttagagaaggagtaaaaatgtttaagtcatagtaaaaggacactcttagattaaaaagaaaacacggaggaggaggtaagggggtcagcagataagagagtaaaaattctttggtgaaagcaggtggagaatatcctcagcaatactcccagcaccttaaagtgaattggttttctctctcaatctctctcggtgtactcctctatttggtattgtatttcaatttgcttgcacaataagacttggttgtttagctcatcttctgacttccatgaaacaaaatgttattgtattcccatttgtagcgtgaatctctctcaaaaagaccactgatcttagaaacctctgtattcatgttagtaaatgtcacattttagaggagaggagactcctgacctgaaaatctaagcttgaatctataacgtcctttaaatattaggcctaaataaggtaacataagttttcaaacctgatcgacaatcatattgtctgggaagctttttaaaaatacacatttcccaagttccatctaaatttcactattgattctcctggagtcctttgtttttgttttgttgggttttttttgtttgtttgtttgtttgttttgaagtcctctagatagttgattttgataatcagccagatttgggaatccctgatagggagaatggtgtgtgccaaagttacattgtattgatcaagtaagggctgcttgactcaagggtccccctgcggtgataagacctttgtggatcatatacagatctctatctttagttcaagtatatttctccattttgatagccaagtcacagctagcctacccatcattttactgctgttttctggtgctgaattttgttgaggggtgggttggggatgtcaccttgaggggaagtattttttaagaagtgtctagacctggctcacaccttaatcccagcactttgggaggctgaggtggacggatcgcttgagcctaggaggagaccagcctgggcaacgtggcgaaacccagtctctacaaaaaacacaaaaattagctgggcgtgatggcatgcacctgtagtcccagctacttggtagactaaagtgggaggattgcttgagccttgagggtttgaggctgcagtaagctttgatcatgctactgcactccagcctgagcaacagaaggagaccctgtctcagaaaaaaaagtgtccaggttttgttggataagaaggaccagggtcctctaactcactgcagggtctccttgcctagctagttctctttggtatgcttggtggtatgtgtaatatgtagagttaaagatactaggcataaaataggtgattgtgtcaacatcagaaacaagaagaaatgggagtgaggagaacatgaacttattgaggagtatttttttctttcctaatgtagttaagaaacataaccagaaagaataagattatttaactgaaacatatttctaaaactgaaacaaacatgatactaaaatagcttgtttatcattccccaattatgcatttttaaaaccttcacagaatgtggcttcatgtctcaggctttaacatacttattgagtatgcacacctctctctgctagttacagtgtgccttacgagaagatttttctgattatctgttattgtgtaaccattggcccagctctgtgtaaacaagctctttagcctggcctgctggaggttggctcttcccaagaaagtttttagaactcagaggaactgcatgaagtagtagtgagaacacttagccctgcattgcagaagttaactgatcctctcagcatcactgtgaggtaggtaagtaaatctgaacttgaaacctaaagtgcaaggctaaacaagttgcttaagtccttgcaggaggtatagcatcagaaggtgattcatacactgggatccctggcccccaggcttgtgctcagaaagatcctctgttctgttgaccgcttgatagaaaactggaatttgatttattaaatgtttgacatttttaatgaaaagaaattgattcagaaactttgtgaattttgctcactgttttgagaatctaaagaccctttttcttcttattttagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaatgt

SEQ ID NO: 36107 - DNA, 768043 bp, Homo sapiens; identical to SEQ ID NO: 35581
  misc_feature (106202)..(206201): n is a, c, g, or t
  misc_feature (390258)..(490257): n is a, c, g, or t

SEQ ID NO: 36108 - DNA, 27563 bp, Homo sapiens
ggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaagttgtgtccttgtttataccaaacttcatgtgccttttcctgaacctgaagctgtgggaaggtctgggggcagggccgcatcaccgaccttacgtccaacctcaggactgcctggagcaagagccctggggttggggacaaaggaggctgcctggacctgggtaagggaaggggctggaggagaatgagtgcaattccctgcccttcacagcctgcaatcggagctgtgtttttgtttttgagacagagtctcgctctgtcccccaggccagagtacaatggcgcaatctcgactcactgcaacctctgcatccctggttcaagcaattctcctgcctcagcctcccgagtagctgagactacagttgcctgccaccatgtacggctaatttttgtatttttagtagagacgaagtttcaccatgttggccaggctggtctcgaactcctgagctcaggcaatccgcctgccttggcctcccaaagtgctgggattacagccactgcgcccggcctgaaactgatctttatcctcctcccagttcctactgtgcaccagagaccctccagtctctaatacctttgacttgaagagcagtcatttttttttccttttcttttcttttcttttttttttttttttttttgagatggcctcactcttgcccaggctagagcgcactcgtgtgctccatttacggctcactgcagccttgacctcccaggcacaggcgatcctcccacctcagcctccaaagtagcagggaccacaggtgtgcaccaccacacctagctaatattttttatggtttttatagagacagggtctccctatgttgcccaggctggtcttgaactcctggcctcaagtgatcctcccatcttggtctcccaaagtgctgggattacaggtgggagccaccaagcctagtcaacagtcacttttattctcacttcactggagaggaaggctcagaggctagtaagtggcccaggagcatgctggcagtgataaaacctgctggagtgacattttcccactggctctcaatcctggatatatattaagagtcagaggccaggcgcggtggctcacgcctgtaatcccagcactttgggaggccaaggcaggcggatcacgaggttaggagatcaagaccatcctggctaacacagtgaaaccccatctctactaaaaatacaaaaaaaattagctaggcgtggtggtgggtgcctgtaatcccagctgaggcaggagaatggcatgaacccgggaggcggagctgcagtgatccgagatcgtgccactgcactccagcctgggtgacagagcgagactcgtctcagaaaaaaaaaaaaaaaatgagggagaactttttacaatagcaacgggtgaacctcacccagaccaattaaatagaatcaccggagatgggtggctttaaaaaaaggtctccagaaggcctggcgcggcagatcacacctgttatcctagccctttgggaggccgaggtgggtggatcacttccagcctgaccaacatggcgaaaccctgtccactaaaaacaaaattatctgggtgtggtggcggacatctgtaatcccagctacttgggaggctgaagcaggagaattgcttgaactcgggaggcagaggttgcagtgagccgagatggctacactccagtctgggcaacaagcacgaaactccatctcaaaaaaaaaaaaaaaaaaaaaaaaaaaaaacagatttccagatgaccagtgtgcagcccgagccgagagtctgctttagaccagagctgctcagactgtaatgtgcatgcaagtcattgagggtcgagttaaaatgccagtagattcagtggctctggggtggggccccaggctgtgttgctatcaagcctccaggtggtaccactctactcactgcagaccccgtaggcagtgtggtcacttggtcaattgccatttaagactcactaggggccaggtgtggtggttcacgcctgtaatcctagcactttgggaggctgaggcaggcagattgcctgagctcaggagtttgagaccaccctggggtgaaaccccatctctactaaaatacaaaaaattagccaggcttggtggcatgtgcctgtaattccagctactcgggaggctgaggcacgagaattgcttgaacctgggaggtaggtggacgttgcagtgagccgagattgtgccacttcactccagcctgggctacagtctccaaaaaaaacaaaaaagagattcagtatatcagctactcacagttgaccctgaagatctctgggaagtagtgactcatgactcgtttatttattaagttttgctgtagcagaagtttacttttgagccaagagtctgatccggtctccctcttttttttttttttctttctttaaagagatggggccttgctatgttgcccaagctggtcttgaactcctggcctcaatccatcctcccaccttcggcctcccaaagtgttgggattacaggtgtgagccacctctctcaggcaagagcccctcttttaactagacaatgaacctggtttctgctttggacaggctatttagttcctgcttatttaccctcatggtgggagagaccctggtgggatttggggtgaaagctggctgtggttcttgcaggagcctcatgacacctgagggaggtgtgatcaggcaagactgggcctctacactgagagccgactagggcaggtctcagaagcagagactgaaggaagttgggtggatgagtggatctggggagcaggggccaagcctgagggctgggcagagccttccaaaggtcaacacaatccttgctattgtcttttgagggccctgatctattttaagtaaaatgctctaactgcgcatgtcatctggaaggaaaccacaaaaaactcaatctgagacttgtcaccaatgtgctgcctgagtcaaagggtttccctggctcacctccatagatggcgagggtagaaggcaagacctgtcctgggtggtctaggcagaaggcccaggtttagggcatggcaggtgggtggtcagggaggtgaggtggggtcctggtgctgatgcaggggcagttgccgagggcttggcctcagaacaaggcaggagtccagccatgaggatgactcttgctgagtcactgagctgggcgaggcattcagaccccctgactgggcccagctggggcggcagatggtggagaggcctcagctgtggggggtgttggggagattatccactgatgaaccaaatggaggctgttcccagagcctgcttccaaccttgcacggccttctagagttcaaatctttcctgggggggcctcagagccctgtccatacctccgctcacagccccagcccttcctcttctcccatctggtttcctggccaggtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataagggtgagagccaagatccaggcatcctggctgggtgcggtggctccacctgtagtcccagtgctttgggaagctaaggctggatgactacttaagaccaggattttgagaccagcctggacaacaaagaccttatgcctacaaaaaattaaaaattagctaggtgtggcagtacgtatctacagtcccagctactcgggaggctgagatgggaggatcccttgagctgaggagttcaaggctacagtgagctgtgatcactgcactccagcctgggcaacaaagtaagaccttatctcaaaaaaaaaaaaaaaaaaaggccgggcgtggtggctcacgcctgtaatcctagcactttgggaggccgaggcgggtggatcacaaggtcaagagatcaagaccatcctggtcaacatggtgaaaccccgtctctactaaaaaaaaaatacaaaaagttagctgggcatggtggcaggcgcttgtagtcccagctacttgggaggctgaggcaggagaatcatttgaactggggaggcggaggttgcggtgagccgagattgcgccactgcactccagcctggcgacagagtgagagtccatctcaaaaaaaaaaaaaaaaaaatccagatctaggcattcccagccctctggactctaggaagtcgtctttccagaacagagccccgtattgtggagcaactggggggtggaatcaaaggtgagcaggacagggctataggaagaaaagacaaggtccccataagagtggcgagaggaacagagccaggacatcggaaagcaagcccctgtgttcccaaaccgcagaagagggagctctgatgttagacaagccaccctcctacaagcgaagggaaagtaactttgagcaaaaatgagcaacagaaaatgagatcaaggtcagatctcatacaaagttgcaagatgaaagaatgagcagcagaataacctccctgtgatgtggaaagtgtgccaggaaaacagacccaaactgtaacctctttcagaatgaggcaaggcagtgaggaaactatgtgaaaacacgaaagcagccgatcagagttgtaagcccgggcagtctgggttggaatgggtgccccgagccacgggaccatgatgcctctctagaaagacaggaccaggcattccaccagggttctagtcccaacagcaccactaacttgcttgtggccctaaaggattcattgtccctctctgggtctcaactatttagagctctactgtccagtatgggatcaaccagccatatttggcaatttaaattaaaattagctgggtacggtagcgtacccctgtaatctcagcactttaggaggctgaagcgggaggattgcttgagcccaggagttcgagaccagcctaggcaacatagcaggaccttgtctctgcaaaaaaaatgaaaaaattagctaggcgtggtggcacatgcctgtaatcccagctactcgggaggctgaggtgggaggatcacttgagcctggaggttgaggctgcagtgagtcatgattgtgccactgcattcctgcctgggcaacagaacaagaccttgtctcaaaaaataatttaaaaatttagttcctcagatgcattagccacattttattttatttttttccaagacagagtcttgctctgtcgcccagggctgtagtgcaatggcgagatcttggctcactgcaacctctgcctcccaggttcaggcaattctcctgcctcagcctcccaaatagctgggattacaggcacgtgccaccatgcccagctaatttttgtatttttagtagagacagggtttctgcatgttggccaggctggtctcaaactcctgaccttgtgatctgccgacctcagcctcccaaagtgctgagattacaggtgtgagccagcatgaccggccattagccacattttaagtgttcaggagccacatgtggatgtggctagtccaaagacagcacagatttagaatattctcatcattgtagaaagctctattggacgctgctgagtaaaagggtttttttggtttggttttgagattggagtctcgctctgttgcccaggctggagtgcaatggcacgatctctgctcactgcaacctctgcctcccaggttcgagcaatcctcctgtctcagcccccctagtagctgggattataggtacccgccaccacaactggctaatttttgtatttttagtagagacggggtttcgccatgttggccaggctggtctcgaactcctgacctcaggtgatccacctgccttggcctcccaaagtgctgggattacaggcttgagccaccacgcccggccaagttaaagggtttttaaacaagagctgggcagtgcaatggcatagctgtaaggcagcagggggtggtggggactgtggtaggtgggaaagcttgtgttccatctaaatggggcagctgctgcttgactgtaggctgtattgctggtcttctaattcttcaagtgaatcaggaattgggattttgtgaagactcacaatttctaaacaaaaagttgaagttttacagatcgtggggctcaagtataactcctcttgggctgtatccagccttgattctgtaatctgtggctcctgcctgtttttcctcggccaggccactcccttcttcccctcacttatatttttcacctggggttggaggctgggtagatggtggaattgatgaggaaccacttttttttttttttttttgagatggagtctcactctgcctctcataatgctgggattacaggcatgagccactgcacctgtcctggccagacatttttgaggccaccaccagacaaaagaggctcctcatcggccaggtgtgatggctcgcctataatcccagcactttgggaggcagaggcaagaggattgcttgaggccaggaattcgagaccagcctaggcaacataatgagacctcatctctccaaaaaaaaaaattagctagacatggtggcatgtacctgtagtctcagctacccaggaggctgaggcatggcttttgtgagctatgattgcaccactgcactccagcctgggtgacagagtaagactccgtctcaaaaaaaaaaaaaaaaaaaaaaaagtctgacctgagtctcttaaggatgaggctctggagcacctagtaaacttggtcccatttgtgtgactcaaagggacatgtccaaagtccaaagtgctgggggcaggggtggggcttaggtagggcatgtgacattcctgaacaggccaagcactgggtgaaactactcaggattcagaagcaggtgggatgggtgggtggaacatgataatcatcccccttctccttcctttccaccctacccttgctcacaactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgcggacagggaagggtgcagtggcctggctggaggaggtagggccgtatcccacccagagtctgtcaccagattcatgcctgccccaccccaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggtacctggtttcctcactccctatgccccaccctacctgtcctccacctgccttgggctctatactgctgccttcttcttctttttttcttttcttttttgaggcagagtttcactcttgtcgcccaggctggagtgcagtggcataatctcggctcactggaagctccacctgggttcaagtgattttcctgcctcagcttcctcagtagctgggattacaggcacccgccaccacgcccggctaatttttgtatttttagtagagacagggtttcaccatgttggccagtctgatctcaaactcccgaccccaggtgatccacctgcctcggcctcccaaagtgctgggattacaggcatgagccactgttcccggcctgtaccgagttctaaagggaaaacaaaccagggcagtgggaggggtggggagagacacttgctggctctcaccaagggtggaattgactcactgtacctccactcacctccagccacccccatcctccacacatgccccaaacacacctgcctcttttctgagaactgttggcccatctcaccttcccaggctccagagcctaccagaagtgcccagccagtctggcattaaatgacatgtgccaaggttaagcagttcattcacccggtgccagacactggtgggcagtgccaaagcagcagtgacaagcccaggccccaggctgtgcctgttctaggagaagccatcacaggcctgaacctacagccaggctcttgtccccgttggcctcaggcctgggcctgagcaggtgggtgtcccaccttcattcctttacctgttcttccacctttaccttctggccatttaatggttttgggttttttgtttgtttgtttgtttgtttttaatagagacggggtttcaccgtgttagccaggatggtcttgatctcctgacctcatgatccgcccgcctcggcctcccaaagtgctgggattacaggcatgagccaccgtgtccagccccatttaatggttttcttactgactttactaaccagtgctgcttgatcctgaaagcataatagcagaacatggggaacttttagagacattcatgtccacttaggtgcagacagtttgggggaagaagtgtgtgtgtagagagaaaatgaagaatgattaagacaataacccttaaggaatccaagtgaaaagtatatagggattcttgtacctttttttttttttttttttttttgagatggagtctcactctgttgcccaggctggagtacagtggcataatctcggctaactggaagctctgcctcccaggttcacgcaattctcctgcctcagcctcccgagtagctgggactacaggcgcccaccaccacacccggctaactttttgtgtttttagtagagatggggtttcaccgtgttagccagggtggtctcgatctcctgacgtcatgatccacctgccttggcctcccaaagtgctgggattacaggcgtgagccaccgcgcctggcctttttttttttttttttttctggatctccccctgttgcctagacgagagtgcagtggggtgatcatagctcactgcagcctcaacctcctgggctcaaacgatccttccacctcattctcccaaaatgctgggattgcaggtgtgagccaccaagccctgcctaagctttcattttaaatatgttcagccgggcacagtggctcacgcctgtaatcccagcactttgggaggccaaggtaggcagatcacttgaggtcaggagtttgagaccaggctggccaacatggcgaaaacccatctctactaaacatacaacaattagccaggcgtggtggcatgcgcctgtaatcccagctacttgggaggctgaggcatgagaattacttgaacctgggaggcggagattgcagtgagctgagattgcgccactgcgctccagcctgggtgacagagcaagactctgtctcaaaaaaaaaaaaaaaaattagctgggggtggtgacacacctgtaatcccagccactcaggaggctgagacagaaggatcacatgagcctgggagattgagactgttgtgagccatggttgtaccactgcagtccagcctggatgacataggaagaccccatctccaaaaataaaaaaaagccagctcttcctttgagccccagtttcagttcaaagggccttctctaacttctccttcatctgaactcctgagacagggtcttgctctgctgcccaggctgaagtgcagtggtgcagtcatagctcactgaagccttaacctcctgggctcaagtgatcctcccacctcagcctcccgagtagctgggactacaggtgtgcgccgccaccatgcctggctacactttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggtaagttctgtctccatagggctccctgccttcctgtcatagccctgataccttctgaccatcaccttccctccccaggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgagtagctgggactacaggcgcccaccaccatgcccagctaattttttttttttttgtattttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaacttttaaaattcaactggggtgggggtttggcctcaaaagaatgaataagaggaccgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctggatcatctgaagggttaaatagtctttctggggctgggcgcaatgactcacatctgtaatctcagcaatttggaaggctgaggcaggaggatcacttgaggccaggagtctgagaccagcctgggcaacacagtgagaactcatcgctacaaaaaatttaaaaattagctgggtgtagtggagcatgcctgtaattccagttactccagaggcgctgaggcaggagaatcgcttgaaccccagaggcagaggttacagtgagccatgatcatgccactgtgctccagcctgggcaacagagcgaaaccctgtctcaaaaaaaaaaaaaaaaaacaaagccggtcgggtgcagtggctcatgcctgtaatcctagcattttgggaggctgaggtgggaggatcacctgaggtcaggagttcaagacaaacctggccaacatggcgaaaccccatctctactaaaaatacaaaaattagctgggcatggtgtcacccacctgtaatcccagctgtactcaggaggctgaggcaggagaatcgcttgaacctaggaggcggaagttgcagtgagctgagatcgcacctttgcactctagcctgggcaacaagagagagactccgatttaaaaaaaaaaaaaaacaatccctggattggtagaaattgtctctgagatctgggagcattgggagcatttggtggccaatggggctcgcagatcccctgaagttggaggcaggtcactcaaatacccaacatgttgctctgcagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggtgaggtccctacacccccacagaggactgccctgggagatgtatgtcctctagtggcatgaggccctctgccttctctcctccagacgcacgttctaggaacaccttctgtgcctttgcatgcttagttcttacacacctgagacactggcccatttgattcctggcagcctctgacttacccctcagacctgaagttaattccccttctgggaaggcctcctggctacccgctgcctgagactctgaaactctgatacagtcatgcgccacttaatgatggggatacattctgagaaatagtccttagatgattttgtctttgtgcaaaagagtgcacttatgcaaacctagatggcacctagtctagatggcgtagcctgcccctaggctgccaacctgtgcagcatgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtggatcacttgaggtcaggagttcgagactagcctggccaacgtggggaaaccctgtctctactaaaaatacaaaaattagccaggtgtggtggcacacacctgtaattccagttactcgggaggctgaggcacgagaatcacttgaaccctggagatcaagcctgtggtgagccgagatcgtgccactgcactctagcctgggcgatagagtgagactctcagaaaaaaaaaaaatctccattataatcttacgggaccaccatgtgcagtctgtaatggactgaactatcatgcagtgactatatttcacatctttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcactccagcctgggtgacagagcaagactgtctcaaaaaaaaaaaaaaattagaaataacccaaatgtacatatataatgaatggataaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagctatttgggaggctaaagtgggaaaatcgcttgaccccaggaagtggagtgtatagtgagctatgattgtgccactgtactccagcctgaggcagtagagtgagatcctgtctctaggaaaaacaaaaaataatgacatacgtgctacaacatggataaaattgaaaatgttatgctaagtgaaagaagccagctggacgcagtggctcacgcctgtaatcctaacactttaggaggctgaggtgggcacatcacctgaggtcaggagttcaagaccagcctggccaacatggtgaagccccgtctctgttaaaatacaaaaattagctagcatgatggcgggtgcctgtaatcccagctactgctcgggaggctgagacaggagaatctcttgaacctggaagacagtagttgcagtgagccgagatcccaccactgcactccagcctgggctgctgagccgagactccatctcaaaaaaagaaaaagaaaaaagccagacatcaaagaccacatattgcatgattccatttatgtgaaatgtccagaataggtaaacacataaagaaaatagactagtggtgggtggggtaggtggggagtggcagtaacttctaggtacaggatttcttttcagggtgatgacgaaaatactctagacttaacatagcagtgatggttggacaactttgagtatactaaaacaactgaattgtgaattgtatactctagatgggaaaatttcatatgtggattatatctcaaaatttttttaagaaacaggcggtgctgggcgtggtggctcacatctataatcccagcactttggaaagctgaggtgggtagatcgcttgagtctaggactttgagaccagcttaggcagcatggcaacaccccatcatctacgaagcacacaaaaattagctgggtgtggtgatgcgcatctgtagtcccagctccttgggaggctgaggtgggaggattgcttgagcctggaaggttgaggctgcagagagctgagatcatgccactgcactatccagcctgggcaagagaggaagactatctcaaaaaaaaaaaaaaaaaaaaaaaaaggcagaatccagatttggcctgaaaaccagagtttgtcaagccctaggttacaccatctctagaaaacaaagcctgggagaaagaagaaaaaacaggttgatttttaatggtttagcttgcgtggatccaggtcctgacagttatggaatctttcaaggacacatttgaccagatgagatttggcaggcgtttgtgtagagcctcacagtccagacagtgcctcaccgtattatgatgtgggggtgggggcgggcttctggtgctcttgtcctccacacaggcctgaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccggtgagtgctggcagcgcagggtgtagggggtggctctccatgggtctggctctgaccctcggctgtctctgcagcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggtaaaaatggggacagggcatgggggtgcattcctggaatcccagcactttgggaggctgaggtgggaggatcacttgagcctaggaggtccaggctgcagtgagccttgatggccccactatactccagcctgggtgacagagcaagaccctgtttctttgttttttgtttttttagttttttggttttttggttttttggttttttttgagaccgagtttcactcttgttgcccaggctggagtgcaatggcgcgatcttggctcactgcaacccccacctcccggattcaagcgagtctcctgcctcaacctcccaagtggctaggattacaggcatgtgccaccatgcccagctagttttgtatttttagtagagatggggtttctccatgttggtcaggctggtctcgaactcctgacctcaggtgatccgcctgcctcggcttcccaaagtgctgggattacaggcatgagccactgcacccggtcaaccctgtttcaaaacaaaaaaaacaaaccgggtggcaagcagtgggtgagggttcctgctgggtgcagcctaggaaccccaagaaaaggagggtcctgctcaagtgctggtgctgggctcctcatgaaggcaggacacctcattcagtgctgaggtcaagagggaacctaggagttcacgcaaatccagggaaggcgtgggctcacctcctggggtcaggactcagggatccagtagcaggacactaccccaactaagctcccagtgagcgtgcagccaaatgcgtaactgtcgggctgttaaaagatgcatgggacacagctggcgggagtgggcagtgcaagggggcggtgagaactcaagttcagaaactgactgccctggcctgcgcccccgccctgctgtttgcagcctgtggacctggggaagggacagggtgctttcctcagtttccccatctgtaacatgaggaagacagcattttctccttcacaaggccattgaaaagatgcaatgagtgttagaacagtgcctctattggtcagagctcaatagcagctattaggattgggtgagataagtcatgtacagaaacagtgttcatgactgggtactgtggctcacacctgtgatcccagcactttgggaggctgtggcaggaggattgcttgaggccaggagtttgagaccaggctgggcaacataacaagactctgtttcaaaaaaaaaaaatttataaactagctgggcatggtggtacatgtctatagacccaactacttggaaggctgaggtgggaaaattgcctgagcccaggaatttgaggctgcagcaagctatgattgtgccaccacactccagcctggacaacagagacccacagagaccctgtctcggaggaagggaggaagggaggaagggaggaagggaggaagggaggaagggagggagggagggagggagggagggagggaggaagggaggaagggagggagggagggtcaggcgtggtggctcatgcctgtaatcacagcactttgggagactgaggcaggcagatcacttgaggtcaggagtttgagaccagcctggccaacatggtgaatccctgtctctactaaaaatacaaaaattagccaggcctggttgtgggcacctgtagtcccagcttgtagtcccagctactcaagaggctgaggcaggagaatctcttgaatccgggaggcggaggttgcagtgaacccagatcgagccactgcactccagcctgggcgacggagcaagactgtctccaaaaagaatattcaatactcccaagcatgtccctcacctcttagctgagagcagccagtgccctgatggcggcagacagctgccgacatattcccagggctgccgacatattcccaggcactacaacatcatagttaagagcacaggccccagaagcagctgcctggttcagctttctggcttgtcacatgttatatggcaagtcttgggccagccacttgacttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagcactttgggaggctgaggttggggggttgcctgagcccaggagttcaagaccagcctgggcaacatggcaagaccttgtctcttctaaagagagattcctgggtgaaagcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaagtgaggctgggagctcggctgcctataatgcccatggcaggccactgctgggaactggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaaaaaaaaaaaaaaaagcacgtatcagatgtggctcctgcagcctcccatcttgcatgtgataaaacctaaactccttcctgcagctccagccggcctcccccgatttgccttctagcctcccccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgaggtgggttgagaactagaggaggagactggcaggggccgagggtcttaggacagcagctggtgtgggcagcaggcctgggtggggtgtcgatgagacagtgcacggctacagcataagccaaggccgtggggggactgggctgtctcccgggtcttacctgactctgccttctccccagcatggccgtggagagcaccgggactgccaaggcggaggccgagtcccgtgcggaggcagcccggattgagggagaagggtccgtgctgcaggccaagctaaaagcacaggccttggccattgaaacggtgagtggggggaggcattaagaagagggtggccttgagtcctggaaaaggcccattccctacagtccctgagactgtataggacaccaggtcccccaacataaagccctatccaagtactttgcatttgcaaagtcctttgccttgtaggattcattgactccattgctggaaggtaaggattagaacacccattttgcagctgggcgctcatgcactggccaccttggcacaagtgctgtgtatgcttcataggcattatcttatttaatgcttgaaatcccattaagaggccgggtgcagtggctcacgcctgtaatcctagcactttgggaggccgaggcgggtggatcacctgaggtcaggagttcaagaccagcttggccaacatggtgaaaccccatctctactgaaaatacaaaaaattagctgggtatggtggcatgtgtctgtaaccccaactacttggtaggctgaggcaggagaattgcttgaacccaggaggtgtggaggctgcggtgagctgaggttgtgccactacactccagcctgggcaacaagagtgaaactccatctcaaaaataaagtaaataaaaataaatgtaaaaagaggcctagtgtggtgcctcaggtctctaaccccagcactttggaaagctgagatgggaggatcatttgaggtcagttcgagaccagttcaagactagcctgggcaacatagcaagacctcatctctacaaaaacaaaattttttaattgactgggtgtggtggcacatgcctgtagtcccagctacccaggaggctgaggcaggaggatcctttgagccaggagttcaaggctgcagtgagtcctgatctgcattccagcctgggtcaaaaaataaagaatgattgatttttcctcttccaggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgacccttcaaaccagctgacttaaggagggtcactctgaagtggccagggtttgacgcccatctcaacttcctcctgttctcaccctccaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggca

SEQ ID NO: 36109 - DNA, 287943 bp, Homo sapiens
gtcccccgcctgcctgaggacccccgcgcaccccagagacggcgcgcgcccagagcgcgggagcccggagcgccgggcgcctgggaccccgcggagccgctgcccagcccgtggggctcggcgggaatgcaggctgcgctgtgaacccgggcgccaaggccatgtccggcgctcgctgccggaccctgtaccccttctccggggagcggcacggccaggggctgcgcttcgccgcgggcgagctgatcacgctgctgcaggtcccggacggcggctggtgggaaggcgagaaggaggacgggctccgtggctggttcccggcgagctacgtgcagttgctggaggtaaggggcgagggccggggctgtaggagccggggctgcggtcctcggtgcgctcgcgtacctgttgcccgttccggggatgccgcagcgtcccggtcggaggggcgccccggggggcagcccttgccggcgctacctgtagctccacgctcctggggggcagcgacggcagcgggcgcccctcggggcgtgggcaacgcggactcgcggggagcttccaccttgcgccgggcctccggagcacaccgtggctgctctgaggaagcgagaacttgttgcctgtgtgagttaaggagcaggcgggagcgttcccggcagtggcaggggccggtgaagggtctggcggtcttgggaagaggcacggaggatcaggggtgcgagaaagtggcaccgactcggtcccgcagccccgcgtctccaccccggagtctagagcctgatgacccgtggacggtcgtgctgccttgggtcaggctgcctggccgcctcgggaccacccacttgctggtcagccgagcctgctggccaccagcccgagccccctcagcaggcttgatcctggggtgccgtagcaccccccgccactgcctgctcccctggtccagctccccgaggctaaggctcagaacccgaaagtggcttgttcctggggttctggcctggccccagggctgcacaggacctgctgaggcaaggcggctggctgtttattgtctatgtgacaggctgtcctctaatcactgagctcgcagtcacagcctgagtgagacccgaagtttctaaagtcctttgtgtgtgggggggtgaccttccaggacatcccctttactagaagcccgcctgcccccaggattcttgtaaagactaaattaacagttaccttcaatggtgtcagtattcctaaacattctggtaaaacactgccggaagaaatcatggaggctgaatttatttattatttaactcttgacctacttcacagagaaagtagcaaattttgactgagaatgctcagtgcaattcatcgggggcggggggaagaaagaaagaagtgaaatggttacagggtgagtccgcctgaggatgtatcctgtggcaacattgtcagcaagagcctggccttataaaagtacattagattgctttcaggtccagagaacaacaaaatctctcctaaaggcatcagtagcatttgagcaaagtttaggggctgctggaatgagctttcatgggctgtcagcagagtatgttgcaggaaccctcttggttctgtatctggagaatccggagataccctacttgtaggagaggctcaggtgtgccctgccctggcttttccagttcctttcccgagattcggatgtaaaagaaagcgaacgtattgcttcttacatgagaagcaaggggcctccttgtttctagcttgaagccctgggatagatacgtattttgggagttcttcgggtggtcacccttttccaggaaattctgatgtggaaatttggctgatggatgtctgtccggtgaggagcatccctggctggactgagccagctgtgttttgtgtaggggtgaggctgggtaggtgttagttagcaagagtggagtgctgctttttcttccgggaaagggacgatggaccagggccaggggacaagcggaattaacaactgggacagttttgggtgtgtctgtcccatcctctggcatatacaaaggtaagagatctctggtgtctcagggcctctcagaccattcctgactagtaacttgcaacagaagcatccatctgcgtgagcaatacttctgagcacctgcttggcacagtgtgtgcacgttatcaccagttccctgacagctctgtgaagggtgaggtacttcccccattttatagacaagcaagctgaatatgagagaggcgaagtcagctccccaactagtaatgcttgcgtgttttgttagcagctcagatgactgagtatcaccccctgcgcctgtgccttttttaaacatgatagcccgggctcaactatgccaaacagcgtgtgagcgaagggtctggatccatggggaaaaggggcatgcgcagcccctgaggtcagcatgttggtgacagcaccgcgaaggggaggctgaacctctagggctaaaacgaggacagctgcatccaggagcaacttggaggatcttccctgctaaccccaaagtgtgactttactcagaaccagctgggggtcttcccacagtgggcccgagtcctgtatcctaagtactgggtgggactcttctcagggccaaagcagatgcagtttcaacaggggggcatgtgggtcaggtgcttggcatctgggaacctcctacatgagcaagttggacctcaaggctgaaggctaggtagagatagaggacatgcaagcagagttgcttgggatggggtgagtcctgaagggcagactcagagaatgcagaggtccccaggctggtgggtagactggccagcatctggactcatgagactagagagggggcccatagatactggagatggcgaacctcatgagatgtcagccaatgtggtgctgtcactcagcttgcttgggagcatggagttcagaaggccagggcagctgttggagaaacaagtacagacagatggactgtactagcctcctggcctagggatgggattgtgggtacacagatgaatatggcatctctaatgtgctccctactccagcggaactttcaccctgatagaaagagtgatactaggaaaccccatcttggtggaggggagggaggcactgaatactgtgtgcacactggatacttcccaaggagatcttccttgttcagatgaagcaaggggaaccgagagacccagcctttgcaggaagcatacacgggggaggggagttgggagctaactccaagagagtcaccagatctgacccagtggccagctagcccttgggaggaggccagcttggaggaggtcttggtttttggggcaatctctttggtcaagactccaaggaaatggtatagcacatacttggcttccagagagcagcttccaggaaaacctcagcacaggcagggaagtgtagaggtctctggtaggcccaaggactctggccacaagggttcttcctactcggggtggtgcagctcttcaaaggatgggcagagggaaacacctacctccagaaaaggaataggccttacagccaaggcccacagctggttattagataaaatcaactagaaaaatctttcctgagggtttcttctgctatgacgagggacaggaattaagaagtctttttttttttttttttttttttttgagacagagtctcgcactgttgctcaggctggagtgcagttgtattttgagtagaggtgaggtttcgccgtgttagccagcatggtctcgatctcctcaccttgtgatccacccgcctcggcctcccaaagtgctgggattacaggcgtgagccactgtgcccggccgagaagtctttttaacatcatttgagagatatggtagaggaagagacctgagaccagagataggagctgtgggagcatgttctgccagctccaagctaggcctgagattgcctccatagacctgggaaccccacatgtgggaatatttccaccagctttctagggtacatcaaggctgagaaatagctcctggggaaggtggatagagaatcctagatctccatcctggggaaaatttggagagaaagacatggtaccaggacaagcccagtggctggacaggtcagtggttggagggtttaatagggtccaggaattcctgtggcctgtactttccttgaatggagagaagaaattagggacctggggaatgttgtaaggcatctacaaaacttcccagagcttttgggaaataattctgggggacaatgggattggaatgcaaacaaaatagagctttctttgaactaggtggtattcttagaatccaggatctggctggataatctggaccttttctctttcctaaaaagagccttttcctttctttctgggttactaacagaatatgacactgtttgctggcacaactagaatggctgctgagggtcaccgttaaacttgattttcttcactctaccctttgttctcccattttgggttcatgcagttgtgctgcaggagttgataaggagtgtctgtgggagagagtgggctgtgctatggataattaaggaatgatgttttatctattgccatgtaacaagccactccaagatttagtgtttcaaagcaacaatttcttattatctggcatggttttgtggattgacggggctcagctgggtggttcttctgctggtctgtctcagtgtctctcatgcagttgcaatcagatggtggctggggcagagtcttggaggctcaactagactgcagcctccaaaatgtcatcttcactcacctgtctggtgctttgatgttcttccatgtggcgcctttctccatgtagtgtttcattctccagggcctttccacatggcctttctcttcaggagttatgtggtagctggcttctaagaatgcaaaggcatacattgccaggccctcttaaggtctgggcccagaactggcatatcgtttctgccacattctattgggaaagtagtcacaggtctgtccagagtcaatttggaagggaggtgggtacaggtgcggttatgagggaggcgtggttcatcgagggccatattgcagactagctccctcagaaggctagggagaacatacatgggacagatgatccattagtgaggaggtagtgctgggccagactgatgagagagagaaccccaagagggaggtaaaatgcagagacttggcagttctacctctatcgcaatccttggagggttttttttttttttttttgactctagaggtttctttctaaaggccacatgataaacgatgcagctggaatttgaaatcagatttgcctggctctgggcctgtccactaagccattgacataccagtccagctttttttaggccagggctgttcagtgctgatgattcatagacatagtggatctgagctccctgacatctaatagatgtttgctatattacacaaattgattttaatacagagccttttcctttctttctgcaacatgaaaatcacccaaaatgagtgtgaccttgtccctcatgctagtatttttcagtcagtcatcaactctgttcacaaaaggtgcaattagggcttgtggctcggaggggtgggtaattgtgactgaaaagaccagcgtgctttctgacatcttcactaaatcaccctcctccttggtatgggggctgtggccagtatttgtagctcctggtgttagaaaatgacctttggcccaccactctgtcagcctcagctcagaaggaaccacctcttttgtcacacttgtgtgctggactggtcagtggctaccccacaggactttaaagcaatgagcaaggcttatggattgagtggattcagggcattttcacaaaagttcccttagcaacaagtcggcgggaatccctgacatctgttcaccgctctgtggatccctgatgtctgttaccacctagaaacatgaatgagaggctgaccttcacgtactcttctcagtctggaaaagcccagcttttttctgatggtgtggtagaccttgtctgtgaacacggatactgatcctcacttcgctggtgaaagaaaatgttttttggtaaaccaggaaaccttgtgtacatgtaaggtattttgactattatcaggccagcccaggggactgtgctgtcttattactcacagcagcaaggcgacacatgacaggctttctaacaaaatgtcaggagggattcctctgtacttaaatgcaaaattagtatatttctctgtctccctgcaatggcgaggcttctggggtggtatttatgcctatggcgagaagaagaagtggcggctggcagatctctctggcttttccttggctgaccagaacatgttgtgacgttgtgaaagtttagttgcagtaggtatatgaactgtgagaagtttttgaggagtcttaagaggatccacccacctcctttcttcacgttttctgtcttccctaccatctttaagaatttgtttttagtttaacttcctagttctccgtctactactcttcttgagcttggagctggttttcagattcaacctctaggtactcaaatttcatatgtcaaaactaaactcatcatctctctcctcttttttttttttttttttgagatggagtcttgctttgttgcccaggctggagtgcagtggcgtgatctcggctcactacaacctccgcctcctgggttcaagtgattctcctgcctcagcctcctgagtagctgtgattacaggcttccaccaccatgcctggctaatttttgtatttttagtagaggtggggtttcaccaggttggccaggctggtctcgaactcctgactttgtgattcacccgcctcagcctcccaaagtgctgggattacaggcgtgagccaccgtgcccagccctctctcctctccttactgccttttttttttttttttttgacacagggtcttgctctgttgcccaggctggagtatagtggcatgatcatggctcactgctgccttgacctcctgggctcaaacgatcctccaagtagcttggactataggcacctgccaccatgcctggctaatttttgtattttttgtagagacagggtttcaccatgtttctcagactggtctcaaactcttgggctcaagtgatcctcccaccttggcctcccaaagtgctgagattacaggcatgagccaccgtgcccagcctcttcactgccttctgttcccaacctctaaaccaagcttgtggaacatgtggcccaggatggcctttgaatggggcccaacacaaatttggaaactttctttttttttttttgagacggagttccgctctcgttgcccaggctggagtacaatggcgtgatctcggctcactgtaacctctgcctcctgggttctagcgatcctcctacctcagcctcctgggtagctgggattacgggcatgcgccaccacacccggctagttttgtatttttagtagagatgggatttctccatgttggtcagtctggtcttgaacttcccacctcaggtgatccacctgccttggcctcccaaagtgctgggattacaggcgtgaaccaccgtgcctgttcttaggtttgtaaactttcttaaaacatgagggttttttttttttgtgagatatatattttttagctcatcagctatagtagcgttagtgtattttatgtgaggcccaatataatttttcttctttcagtgtggcccagggaagccaaaagattggacacccctgctctaaactttagtgaatgtcaccaccatctgtccaccaagttccctgatatctctccccttacctttcctctcctgttcagtaggctagcaagcctcgtcccttcccttcttccttagaagcatttctttttttcttttttttttttttgagacggagtcttgctctgtcgctcaggctggagtgtaaaggcacgatcttggctcactgcaacctccacctcctgggttcaagcgattctcctgcctcagcctcctgagtagctattacaggcacgcaccaccacgcccggctaatttttgtatttttaatagagatggggtttcaccacgctggtcaggctggactcaaactcctgacctcatgatccgcccgccttggcctcccaaagtgctagggttacaggcatgagccactgcgcccggccagaaacatttcttaaagccttctccttcttaacttgcgttggcaaatctttctgtaaaaggccaggaaacattttaggctgtgtgggccatgaggcaaaactgagttacggctgcatcggtgtgatctgtagtgcgccagaggcagtgacaagcagtgagagcatcccatatggtctctgtcacaactaatccactctgctgctgtagtgcaaaagcagccagagataatccgaaagccaatgggcgtgcctgtgttccaataaaactttatttatggactgaaatttgaatttgttataattttcatgggccgtgaagtattattcttcttttgatttgttttcaacttttttttttttttgggagatggaatcttgctctgttgcccaggctgaagtgcagtggtgtgatctcggctcactgcagcctctacctcctgggttcaaatgattttcatgcctcagcttcccaagtagttgggactataggcacccgccaccacagccggctaatttttgtatttttagtagagatagggttttgccatgttggccaggctggtctccaactcctggcctcaagtgatccaccctccttggcctcccaaagtgctgggattacaggcttgagccactgtgcccagccagccatgtgactatttgggggaaaataatttgaggctgagggggactgcagatgtacataaccctgagtagaggagtgtgtttgataaacctgggagagccagaatattccagaatggttagagtggcaagtagggggagaggggttgggggtgtgccggggaaggagatagaacctggggagatgggtcattttctaaatgcagtggaaaagcctttggtttgattgaagtgggtggcatcttcggatgcgttctggaaagctcttctagactgcagggtggagaatggatttgaagaaaacagggaggggaggcaaggagaccagttgggaagctcagagcagggtggtggaagtggagatggtgagaggtgtgtggatttggaatgtatgttgcagctagtgtcaacaggtcttgctggtgtgttgatcggagggagtaagggaacctcagggggtctcacttcttgcaggtcacttgtaatgcactttttcccttttgtattttccccatctgtccatcctttattctgccactagaaatctcttcccaaaaaaaaggaggtaaaaggcaaatacaaatttggaaaaagttccttaatgtagaaagtgcttttataaattaaaacaacaaaacccaaaacaaagaggaacatatcagtataagaatgggcaaggaacttggatagacacttcataataaaacatatacaggctgggcatggtggctcatgcctataatcccagcactttgggaggttaaggtgggcagattgtttgagcccaggagttcaagaccagcctgggcaacatggggaaacccaaattttttctctataaatacaaaaaaattagctgggtgtgatggttcatgcctgtagccccagctactcaggaggctcaggtgggaggatcgcttgaacccgggaggtcaaagctgcagtgagccaagactgcaccactgcactctagcctgagtgaaagcgtgagactctgtctcttaaaacaaatgaacacacacacacacaaaaccatataaaaagtcctcaactatttagtctcgccagtgattgaataattgcaaatttaattaaaaaacagcttgaagacagaaatatgtaaaaaaaaaatggtattggcagggtgtaaggaaatggtcctgagcttcctgaaggaccatttggcactgtacaattccacttctagaaatttcttctcagggagcatctgatatatcaggcaagctgtaaatatcagcgtatattacatcacagcctctgatagcacaagatgaacaacaacctcaatgtacaccagaaggaactagttaaaatcaggtttacctgcgcttagcaggtcagaacatgcggaaggggttcagtaactatattgaaatggattttttttttttcttgaggtggagtcttgctctgtcacccaggctggagtgcagtggcgcgatctcggctcactgcagcctctgtctcctgggtgcaagtaattcccctgcctccgcctcccgagtagctgggattacaggtgcccaccaccatgcctggctaatttttccatttttagtggagatgggtttcaccatgttggccaggcaggtctcgaactcctgacctcaaatgatccacctgcctcggcctcccaaagtgctgggatgaaactgaatttaaaaaataaaaatattggttaatgatgctaaatgtctttgtggagctagcatagttcacatttctcctcacagtgaggcaaaaagagatggtgtgtccagaaaagaattacttttcaaaagtgggaactgtgtgtaccaaacattctgtaagtatccttttgtgggaagaataggtagaaggaatacatgctggcccgggactgcattcttataaatatcctcagtaacagcaaatctttgtcttttgaggggtggatttgattttttttggaaacagccaaaattcattcaaagccaagtctggtgtgtctgttcatgtgactgtctgtctgtcaccttgtggcaaataggatttaaggcagcttaccaaaaagcatacggtacaaaaagataaaagcataaacacatgaggaaatctgtggaaaagaaaaactcagatgattccggagtgaagtttgatgagcaaagcgagtaactgagttaagtaatgccgttcagggctaaaaaagaggtcctaccttaaagtaatgatgaatttgagcagtgaatgaggagtaacagaaatattctgaaaaaggtagcattgtgggggtgtgtgctatatgggtcaggatgggttactttatgccaccacagcaatctcagtggtaaagcaacatggatttgctttttgctcatgttgtaagtctattgtgagttggtccaaagccgcaagacctccaggacccaggatgatggaacgcccagtgtgtggaatgctcagggactgtgtcaaacagcacatggttcttaaagcttttgcccaggaatgacacatgacacttctgctggtattttattgtctaaagcacagccacacctaactttaagacagtgaaaaaatacaatcctgccgtgtgtttggaaggagaaaaggagcaagctgtatctatgtagatggccctgttgaccaccacatgggtaaccactcatggggacaccccagttcctgtctgtttcagtttcagcattttatcatcgcacctagagcagtgcttctcagactgaattcagtgctgctacagcaaagtggtttctgtttttttttggagacagaatcttgttctgtcgctcgggctggagtgcagtggcactgtcctggctcactgcaacctctgcctcccgggttcaagtgatcctcctgcctctgcctctcaaagtgttgggagtataggcatgagccactgtacccaacccagtctaatattttcatattataaagaaggctttgggccgggcacggtggctcacgcctgtaatcccagcactttgggaggctgaggtgggtggattatctgaggtcagtagttcgagaccagcctggccaatgtggtgaaacccagtccctactaaaaatacaaaaaaattggcctggcttggtggcacatgcctataatcccagctactcaggaggctgagggaggagaattcgttgaacccaggaggtggaggttacagtgagccaccgagatcgcaccactgcactccagcctaggcaacagagtgagactaggtctcaaaaaaaaaaaaaaaagcctttgaatacgtggggcctggcttctggtgtagggacatcagagcctagctgtacaatatcactatacatggtgtgagatctgtgcttctccaacatgaatgggtgtgcatatcactcgaggctcttgttaaaatgcagactctggccacgcgcggtagctcacacctggaatgccagcactttgggaggccgaggcaggcggatcacaagatcaggagatcgagaccatcctggctaacgcagtgaaaccccgtctctattaaaaaaaaaaatacaaaaaattagctgggcatggtgggcacctgtggtcccagctactctggaggctgaggcaggagaatggcgtgaaccaggaggcggagcttgcagtgagccgagaatgcgccactgcactccagcctgggtgtcagagcgagactccgtctccaaaaaaaaaaaaaaaaaaaaaaatgcagactgatttagtagtctgaagtggaaacctgaatctgaaagaaaaaaccaaactctctgctcacactccatcctgtttctccacactcacacagcaccagacacttctgtgacttgattgggggtggcgagtgttttcccacacaccaggcgggttcttcagtggacaccagctgaacctcttatatttctattgggttgtgacattgtctacctggtgttggagtcagatcctacaggctgagagcgcagtcccacaagagtgccccacttcatatgtcaagtagtgtcacttatatttctgattgaccggctgtaaattgggtttcccactgctccctgcttgggtttgattaatttcctaggatggctcacagaacttggggaaacacgtttactggtttactataaaggatacagatgaacagccagaggaaggggtgcattctgcaagttgaagaatttttctaagtttcccaggattgctctgagggccaggagaagctgggagaagagcttggcaccttgtacacactccataagtggaattcatatttctgcatgctctagtgatcatagttgaatgctgggggctgcctgttcaatgccagggcatatgggggtaggggtgtgcagcttccatgccctctctggactctcctagcacctccatgtgttcagcaacccagaagcttatcaaatcttgttcaagagtttttataggctgggcagggtggctcatgcctgtaatctcagcactttgggaggccgaggaaggtagatcacctgaggtcaggagttcaagaacagcctggccaacatacaaaaccccgtctctactaaaaatacacaaatgagcctggtgtggtggcacgcgccgtagtctcagctactcaggaggctgagacaggagagttgcttgaacctgggaggtggaggttgcagtgagcctagatcacaccactgcactccagcctgagtgagacacagcaacactccgtctcaaaaaaaaaaaaaaaaagagtttttatagagcttggtctccagcctcccatggccccccttttcctggaggtcagcaggtggggctcaaaaatcccaaccctctaatcctctaataacttgttcctggtgaccagctccaacctgggctatctgagggcccccaccctaagtcaccttattagcatccactgaagtgtgatcaaatgggctcattatgaataacaaacaacattcctatcaggaaattccaagggtttgaggagctatgtggcaggacctggggacaaggaccaaatatatttcatattacaccacactgggattctgcatttcccgccagctcccaggtgatgccactgcttccagtctgccggccacaatttgagtagcaaggcatttgaatacccttaggggttttcagtttgtctgcaagacttgttaaatcctggaattagattggatttagtttactttcattctttctctttaaaagtggattatatgaggctacccagggtcatggaaagaacacaggttttggaattagacctctgtgagtatatttaatccgaggacagagatatggtggctggtgttcctgtttgaccagaggagtttccttgatcatgaggtggaggtgggcctcagggaggctttcctggggccaatgccaggagcctggctaaggaggaagtgcaggattcagccgctggaaaggctggggggcagggtctggactgcagtatgaaccaggacgatggagaggcagccagggatggtcttgccagatgccaacagtgtcaggaaaaacatatgcaacggggacatggtctctacatcttgagacagtttatcagttccaaggggataactggttgttttgtgtggtttggtttgtgaactggaatgtgagccctgcagctgctcccagtatggacagcttagacaacaacgttcaagggtcggccagaaacccctgggaggtgggggcagcagagtgcttggcaagagggtggcaggtctgcgtacaaatcccagctcagcccctgctacctgtgtgagagcccaggcaagttgcagaatctttttttttttttcctgagacggagtctcgctctgtcgcccaggctggagtgcagtggcgctatctcagctcactgcaagctccgcctcctgggttcacgccattctcctgcctcagcctcccaagtagctgggactacaggcacccgccaccacgcccggctaattttttgtattttgtttagtagagacggggtttcaccgtgttagccaggatggtctcgatctcctgacctcgtgatccgcccgtgtcggcctcccaaagtgctgggattacaggcgtgagccaccgcgcccagccagttgcagaatctttctaagtctcccagggctcctctgaggatcaggagagcctggtagaagagctttggcactttgtacacacacactctgtaagtgcagtttaccttcctgtatgctctggtgatcatagttggatgctgacagctgcctgttaactggagtttcattggggcacacagggcggatggtgttggggaagtagggggacccttttccaagggcctctctgaggtcgtactgcaagactgtctggtgcagcattatcgatgaggcacaaatcacttgtgagtcttatgaaatgcagatttggattcagtaggtctggggtggggcctgagattctgcatctccagcatattcccatgggatgttgctggtattgggataacacttggggagttgcatacaagatggtatagcattttcctgagggttttcggggcgtaggtcctacaagtgaaagcaagggaagctgcagcgtctggccattgctagtttatttgaaactgctacataatggttgctgctcctcaggctgggctaattagtcttaatggcttcttacctgggtttgatgggcctccggctgcctgggcactcccacacaaaactctttttgtaatgaggaaaaggctatttattgggagaggtgaaactcaggagactgctgaaggactcaagcattcgtttttgtctttttgcctgttgctggggcaaaggaaaggtttgtttcaaggggctggatggaaaatctctttttaaagtgttgctgtggagctcagaatctaatcctgggcccgtgttgtagggctgtacactgcagatggtggcggtaccacaaagccggtgtctcctgcagcccctagatggaactctcaggtccttgctgtcggagacttagtctggatttctgccgtgtgccctaacaggagtggctgtccattttatccccctagtgatgtccatctgtcacagggtgaaccccaaaattggggctgagcctgggaggccacatgggttcttggcttcacacaggaaataattcaagagttagctgacaaagtaaaagcaaatttattaaaaagtaagggaataaggccgggtgcggtgcctcatgcctgtaatcccagcagtttgggaggccgaggtgtgtggatcacctgaggtcaggagttcaagatcagcctggccaacatggtgaaaccccatctctactaaatatgcaaaaattagccgagcgtggtggtgggcgcctgtaatcccagctactcgggaggctgaggcaggagaatcgcttgaacccaggaggtggaggttgcagtgagtcgagatcgtgccattgcactccagcctgggtgacaaaagtgaaactccgtcacacacaccaaaagtaagggaataaaaggatggctaccgcttaggtagcagtatgggctgcttgactgactatacttactgttatttcttgattatatgctaaacaagggggagattattcatgagatttctgggaaaggggtagggagctctgggaactgagggttccttcccctttcagaccatatagggtaacttccagtcattgccatggcatttgtaaactgtcctggcgctggtgggagtgtcatttagcatgccaatgtgttataattaccctataatgagcagtgaggatgaccagcggtagcctctggctgccatcttggttttggtgggttttggccggctcctttactggatcctgtttgatcaacggggtctttgtgacctgtatcttgtaaaacaagtcctgccaaattcctatctcatatcctccagagtgatggtgcagtgatttttgtagccagtttgatcacggaactctgctgtttaacatttttcataggttcttcattgcctttacaatataccatgccttagccttgtttacaagcccttcatgacccaacccctgtctatctcctgagctgcattttagctatttattcacgtgcatgatgttatcagaaccacatggaactacctgattcttgggtacagctttgcttttttttgcttctgtaccctgtgcatgctgttcctgttcctcgaagtaaccctcctcccccatcctcttctttacccttactcccttttctttctgtttgacagctctattgagatatatccccattctattctattctttttttttttgaggtggagtcttgctctgtcacccaggctggagtgcagtggctcaatctcagctcactgcaatctccacctcctgggttcaagcgattcccctgcctcagcctcccgagtagctgggattacaggcatgcaccaccacgcccagctaattttttgtactgtagtagagacagggtttcactgtgttagccaggatggtctcgatctcctgacctcgtgatgtgcccgccttggcctcccaaagtgctgggattacaggcgtgagccaccgtgcccccaccgccacccccgcactgccaccccccaccccccgccaccctcatccttattctagaccccttaacacttaccctactgggttggaattttgttgccacccactacattgtggaatccttgagctcaaggattgggtctctgatcttttaagcctttagcgtccttgtacaaccaggcttagggacttgataagaaaacaaagggttatagttccctcatgctgacattcatggtgccgatgaataccagattctgagtttgctgcccatggtagttacttggcttcacatggggaaaaaagtaacaataaggagttacaataaaataaatacaaaacaataaaaatcccatgcaggcatcttacacatgcataggataggtaacaagattgattggggaacagagtgtgtgtgactcaaatagaacatccctgctgcagggcaaataactcagattccatgaagtcattgtatatatagggcagcaaaccattattatttcgtgctggagagaaaaacaggcgttgaagaaatcggcctcccttgggattgatttgattattgggtgactccttggatgggggtgttctcgatttgtgggcatcttggcaggcagtttggtgcaatggtgatgagcgtggtgtttagagctgatcagacctgggtttgcatgctggctgtatgagactttaggcatattatttaccttaacttctacctcagtttccatagctttttttttttttttttgaggcagagttttgctctgtccctccaggctggagtggtcttggctcactgcaacctccgcctctcgggttcaagcgattctcctgtctcagcctcccaagtagctgggattacaggcacccactaccatgcctggctaatttttgtatttttaatagagatggggtttcctcacgttggccagtctggtctcgaactcctgacctcaggtgatccacctgccttggcctcccagagtgctgggataacagccatgagccaccacgcccagccattagtttccgtatctttaagtgggaataataaggcccacatcagaggattgttgtgaaagttacaattgttttcctaaacgtaaatgctccactgagagcttgacaccagttctcagtatttgctgatggtcactgccatattacgtattttgcatccattgctcagaatgctggtcattactatttgccttctttattaataaaagaaacctgctgtctcggagcgtccttcccaacctcctggtcaccattttgggtggggaccttgtctttctgacccctggccactgtcaccttaagtcagtttcaatcttggttctgtttgtctggttttagcaccatcaggtccctgtttgtctggttttagcactgtcattgaagacatttttgcccaaggaagtcacagcccttctgtggatctctgagtttgttatagtgtatttggaccacaaacttaaaccaaaaattcatgttcatagtctcagtctcctcctatccagatcctccctgcatgtgataaaatgtgaccaagaatcttaagaggttaaggggattgaaggggaggggaatcttagataaggtgacagataaaccagcttggaaacacggagttttctgcaacagattgcatccaagatctcctgaaatatctccctgcttggtataagggaaaatactctcctctcatttggtgtcacaggacctatgaatttttttttttttgagatggagtttcactcatgttgcccaggctggagtgcaatggaacgatcgatctcggctcactgcaacatccgcctcccagcttcaagcgattctcctgcctcagcctccagagtagttgggattacaggcatgcaccaccacgcccggctaattttgtatttttagtagagaccgagtttctccatgttggtcaggctggtctcgaactcccgacctcaggtgatccgcccacctcagccttgcaaactgctgggattacaggcatgagccaccgtgcctggccagatgttttcaagttgatgtgtcttgtgacatggcagaggggacattggttctctcagccagtcgactacagtttttgagctctttctgtgccccagcacctgtctgtcctggccgtataatcggatcctccaaggtggtggttgtagggctctctctgctcaccttttttctctaattccctctgttaaccagcgaacaaagaaaagccctccgctgtctgccgtgacagcccacacagggaagagggcagagatcttcctgtttctgatgacttcttgctttgaaaagaggaggcaatttttgctcatcagcaaaaaaaaaaaaaaaaaaaaaaaaaaaaaaaggtggtgggggagggaggggagttgagttggtggtgaagctctttcaaagatttgcctgtccctctagccagattactaatgcatgctgattagaatgtgtgctgggagagacagtgagctggggtttagggatgttcacaggagaggtatgagacaggctccgtgtatggttttctggagccctgtggtgggcgtggctgtcagatcctgatagggtttagaatttcagatgggcttcttctgcctcacctgggagaaaatagccggagtggacatgaagccagactccttcctcatctatgcagagtcctctatgtggagtcattcagagagtgtgggggtgggggcggcgagtttgggagatgttggtatggacttgccaaggcattgccaagcattccacgggcaccacagaaccatctctggcctaagcccttcgtcctggtccaagaagccagcgatacttcttggcattgctgaatgggagaggcaggggagctgagcttgcctggaatcccccatctcccagccctggtgcttgcttcaggggcctggataaagcagctgctcattctgccacatacactcccaggggactgtgactcaggctctggatcactccctccaggaatccctccggctctgtaggacccagtttgaaaacccagtgttatgtgatgctaaatgctgacattccttccctgcctgtcagctttgctctcggaggtgcctaatggcgccagtgctgacctaatgcggccggtgttctggtttgtttctgaattgcgtgttgaggtagttggggggctttgttactctgggtggctggtctgctttattattagtcttggggaaatgatttctctgagaagcagtagaaggtgtaaattatgcttcactgcaaatcatcaagactatatatatattcagctacagctgcaagtctcttgcaaatgaggactgatgtgagatgcagccaagttggaaagggttacggtgcagacaggcagctgacatgattgataatcatgcagtcacctgtacttggctttctatggcttgtggtctggggagaagagcagcagtcatgcttagaggctatactccatctgagaaggctggagggcagcagtgagaaggtaacacctccataggagcagacacagtctccattaacctggtccttagtaaatatctcttgggtttccaccgagccagggaccccacacatggcgtcagcagcatcctctccacacctgatctccactggctccccattgcttgaagtgtcaagacactcctcatctggaccttgcacaaatatggaccctgtacaaactgcacctggcctcactccttctccagcctccttactttccctctcctggggagcgggaagcaacctgacacctctgtgcctttgctcggctgcagcttctgtctagaggcccttctcatccctgtcgagggaatgatgatcttttatcaagatccagcccatggaccccttcctctgtgtggcctttgctctcccccaggcagagtcctttcttctgctggcttgcatggggatctcctgctgggatggcaccaaccacatgggactgcgatgccttatttatttgactgtttcctccattacactctgagctctgcagggccaggaacgccacttcctaaacttttgtaactactctggtctggcatggtgcttggtgtctctgaagtctggctcagtaagtatttgatgactggatgggtgaatcaaagaggataaagggagagcttgccttaagaactggggacatcttgtctgattttggctcacggcttaaccagcttggggtcacggacggccaaggttagaaggagtatagccaggtcatcttggagtgctgactattaagggaaggccactggctcctggagaacaaggccattgagccccaggccaggactcccaggattggcaagtgaaaggcagctggatgcttggagtggtcctctctcctcatctccttctcagtagggctgctgcagggacagctgggtgtagctgagggccctgggttttaactacggtaccttccaacaccccttccacagagttattggctctttggccttgcaatgttcatgtaagatctctgaccttcagttttttcagctgtcaaaagggtggtgacacccattctgctgcccattcagggtgactagaaggattttgaggatgactggaaggattttgaaggtgatggtggctgtgtacgggatttgaagtttacgggtgatgaatgcaagcggtgctaagagacgctgtgcagggaggagagtgggggagtctctccccagctcttgcacccagctgtcccgactcaaccaggtggcttggtctaacccctcacctctctgctgtggtcatcctttctcctctggcctctttgaagttgcttctgaggcctcctcctaagacctcctccctgtccctgctatccgattaggaaagctgttggaattcttggcccagacaagctttaatcatttgcagtaagagctctgttgcctccttcatccttccctgccttcagttaagcccctctaaggctcgaggtgtgttctcaaccctgggatatagccgagaatgagatggagtggacaggactcaggggtccctaggatcagagggttcattgtccgtggggaaccagaccgagtgataacggggatgtgcccagcacagtgaggggccccaggggacagtcagggctgtgggagtgctcaagaataccatgggctgagtttggacccactccccactcgtatttgaagtcccaacccctagtacctcagaatgtgactgcatgtggagaaagagtctttaaagaggtaagttaaaatgcatggccagctgtagtagctcatgcctgtaatcctaaccctttgggaggccaagacaggaggatcacttaaggccaggagttgaagacaagcctgggcaacatggtgagaccttggctctacaaagtacaaataaaaagaaaaagaatttttgaccacactgttgtaggtcaaggaaaataactaactaactaactaactaactaaataaaatgcggtcattagggtgggccctcatcctgtatgactggtgtccttttaagaaagggaaatgaggacacagatacacacagagggaaaaccgtgtgaagacatagggagaagacggctgtttgtaagccagtggggagaagccttacaagcaaccttgagcttggattcccagcttctagaactgtgaggaaataaatttcagtggtttaagccacccagtctatgattcttttttgtggcagccccagcaaactcacacaagccccttaccctgggcttgggtaggcaacttatttacatagttccacatgggatcaaaaccttgaaaaaacatagggacctagggacagtttgcttgtcccatttttcttactaacatgtattcctagctgaagggttatatagttcacttctttaccttattatcattagaatgtgaactccaggccgcgcgtggtggctcgtgcccataatcccaacactttgggaggccgaggcaggagcatcacttgagcccaggatttcgagaccagcctgggcaacatagtgagacccccatctctatagaaaataaaaaattagccaggcgtggtggcatgcacgtgtggtcccagctactcggaagtctaatgtgggagtatcgcttgagtccaggaggccgaggctgcagtgagctgtgattgtgccactgcactccagcctgggtgacagagtgagaccctgtctcagagaaaggaatgtgagctgcatgagggcagagctgcatcaggtcaaagcccgtgaaggcactggcacgtgtcttttggaagaattctgtctgaacctggggcctgaagtcaaattcctcactctgggcttcaatccagaattgttttttattttttttaattattttttttgatacggagtctcgctctgccgcccaggctggagtgcagtggtgcgatctcagctcactgcaagctccgcctcctgggttcacgccattctcctgcctcggcctcccgagtagctgggactacaggcgcccgccactgcgcccggctaattttttgtatttttagtagagacggggtttcaccatgttagccaggatggtctccatctcctgacctcgtgatccgcccgtctcggcctcccagagtgctgggattatagatgtgagccaccgcgcctggccagaatttttaattaaaatagctggttttctgcatccaggtctctgtttagtgctcaccctgcaaggtgagttgctgtttgttctacagactgcatcccctatatccctctaatctctactcagtccccaaatgtgattaacatgtgttaaaaatcagagaagaaagattcctttattagcttttgtttacactgggtgaattgagccacagactatattacactaagtcctagcagcctatgagtttgaacgttgtcaccctccagagggtttgcttaatgaggccagggattccatcattagtgtcctgaaacgcctatgacagtgcctggcccagggttgggcacttactcatgttattcacttattcatatgtgggaatgaacagttcagccagtataaaggacaggtgagtacacaccaaggagatcttcagggagagatcagctggttttcctgtgaagatgtcagcttcatccctccaccgtctccctgtgctcatggctctgttccctttccaggctgctgctgctggttctttgggtctgcagccacctcccacccccatgaagggcaaacccagcattatgttacctcctcagtataaaaggagagagggtctctttttttttcttttttttttgagacggagtctagctctgtcccccaggctgcagtgcagtggcacgatctcggctcactacaagctccccctcccgcattcacgccattctcttgcctcagcctccccagtagctgggactactggcacccgctgccacacccggctaattttttgtatttttagtagagacggggtttcaccgtgttagccaggatggtcttgatctcctgaccttgtgatccgcccatctctgcctaccaaagtgctggaattataggcgtgagccaccgcgcctggccgagagagggtctctttttatacctcagagctcctcgggtccctgatttcgggaaactcattacttacctaggaatcattcctccttctcttcattttttttctctccctcttccccgcctccccttctacttttaaaaaaagttgtgttaaaattcacataacatgaaattcaccattttaatgttcagtggcatttggtacattcacagtgttatacagccaccaccattatccagttccagaagtttcatcatcccgaaagtaacccatactcattaagcagccactccccattctcctcccttcgcccgcccccagcatcaggcgaccactcatctgttttctggttctatgcatctgcctattctaggtgtttcacagaaatggaatcagaatgggtggacttcgtatttggtttatttccgttgacatgatgtcttcagggttcatttgcgtagtgacgtgtatcagtacttcattgcttttcatgactgaataatactccattgcatggatataccacatttgtttatccatccatcagttgatggacacttggctagttcccatgttttggctgttgtgaataacaccatccacttctttttctggtcttcagttctgcctccagatgctgaatctttagtcttttgttgagactgcatgggttactggcaatggaaaaggcacttgagaaataagaaggtaggcagtgaggggctctggctacaaagcgcttcattaaagtctgtcaagccttagtttgctcatttcctaaatgggtgtaaaattccctgccttgcttactcagccctgcagaatgttgtaagaggcgcaagccacagaatgtgaggttaagcccttcctaagctataaagtcagatgtcaagtgatagttctgtatgttcctcattttttctttgattgtctccctttctgtttctttttttttcttcttctttttttttaatctgcttcctcatttctccttttgctaattgctccatttgaattctgttttcctttcttctttcctctgctttcagctggcctgggggcaaagttgagagcaatacagagtgttatgcacagtgctgtgctggaggtgaacaagatgattggctgccccctggggaatccttgggcagggccggacatgcggcagaggaaggaggttagctgcactggctggtgggtgatgaggtgaagtcaaccaggactggacctgaggagtggaatgagggctgccatggcaggccatcctatctggcttagatttagagacttcttttacacatagctttgaggtcttttgcagtccaggaagtagccagattgatgggtagttaggcagatattagaatccaaacaagcagacccgagggacacttaggggaaagcagcagatggaggtgtatgcttttcttagtatgttgcttttgcgaatgctagatcatccgctgtcctgtgtgtgctgttttcccagctgaacttgaagcttcttgaagacaaaagtgatgacagtcttttatttttgtgcttgctcctggtgcccctcagagagttctgaacttaagtggcatttcctgtgtgtgttgaaacgtcacttgtttagtcctatagcggttacagagggctttcatgcaggatttctcatgtaatcttatcaacagcctggcgaggtggattccatttctcagataaaggctcagagaggtcaaagaatttgctcaggacacacaaccaatcagaggtttcaacactgcttaggaccagcgttcttcactgcttcacccgtcccttacacggactgcctggtttttatggcagataagaagcatgtggctgtgattatttagggagatgggaaatgaatccttatgcatttggatcttgttcattttcgagatttcttccccctagcgtcttagaattttcaagtccaaaagaagttctgtaaaagttgcaggtggtctttcctattactcaagcactgtagattccttttgtctcaacaaacttcagagacgcttcaagggaagccgatttcctgctaaattgatgtgttcctcatttgttacccgaagacctgatttaaggagctattcttggtgacaggcagggagccagctgtgaatggggttctgggttcgctgtcagagccctgcttggaccaagttactcaaaagtctggctctgactgggtctggcaggaggggctggtgtgttggagtaagcgagcttggggaaagcttgcccggaggaaattcggtcaagatgttcagttttaacacctctgggtttcttccaaaccaaaagaggaaaagattctgactgaagggatgaaggaagttttaggattttccatgaatggaactcagagcttgagggatcctggattctttgcggctcaagtgaagctacagagagagaaatggtgcctgggagttaggaggacttttgcccttggctgggacttaggcaaattgctgagcttagaagacaattgatcccagtggttcgctggctcagccacagaaagtgccagctggcctttgagttgttcagggatctgtgatggtatttatgtgtggcagagggatacttctaagctcagagaccacctccgaggtgacagagctgctgggcagaagatgtaagtttaaaaggccactttctttctcattggaacctttcagcagattaacaagatacggggctcattcactgaacaaacgctcgttcagtgccagccgtgtgcagggcacaacctggaaagtaggagatgtagtagtagtaaaaccacagacatcctgactttatagagtttacattttagttaggggtgacagatagcaaggaaaactaagcaaactgcatggtgatctagaaaatgtgtcattttaaatgggatgggcagagaaggtctcattaggagagggcatctgtgcaaagccctggaagatacgatggagtaagcacgtggattgctgagagaagagcattccagccagaaaacagaacagcatgtgcaaaggccctgaggccagagcattcctggagtggtcagggaacagcaaggaggtcagtgtggctggggcagagtgagtgtgtgtggtgtggggagtgttggagatggggacagagaggtgaccagactgaggggtgggtggggccaaagcacgagggcttttgagaccctcacaaggatctgacatttaccctgagtgtcaggggagccattgagcagaggagtgacttgagccagctggatgtttacaaggatcactctgctgctctcttgggaatgaatgatggggggatggaggggggagcagagggtagaaggagggagacaagtaaggtggttattgcagtaatataagcaagagctgatgctggctgtgacatggctgtcaccactggattttggatgtattttgagagcgagaccaatgggatttggtaatgggttgcacgtataaggtttgagagagaactcaaagcgagtttcaaggtttttggcataagcaaatgggaggaaggagctggtttgaaatgagaaggtgaggaacggaagcagcaggtttggggaggaaatcaagagttaagtttgagattcctatatatgttcaagtaatgatagtgagtaggcatttggaaagaggactcttaattcaaggtaggtataaatttgaagtcgttatggcgtagatagtcttcaagccgctgtactggatgagatcacctaaggagtggggtggatggagaagaggtctggggatggggcctggaggcaccccaaattaagaggactgggcagagcaagccaactgtaaaggagaaggagcaaccaaagagtgggcggaaaaccaggaaaccagacagttctccctgggttcagtgaaggcagccatggagtcatcgggacattgaccttatctgcagctctcaaggaatggaaaaccatcagggaccatctgagatatggtcaaagcctcagggatgacgcacccttcctggtgttgttagcatctgtttcattacaaacagcataaactgtagcatggctgtgtttgcctgtccgtaaccccacccagacttcactggcaggcttaacccacaagaagttttagggaaggaggtactgtctacaaggttttacattgtgctgagtgtaaatgtgaacttttaaaattattaattaatttttttttttgagtcgaagtcttgctcttgttgcccaggctggagtgcaatgacatgatcttggctcactgcaacttctgcctcctgggttcaagtgattctcctgcttcagagtagcggggattacaggtgcgcgccaccatgcctggctattttgtatttttagtagagacagggtttcaccatgttggccaggctgatctcaaactcctgacattgtgatctgcctgcctcggcctcccaaagtgctggattacaggcgtgagccactgcacctggcctaattactaattttttttttttttttgagatggagtctcactctgtcgcccacgctggagtgcagtggcgtgatctcggctcactgcaagctctgcctcccatgttcaagtgattctcctgtctcagcctcccaagtagctgggattacaggtgcatgccaccatgcctggctaattttgtatttttagtagagatggtgtttcaccatgttggccaggctggtctcaaactcctgaccttgtgatccgcccgcctcagcctcccaaagtgctgggattacaggcatgagccaccgtgcccagcctaattattaattttttaaccacacaattaatatacaaattagaccatacatcctcactaggggcaatatcaccctgcagggggaagaaatgggttctgaggtgctaacaacatcctagggcctacagcggtttgtggctctccagcggtccacagtacgtaaacagacatacagcctgactgtggtattaaaatttcatggtagtgggggagtgattaggaaagaaatatcttaaaaggctccttagagagggcagtaatgaaaaaaggttgaaaaacccagaattattctaaagccaccttcaactacttccctaggcctctgtggaaagatactctgatgatttgtgggtttagttcttttaaataaagaaaaccaagctattatttcttaacttcttttttttctcacttgataatgtatcttgaagttatttttttttgttagcacatatacatcagtggttatttataaaaactgtgtggtattctatagtatggatgtagcatactttattttccgttccttagttgatggatatttaaagtgcttctaattttttctttttgctattaaaagtaccatggcaaagaattgagcctgtaatcccagctgcttggaagctgagaggtgggagtaccttgagcccagaagttagagtccatcaacctgggcaacatgatgtagtgagaggccaggtgcagaggctcacacctgtaatcccagcactctgggaggctgaggtgggcaggtggcttgagcccaggagttcaagaccagcctgcgcaacatgacaaaatcccgtctctacaaaaaatacaaatgtcagccaggcatggtggtgcatgcctgtagtcccagctactcgggaggcccaggtgggaggatcacctgagcccagaaggtgtcggctcctgtgggctgtgattgtgccgctgcactccagcctgggtgacagagcgagaccttgtctcaaaacaaaacatattgagaccctgtctctaaaaaaagacacagaaaaaaaaagaaaaaaaagaccttcgcaatgtttgcacaagtgcctgtgttcgatgactcttctcaaaggtggcagaagaagatgacatgcttggttatagggccaatgccctctaaacaggttgaaatcttacgaaggggatatgagccaagccaccatctcaccccaggctcagtaaccggcccttacagcccagcccattctctccttaatctttttgacacccacgtgaggtttatatttttttcatgtcctactctagctatgagaaaaccgaagtttacagatataactttaaacaagttagaaatagacaagcggaggctgggcgtggtggctcatgcctgtaatcccagcactctgggaggcggatggatcacctgaggtcaggagttcgagaacagcctgaccaacatggagaaaccctgtctctactaaaaacacaaaattagccgggcgtggtggtgcatgcctgtaatcccagctactcgggaggctgaggcaggaggatcgcttgaacccaggcggtggaggttgcggtgagccgagatcacaccattgcactccagcctgggcaacgagagtgaaactctgtctcaaaaaaaaaaaaaaaaaaaaaaaaaaaaaagacaaatggaaatagtagattggtttagtcaagttagaaataactagaaggccacatggcaggtagtggcagagtgaagtcccagagcagggtctccacccatcagctcgtgaaaggacaagtgatagacttttggggatctctggagcctttgatcgaatgtgcctgcgggggctgtcccaaggcctagctcatggaaacgtaggtcctggctttatcaatatgctggtctttttaaatcagttatgagttccttattttgcaaacacaagagtgcttgaaattgtttttatcatcttgtattttcactgactaagcagaatagggaaaatttttacttaaaaaattagttcatagtaagtaaaggctgcaaaataccatgtataacaaaattccaaatttgtaaaaccaacaacgacaaaatgtgtgtgtgcacataaaagaaagtctggaggaagattcattgagaggttaatgatggtttagtttcttgtttggattttctgtggtcagaagaatgtaatacattataaaaggaaagcatcaatacatatttcattgaaaagctaaaggaagaaaactagagaaagtgaaggatattttcctaacttggtatttgcaaactctgatgcctgtttatcaaattggagttctccttgggagtgagttgaaggaggtcccttggggcccccatcccctggaaaggagctggtgtggaaagtcacctggtgtggtgactcacgcctgcaatctcaccactttgggaggctgaagtggtaggattgcttaggccaggagttcgagaccagcctgggcaacgtagtgagaccctgtctctactaaaaattaaaaaattagctgggcatggtgatgtgtgcctgtagtcccagccacttgggaggctgaggcaggaggatctcttgaagctcaggagcttgaggctgcagtgagctaggattgccccactgcccttcagcctggatgacagagtgagaccttgtctctaacaaaagaaaaagaaaaaaaaaaaaaagaaaaagaaaaagaaagccaggagtcctgggttcctggtgccttttgctctgagacctctgcgaggccgaccaaggacagaatgaccttcctgtgtaatagggaggcatcctgaggcctgggtgggaccctctgggtgttgcctttggatggggcaaggtgaaaggatgtctgaatcagtgcacacaagtgtcccgtttccagatcctgagaaccactggctttcctccaggggagcctcaagtctcatgcccccttgggagctgcagggtgggaggctggagtaggggagcctctatataggaggggtaagtatggtgtaaaaatgcaagcagtgggtcctctgcttacatttactttgggggtgcagttttattttaaaatgtccagagggaaaagaaaggcttgactttttaaagacactcttggcaaaagccaatgtttttcaaccattggacgaagcttgcctgcctaatgagcaatctgtagaaattgatgcataaaaggcattgctaagtaaagaagaggaggtagagatcgatgagggcaccaagctggtgccacaagaactccttagtcaagttgaaacaaaagctcccatagcagcacatgtgctaggctccttttctgtttgagaagcagcaagatgaaatcatggtacatctctagggcatgaagagttaaacttttcttttgttttcttttttttttttttttttttgagaaggaatctcgctctgtcgcacaggctggagtgcagtggtgtgatttctgctcactgcaagctctgcctcccgggttcacgtcattctcctgcctcagggtcccgagtagctgggactacaggcacccgccaccacacccagctattttttttttttttgtattttttagtagagacggggtttcactgtgttagccaggatgatctcgatctcctgaccttgtgatccgcctgcctcagcttcccaaagtgctgggactacaggcgctcgccaccacgcccagctaattttttgtatttttagtagagacgaggtttcaccatgttggccaggctggtctcgaactcctgacctcaggtgatccgcctgccttggcctcccacagtgctgggattacaggcgtgagccactgcgcccagccttttttttttttttttttccttttttcattattatttttagagacaggatctcaccatgttgcccagtcttgtcttgaactcctggactcaagcaatccttctgcttcagtctcccaaagtgctgagattataggtgtgagccattatgtctggcttctttttcttttcttttttttttcatttttaaagagagatgaggttttgctatgttgcccaaattggagtgcagcggctattcacaggtatgatcatggctcactgccaccttgaactcctaggctcaagcagtcctcctcctgctcagcctccctagtagcttggactataggttcacaccaccacacctggctagttaaaccttttctaggacaattttctctgaagagaaagtccagtcatggccatatttctttttttttttttttgagacagagtctcactttgtcgctaggctggagtgcagtggcgtgaactcggctcactgcaacctctgcctcccgggttcaagcgattctcctgcctcagcctcctgagtagctgggactacaagcgcgcaccaccaagccccgctaatttttgtatttttagtagaaatggggtttcaccacgtttgccagggatggtctcgatctcttgaccttgtgatctgcccgcctcggcctcccaaagtgctgggattatagacgtgagccaccgcgcccagtccatggccatattcctaatcctggctgcacagtgcaaaattaacggggcagggaggcccagaccacagccagactgatgacgtcagaccaggtgaagctccccaggtgactgtaaggggcagtcaaaggtgagaaactgagaaatctgagctggggcctcatgggagcctgggggattgttaatgacagctgtcatgtcccaagcggtttctttgcaccagacagtgtgctaataagtgagcacgttatctgcgttctctaatgtaatcctcactccatgagcaaagtgctttgaatttgttcatttgacaggtgaggactggagtaactgacctaagggcacccagatagaaagaggtatgtatcccaggtctctgtaactcaacatgagctctaaccctcagggtaaagccgccccatggggaaagtcttgggggcttgctgggagaatgggaatgccaaggatggattggaaccaagagcttgtcagcactcaaagtatggccctatcccccaacccaggtggaagagctgaggtaagatgcaggagtgataaagaacagacaatattcaggaggtactaatttaaaatatgttagatgcctttttatttctttcaactttaatctgtatttctctctcaagcatttttgtagccagatattttgatttctttaaatcttattccaatctatgtttccctttcttttttttttttttaaattaaaaattttttggcccagcctggtggctcgtgcctgtaatcccaacactttgggaggccgaggcaagcggatcactggaggtcaggagttccaaaaccagcctggccaacatggtgaaaccactcccccgcaccccgtctctactaaaaaaatacaaaaattagcgggcgtgttggcgcatgcctgtaatcccagctcctcaggaggctgaggcaggagaatagctcgaacccgggaggcagaggttgcagtgagccgagatcacgcgactgcagtccagcctgggtgacagagtaagacccagtctctacaaagaaaaataatttttttttctttgtagagacagggtttctgagccatcgtgtctggcctgtttctaaaatatttttttgttgtcctttttacatttattttttaaactatgataaatcacatataacaaaatttaccatcttaaccattggaagtctatagttcagtattaagcacatcacattgttgtacagccttcaccatgatttagccccagagcctttttcattttgcaaaactgaaactctgaacccagtaaacagtcactccccattccctctccccgccagcccctggtaactccattgtcctttctatctctatgaatttgactatactagggacctcatataattggaatcatatacttcccctcgtgtgatgggcttatttagcttagcatttgaacatttttaataggcaactaatttctgctcttcttttatgacaagttattgattcatagaaaaatatggactgatcagatgtggctgttttttctcacttaatacatctctggaaacttaacacagtaaatagccagtgacatgaaaagatcaaacttttaaaaagtgactcgtggagcaaactgggacttcggcaatcccttggtatttttttccttctttaaaaaaatcaaaagatacaagctcccccagagtgcttgtcaagaatgagtgggaggggggacccaggaaacttgaaggatacattaaattctttaaataaattcaggaagtaacatccaggagtggttcacaccattcataaaatatacagctccctcctagagagagaggattcagtgtgatgtttttccccctgaaataagcccgcccagcttctcagcacagactgtgtgattcttacactgggcagcgctgcttcttcaggccgggctgtcagagcagggacaatcccaagccaagtcactgctttcagtttatctcagagggaccagcatgtgcctgggcgatattagcaccttcagactgggagccttcggaagggttctgccagcattctgggaaggcgattttttttttttttttttttttgagatggagtcttgctctgtcgcccaggctggagtgcagtggcacaatctcggctcactgcaggctccgcctcccgggttcacgccattctcctgcctcagcctcctgagtagctggaaatacaggcgcccgccaccacgcctggctaattttttgtatgttttttagtagagacggggtttcaccgcgttaaccaggatggtctcgatctcctgacctcatgatccgcccgcctcggcctcccaaaatgctgggattacacgcatgagccaccgcacccggcctgggaaggcgtttttgtaaggcagattggcaactggacatttgcatttggcttcatcatccatcattgtatgttttttggcttgggctggagggcatatttgatttaaatgtaatagttaatgactgagtggaacaactgagatctgtcaagattaactgttgagcagtcagctgaaatgtgtgggaatgtgagtctgcaggaagctcaagttcaaagtctgcgaccttcctttcccgttgacatggtaaaatcctgttacagtgctcgagtcagaggacaagatggcacctactgtagtggatatttgtggtctgttgtctctgattctccttcttctggtaacgacacttccatttttctttggggaaccacagatgcagtgggttcattggaaaatgagtgaactattggttggagctggtttgagtttggttagaaccaggcctctcctaaatccctctcactacagtgaaccagaaatggacatgtcacccaagctgggttcatgagcttcttccctccctaggaccttttgctgtatagtttggcaaagaaatgctttcttcccctggggttgttaaagctaggaagattataaacttggagctgccatgaccatctttggtaatacttgggaagcacctgagaatgaagctagcaaaaaacaaacaaaaaccgcaaacaaacaaacaaaacggagccgcgacccttgttcaagtgcttggatccatctgcaactgaaggccagacactcttgaacttccaagttatatgagccaataaatactgccatgccttcgtctgtgtgtgtgtgtgtgtgtgtgtgtgtgtgtgtgtgtgtatggtttcaatttctatggcttccaacttactgcatcctgtcaaaaacagccatattatgaccaggtgtggtggctcatgccagcagttcccgctacttgggaggctgaggtaggaggattgcttgaggccaggagtttgaggttttagtgttttatgattttgcctgtgtgaagccactgctattcagcctaggcaacatagtgagacccatccctgaaataaacgacaagcaaagcacatacttccttaactttctatattatagttagaggaaaatgtcatattgcgcacctgtgatgtgatctgcctggtggcaagggtgagcccaggcagtcatggtgagattacagaggtttggtatgccgtggagagaccactagacagggagctgggattcacaggctctaggtgcctttcttcttcctggctaggtaacctgggcaagtctcttaagctttctcagcctcagctctcaacatctgtaaaacagaggaattaaactaggtgatcttcgaagtcgcttttagctctatatggtcctgtaactgttttatttaatatctgtgttttaaatgggcagtagaaatagggacaaaatcaaagagaaacaattaaaaataccccctagatctctacgaattgcttgaagatccacctttttttttaatacaatttttagtgtaaattttttaagttgaagtgtaacctacatacagaagaacggtcatacctggccagacagggtcgctcatgcctgtaatcccagcaccttgggaggctgaggtgggtggatcgcttgagctcaggagttcaagaccagcctgggcaatatggggaaaccctgtccctacaagaaattagctaggtgtggtggcacgcacctgtagtgccagctactcaggaggctgaggtggttggattacttgagctcaggagttcaagaccagcctgggcaatatggggaaaccctgtctctacaaaaaaattagctaggtgtggtggcatgcacctgtagtcccagctactcaggagactgaggtgggaggatcacttgagcctgggaggcagaggttgcagggagccaagatcgtgccactgcacttcagcctgggcgacagagtgagacactgtctcaaaaaaaaaaaaaaaaaggtcacacttcatgtgtatagtttgatgcgttttcataaactgggaacactcttgtaatgagcatctacgtcagacacggaacttacccaggacctaagaaaccttctctccaagtcagtactctcttccaaaggtgaccccgatcttgacttctagattgtgtaataattttgcttggttttaaattttacataaactgagcatagagaagttattctttttggtgatggaggttggggggggtgcatctggcttttctcacttaacaccttgtttgtgagattcacctatattatgggtggcagtagttcattctcattgctgtgtagtgtgtcaccctatgaataaatacaccatcaattatttatcctactcttggatctttgggttctttcatactattatgaacagtgctaccttgaacattctcgtacatgtttttggtggacgaaagctctcatttgtgttgggtattcacctaggggtaggattgctaggtcatagaatatgtgtatcatatgtttactcttgggaaatactaccaaatagtgttccactcccactggcactgtctgtgacttctcatagttctacatccttgtctgtgtgtgccattgctggttttacagattttagtcatttgggtgaacgtgtaggggtctcacattgtgcgtgtgtgttatctttaatatatatatatatatatatatatatatatatgttttagagacagtgtctcactctgttgtccacgctggagtgcagtggtgtgatcttggctcactgcagcctccacttcctgggctcaggtgatgatcctctcacctcagcctcccgagtatctgggactacatgtgcatgccaccatgcccagctaatattttgtattttttagaagagatgaggtttcaccatgttgcccaggctgatcttgaactcctcagctcaaatgatcctcccaccttggcctcccaaggtgctgagattacaggtgtgccccactgtgcttggcctctttacctttttaattagcaatttttcagaattttattatgaaaaatttgaagagttgcaagaattacagtgcacacttatatacccatcatcagattccgccattaacattttcttatacttgttttattgcatatctaaccttctatccttccatcaatcgtatttttttggaaacatttcaaagtaagttgagaacagcagtatacttcattctaaggagttcagtatacagagcattaacttacatacagtgtaatgcacatatctttttttatttttctttttatagaggtgggatcttgctatgttacccaggctggtcttgaactcctggcctcaagtgactctcctacctcggcctcccaaagtgttgggattacagatgcgagccccctgcacctggccttgttttttttttttttttttttttttaccaaaaaaagaaaaaacaggattggccgggtgcggtggctcacgcctgtaatcccagcgctttgggaggccgaggtgggtggatcacaaggtcaggagatcgagaccatcctggctaacacggtgaaaccccgtctctactaaaaaaatacaaaaaaattagccaggtgtggtggcggacgcctgtagacccagctactagggaggctgaggcaggaggatggcatcaacctgggaggcagagcttgcagtgagccgagattgtgccgctgcactccagcctgggtgacagagcgagactccgtctcaaaaaataaaaataaaataaaataacaggattttgttctgttgcctaggctggagcgcagtggtacgatcatagctcactggaacctcaatctcctgggctcaagcaatcctcccatcccagcctcctagagtagctgggactgcaggtggataccaccatgtccagcctacgagtacctatatgcttactggccatctgggtttcacatgtgtgtgaaattgtgtgtgtctaagggtgatatgcctaagggtgatatgtctaagggtggcttttaaattttttgcggggagggtgaagagtccagttgactgacgggaggaccaagggtatattcatgtgacaaacctggttccaaagtgtctactattaactggaagcagattctcacacctacaaggcttcccagtgtcaggagccaggaaatgctggtttgttaaaactcagcccaaaattgggcagagcagtgaaatttccaagcatgatgctcaaagccttatcttctaatcatttccagttatgtaacttttttttccaacgagtgtcagtctagcaggataacacaaaatcattagcagatttataaagcggtttgaccaacggctgccagaggaagtgtgactttgagttccccacgtaggcgtcagacttgtcttcatattgaaaggcaggggagttggtgcaaagaagggtgttcccgggggcagttgacagtaatggatctttaaaaaaattattcccctcgtcagctccaaggttggcaggccttgcacttcagggtgtcaggccctgtccccagcccctttcctaggctgaggactctgggtttgctgcgggtttgtaagccgtgggtgtttcctccttctcccaggggtcccatgtgtcaaatcctgtgactgggcatgtgtggccttgtcatgatgcatgggtctgtgtccggggaggagcagggccacccacatcctcatttggctttctgtttcttctcagatgtcattttgtgaaggagccaccgaccaaggcctggttaggaggaagtggtcaccaaaatactttggtgtccagggcttgcagagagcttgtcctcagtggctgtgtctgaactccactattgagggtgcctggagggggatcttgattgggaaggcagtggggagtttgaaggaggggctgtttatagaggcttgagcagggtagaggatggggaagcacgcccagagaggggaaaagggagggaggcctgcagcaggagggggccgactgctctaaagaagccactgctactcccaaccccagcctgcagcctgcagcctgctaggagggaactggtgaaaataccccaacctcgctttcctcatgaaccttcatctcctacctatgactttcagtggccaaattgtctttcactgtagccagagggtgcgagggtccctggagtccctgtgggtcagccttctggtgcaggagctgcaggagaagggccaaagctagctcccgacaggcaagtggagagtcaccagcccagagatgtttctagagctttgtcccatgttaaaacacaaaattatttgctctgggagaatatatttaaaacttctcttgacgagtttggaagagagctttggcctaggaactgatctgaaattaaatgcagacatatggggtgggggatcttgttcataaagatcctcctcctgcctggcttgagtcaagaaacaggcgaagggcacccatggctgtggcatggagggctaggacaacagagacactttgcaggaacatgggtttaggaggtggaatgccagaatgggctccccagggtagaggtttggagaaatctgcttacgaaggaaatattatcaaggaccaaaaaagtgatggaaagagagggacattgtggcggagctaaggatgggtggagcaagaagaaaaagtcagagttgggaaagaagctaggtcggagttagagaatctcgtctctaggctggggcaatggaacaagtaaggaagtcagttgcatggttggaagagaatgtattcccttcgaacctgactcttggtgagggttgctcatccatgcctgtgtggcatagtggttcagagagtgcggggtgtcaatgccagctgtactacttactagctgtgagtccctgggcagattacataacctttctgtatctcagatttctcatctggaaataggaccattataatacatgtctcttagggttattttaaggatcaaatgagtaaatacaggtaaaactttaaaccactgctgtatatttaacccttagggtctccgacactgtcatgaaggctgcctctgaacaggagaggactgagtggaccagttttgggatgggagtgggaggaccagaagaatggtaccgccagggaagagaaaatgggagggaggccatggtctaaattgatccctgacatagcggtgggaaatgagccaaggaaactggcttgaactagcttctatttggaggctggccatttgctgcagagacagttatttgaagctcacgagtcattcacacattattacaaatacttttatgaggacctttggtttctgaatagggcagagctgggggtgagcctgaaaacatggctatcagaaggaagagtcttgggagaagggaagtggagggagaggaattgtttttactttaatatttcttgtcttaaaaagagttattggtggccgggcacggtggctcacacctgtaatcccagcactttgggaggccgagatgggtggatcacctgaggtcaggagttcgagaccagcctggccaacatggtgaaaccccatctctacttaaaatacaaaaaattagctgggtgtgttggtacgcacctgtaatcccaggtactcgggaggctgagacaggagaatcgcttgaacccgggaggcggaggtcgcagtgagccgagatcgtgccactgcactccagactgggggacaagagtgagactttgtctcaaaaaaaaaaaaagagttattggtttagtaggatttagggatggaggttcccatgcagactgtggacatgggttttgtgtgtgtgtgtgtgtgtgtgtgtgtgtgtgtgtgtgtgtgtagcctggggttggggattggggtaatggtagctccacctttatgaagcgtttctccaggacacacttttcctgaacacagtgcagtgagcaccacttttcacctatagtgaaggtgttttctagctggctggggagcatcacccatagacagcatgatacagttgttaagagcacagggaaaccagtgggtttggactgagttttgaatctctgctcagtcactctgtttttctttctttctttttgaaaaatagagatgggcggttgggcggcagtctcactatactgccctggctggtctcaaactcctggcctcaagtgatcctctggcctcagcctcccaaagtgatgggattacaagcgtcagccactatgcctggcctgtgaattttttttttttgtttttcttgagacaaggcctcaccctgtcatctaagctggagtgcagtggcatgatcactgctaactgcagtctcgacctcctgggttcaagcaatcctcccaccttggcctcctgagtagctgagaccacagatgtttgctaccatgcctggctaaatttttaattttatttcttgtagagacaaggtctctctatgttgcccaggctggtcttaaactcctgagctcaagtgatcctcctgcctcggcctcccaaactgtctggattacaggcatgagccatcagacccagtttggcctgtgtgaatttttaatatgtatattttaatatatattttaatcaaagactacagttaaccagcatttatattctatttgccaaaaaggcaagagtctcagcatatttttactttcctttctatcttttctctaccatgtcccatgatgaaattatttggaattatagatccagattacattattattgtgtttattacctcaaactcctgggctcaagcagtcctcctgcctcaaccttccaagtagctgggactacaggtgcataccaccacacccagctaaattacattttaaaacttgttgtttttatagagatgaatctttttatgttgcccaggccggtcttgaactccaggcctcaagtgatcctcccatcttggcctcccaaaatgctgggattacaggcatgagccacctcacctggcctgcttggtcactctgacctgcaggaagttgctcaaaccttttggtacatcaatttcctcatctgtaaaatgggcatgatagtgggacttatttcataaaataggaaaagtaaatgaatgatttaatacatgtaaataatttaaaagaacaatactaatttaaaaaacattattattttattcttctactcatttcttacggattccttctgttccagccagtcaggcttcaggtttctcattgatttctttttttttttttttttgtgagtcaaagagtctcactctgtcacccaggctggagtgcagtggcatgatctcagctcactgcaacctgtgccccctgggtacaagcaattctcctgcctcagcctcccaagtagctgggttacaggcacccgccaccacacccggctaatttttgtatttttagtagagatggggtttcaccatattggccaggctggtctcttggccaggctggtcttgaattcctgacctcgtgatctgcctacctcgggctcccaaagtgctgggattacaggcgtgagccaccacgcccagtgttttttttttgagacggaggcttgccgtgtcacctgggctggagtgtaatggcgtgatcttggctcagtgtaacctcctcctcctgggttcaagcaattctcctgcctaagctaccctgagtagctgggattacaggtgcccgccactatgcccagctaatttttttttttttttttttttgtatttttagtggggatggggttttaccatgttggtcaggctggtctcaaattcctgacctcagataatccacccgcctcccaaagtgctgggtattacaggtgtgagccactgtgcccagccaggtttctcattgatttctgaagaagtgtaagaaatggccacgcacctacccttgcttggcctgtctggccctcctcaccatctccctgcatcctgcaaagtcctcctctagaaactcttgctcatcttcagctctcagggccttgtcttccttgggaggaggcacctaagcggcacctgcacatgccaccctgaattgacagattggagcatttatgttaatatagagaggccttgaaggctgcgtctcctcctctgccatcttgctctccaccgtcatgtttaacatggccccttgcacacggcagcagtggacgaggcactggactgggggaatgtctatctggagtcacatcttggctgtgtgaccttgaatgagtcactcggtctaggtgggtctccttttgtcatgtgtgaaattaagctaagtactgggaactctaagggttaagagctaatgcacgcacagtcaattcttcactgggaagtgatgctttacaaagtcaaggtattgtgatgaatccttctgtgttccgcctgcatgccttagacggtgctgagcacagaatcgttcctcaataagattctcttggggagtcgattgctgactaaagtggattggtacagcttctgttttgatctgcctgtcataatgttctatctcccatcttttcggggaacttccctattctcaccccgccatgtgactttggtggggcttgtcaaccaagatacgttgctaagttgggaggaagttaccagtggctctctagttggggcagagtccacctacacgtgacagccagtcagaggtgagagaagatgtcctgtagacattgtgtgagtccctggaaccaggcatcactgaactccagtgatgcatgctgataaatcctcctttgtgttggcttaaacttgtggattggatttctgccactggcaactgaaagtcctggctctcttttccttccattttggaatgcagcagtgattctctctcttcttccattaacaaagggaaactgaaagggtgtcagaagtaaaagtcaaaactggaaaactttatttaggttgggttatggtggctcgtgcttgtaatcctagcactttgggaggccgaggcaggaggagcgcttgaagccaggagttcaagactagcttgggcaacattagggaaaccctttctctgtaaaaaataaaaaaagtagctgggcatggtggtgtacacctgtagccctagctattcaggaggcttaggtgggagactcacttgagccaaggatgtcaaggttgcagtgagccatgatcatgccattgcactccagcctggatgacagagtgaggccctatctgtaaataaatagatagatggtaggtaggtacgtagattgatgatagactcttataatcacattaaatgctgtcattaaatgacgtagaataatatttaataacaagataaaatatcaccaagaaaaatgaacatgtgacagttttgttagaaaacagtattgttagaaaacaatacttaaaagaggcttcatctgagcttcatcagtgacaagtatttaaaaaaaaaacaaaaacaaaaacaagcaaacgaaaccctttaacttggtatgttggcctgtgcctatagtcccagctactagcagggctgaggcaggagaaccacttgagcccaggagtttgaaatcagcttgggcaacagagcaagaccccatctctaaaaaaaaataaccaaacttaaaaaaagaagaagtctgacatctggaaatatgcttttaagtcaggtccagggaacctcagaaccagcctcagttcacaggcttctacttttttgtagagcacttgctgggtgtcaagctttgttctattctttttaatcctaacaacaacttcatgcgttaggttctactattgtccccattttacaggtggggaaactgaggcacagaagtaaagtgacttgctcacttatggtcacaccatgatgatgcctggattgaatgaaatttaacagccttggccaggtgcggtggctcacgcctgtaatcccagcagcttgggaggccgaggtgggtggagcattttaggtcaggagttcgagaccagcctggccaacatggtgaaaccctgtctgtattaaaaatataaaattagctgggcggtagtgatgcatgcctgtaatcccagctactcgggaggctgaggcaggagaattgcttgagcctgtgaggcagaggttgcagtgagccgagatcgtgccactgcactccagtctgggcaagagagtgagaccctgtctaaaaaaaaaaaaaaaagaaatgtaacagcctcattactgagtccagatgactccaatttgctgcctctcataggtgttcattcaacaacttctataggcaaggagaaaagttacatttcaaaagcccactaccttcactgtatccatttacactttgtgtgtgtgtgtgtgtgtgtgtgtgtgtgtgtgtgtacttaaccagttgagagaaagaaagaaagagaagaaaaggagaggaagaaaaggaaagagtcaaaggggaatgggcggaagggagaaaggaaaacggaaagttgaagtgtgcaagagagtgcctggggtttgaggttggaggtcagatgaaatcaacgtaaatgtcacaaccacacttcctcttgggagttggtgaatgagtcatcacctggtatgctgcccttttaattcctgattagttggttaaccactatttctaggtctttaaaaaatagttaatatttttttctttattgagatgttattcacataacgtaaaactcagctctctacagtatacagttcagtggtttatagtatattcactgtgtagtattctaatatattcactaactgcagaacacttccatcacctcagaaagaaaccccttccctgttagctgtcactccccattcaccccatctccttacccctaacaaccaacaactactaatcgatttctgtctctgtggatttgcctattctaggcatttcatagaaacagaataatgttacatgatatctggccttttgtgtctggcttatttcacttagtgtaatgttttcgaggtttatctgtattgtaacatgcatcagcacttcattccttttcatggctgaataatattccattatcccgatatgccacgttttacctgtccatcagtggatggacatgtgaattggttatactttctagctattgtgaataatgctgtgacaaacattggtgtacaagtttttttgtgggacatgttttcagttctcttgggtctctagctaggagtggaattactagattgtatgaggactctgtgcttaataaagaactgccaaactgtttctacctcttttccacctctaatcctcaaatggaattgatggaaagtcacaaaaatataagttggtttttgtgttcttcggctgcagtatcctaaaattctataaggtgagatatgttatttcaaaatggggccgggcgcggtggctcacgtctgtaatcccagcactttgggaggccaaggcgggtggatcaactgaggtcaggagtttgggaccagcctggctaatgtggcaaaaccctgtctctactaaaaatacaaaaattagttgggcatggtggcgggcacctgtaatcccagctactctgtaggctcaggcagcagaatcgcttaaacccaggagatgaaggttgaagtgagccaagatcgcaccactgcactccagtctgggtgatagagcaagactctgtttcaaaataaatgaataaataaaacaaaataaatacataaaaatgaacaaaaatggatcctcttctatttaggctgacatgccttgcagcaaccttctggagcaggaagatggtttattggatcatatgggccagggttctccatcatttattcatcatccagttgacctgataccgttctgttcaagagaggattctttttttttttttttttgaggcggagtctttctctgtcgcccaggttggagtgcagtgacaccatctctgctcactgcaagctccgcctcccaggttcatgccattctcctgcctcagcctccggagtagctgggactgcaggcacccgccaccatgcccagctaattcttgtatttttagtagagatggggtttcaccgtgttagccaggatggtctcgatctcctgacctcgtgatccgcccacctcagcctcccagagtgctgggattacaggcgtgagccaccgcgcctggcctttttttttttttttcttgagtgtttctctgttgcccaggctggagtgcagtggtgcaatcttggctcactgcaacctccgcctcccgggttcgagtaattctcctgtctcagcctccagagtagctgggactacaggcatgcaccaccacgcctggctaattttttttttttttgtaattttagtagagacggggtttcaccatattggccatgctggtcttgatctcctgaccttgtgatccacccaccatgacctcccaaagtgctgggattgcaggtgtgagccgctgcgtctggctcttaactgagagaggattcttaaccagcagcaaacagttatccaagggatgcaggtgaagaaaggtctaggttaaccgaaaccaacgaggcagcttttcaccccacaaaaataacctccaacaccagaacacaaccaagaaacataaaagtgcaaaaaaactgtgttctttttttgactccctctttctcaagctcctaaatcaaaaatgcctgtgctagccaataattgatgttcacgtgtgctttatgatttttcaggtgctctcacatgagatacatgatcggctctcacagcagctccttgagctccaacaagcagttactatttccatcatcttgatttttcagctggggacatgggaggttcagaatttgtgatttgcggccaggttaggaagtggcagttggtaaaagacagacttggcattcagaccttttgacttggagttctgtactctttttattatgagctcttggcagtgttcacaccgttttaaaaaatctagataaaggtactctgattttttcccccaagattcacattaatagagtttgagcttggctttgggaagcttcgataaacatcatatttggatctttggcatgagagagaaatgccgtgttgtacccttgatcccaacacgtgtgtacaagcccacttgcccagtatatttttacaagtgtattttctgtgttcatgcatgtgaggtttcttagcccccttggctgatctaaaagccttacttttgagctgtaagaggcaatattaggatgttcctgttattttgagtagctagtaaattccagactggtggagaggctcagctgtgggctcaaaaaccgtttacagaaactttgaggatgtttccttttgtctgcgtattttagaaatcagcttaattgaggttgtctgagcatttttgtaaatttcagagaggcagttgtgtattatacttcgctgtgattaaacacgcagacacatacacgccaccctctgcccccacccaagccccactgctggctttgcctggaagtatgaaaacacctatttgtttattcaaaagccataaaccaggcacacagtggaatatgtgcaagtatgttgaacaaagtacttttcagtgcttaaaagctaattgagtaggtatggatcagtagtttgtaattaacatattaaaaaaaatggcaaaccatgtgactaagcatttgaagagggcttttggcttctttcttgcttactgtaattcttgacttaataggtaaatctcaatttcgaatgcccacaggagtacagattcagagacagtaggtcctaaatgaaggaatttttattgtctaactacaggaagacagagatcgttttttttatgagacggagtctcgctctggcgcgatctcagctcactacaaactccgcctcccgggtttatgccattctgcctcagcctcccgagtagctgggactacaggcacccgccaccacgcccggctaattttttgtatttttagtagagatggggtttcaccgtgttagccaggatggtctcgatctcttgacctcgtgatccgcccgcctcggcctcccaaagtgctgggattacaggtgtgagccaccgcgcccggccagagatctttacgctgttaacccttgagcatggtttagcctgtttcatactgaggtggtcagttttgaaagcgtccaagctgagagagcatcacagtctcctggagggagtgtttaaaccctgattgctgggcctcctcccagagctgctggttcagtaggtttggagtggggcttgaacaactgtacttctggcaagttcccaggtgattctggtgctgctggtctgtggtccacactaagtggcgaggctctggaggattcactccctgactcttgcggggactttgccttgtaaagaaagatgtgaaatgcagtcataattgggaaaacttggccaggacttgctctccagggctgtctttgagtgagacatcttttctagggttgccccgggaagaaggtgggtttgatggactggttgggcacactgggctataaaaagtgaaaacattccatttcttatctgcgccttcaatttaatactagttttgggcccagatacctcaaagttctgggattatctaacttggttctgtggaagttcagggtgccttggtgctcgatgtggacagttttacccccgagtttggggagaaccagatgcttcctctgccttcttgcatgtgtgtggatgccttttctggatttgtcctctgtagccaccattctctcaaggtccatcagcgcaggacctgatccatgacaagggtctgctggttcagagggcctgggcctcaccctctggaaccctcccacgaagatcctggctttgggactacgggggcaagttctcattgttgagatggttgttcttgctcccacaaaaacaaaataatgagccattccacttcattgaactccagggttactgcccttagagagctgggaggtgtctctcatttctgggggggtcttagaatatattgctgtttcccccttccctcagttgactcctgggccatctgccctggcccctaaagcccacctcccccacctggcccagctatactgtccgttcagcagcaagcgtggttgtatccctggcagaaacagcggaactgccaatgccccctgaacccatgccaggattggggcacagatccggctgctgctgctgcaggaactcagaacttggtcctggggggcctgagtgctgtttatcctcaatgttgcccaggacaggccaccagggcctggttctagggccttgtaaggtttcatccaagcctctactgcctccttcctagagctaacttttctgacagtgagcgcctggagagctcttcgggtcttacacactgcctgagcttcctccagtcaccttttctttagattcacccaggcatgacttgctccagaggaaccctgaagttccattttccttcctgtgtactttcccccgtgcttctctgatatacagagagtgttttctttccttttgatgtgcacttgagcattgaatgcaggcgtctctgcggttcttttccttagcagtacctgccccggtgctgctggctgtcagccccagacaccagggcgtctgcagccctgagctgagccaggctgtctgccagtgtggggctgtggatttctgttggtcttctcctttctgcctgggggcagcagccattcctgcaccatggcccagccaccgtttggaacctactaactccttctgtcatgtattgttccgtccttcctcatccagttgcctgtctctgattatggtttggtttctagaaggttctaatcagagacgggcaggaactattgatctggcctgttgtacctgccatgcagttcttacctagctcaaagacataaaagactttttttttagaaatgtaacaactggccaggcgcagtggctcacgcctgtaatcccagtgctttgggaggtcaaggtgggaggattgcttgagcccaggagttcaagaacagcctgggcaacatagcaagatcctatctctagaaaaaatgttttccaaaattatctgggcatgctggtgcatgcctgtggtcccaactacttagggggctgaggtgggaggattgcctgagccctggaggtcaaagctgcagtgagccgtgattgcgccactgtactccagcctggacgagagagcatgtctgtcttaaaagaaaaaagaaaaaaaagaaattaacatccacagaaaaggatttgtgtaataatttaccagatcctttcttacctgatactggggatctgccgagattggccactcattttgggttgatcttaaaactttgatagaatttaagggccccaaaaatgcctcttggggcctgtcctgctctgagcatggttgttccccttcactttgggataatatcacgggcccgacactgcctatgagaagcagaggctcacctgtcctcctgggcgtctttcggcagccatggtcagaacacatacctggctctgttttagggagagtaaaactagcaggtgggcacagctgcaaagtccccagctttgaacaggaccccaaaggggaaacagtcactagccttctctgtaccccacagtccttgagttactagagtctcctgcaatcacatcttgccagcaggccttgcttttctgccgctccgagtcccccgttccctgctccaagctgctggaatatggagcccactgcctggcagagctctgagtattcttagctcttcctgccaacagctttgaggctctgggctaggtggggaatgggtggggatgggcctaccttaagccccctccttgtcacttccattttccagcacactcacatgcttggcactaactgtgacaccctccttgcccatgcaacctgacagacacgtgtgagtttgctagggccaccttaacaaagtaccatggattgtggggcttaaacaacagaatctgttttcttgcaattctagagactacaagtctgagaccataaatgtcaacaggttagtttcttctgaggtcgctcttcttggcttgttttctccatgtgtcctcacgtggtcctccctctgtacctgtctgtatcctgtatcctaatttcctcttcttataaggacaccaggcatgttggattaggaccactctcatgaccccattttaacctaattacctttatgtccaattttttttttttttttttgagacggaatttttctctcgttgcccaggctgtagtgcaatggcatgatctcggctcactgcaacctctgcctcctgggttcaactgattgtcctgcctcagccttctgagtagctgggattataggggacacacaacatacccagctaattttttgtatttttagtagagatggggtttcaccatgttggccaggctggtcttgaactcctgacctcaggtgatccacccacctctgcctcccaaagtgctgggattgcaggtgtgaaccaccacgcttggccgcctatctccaattatagtcacatctagagttactaggggttaagacttcaacatacagattttttttgtcttttctgagacggagtctgtctctgtcgcccaggccggaatgtagcggcacaatctcagctcactgaaacctccgagtcccgggttcaagcgattctcccgcctcagcctcccaggtagctgggaatacaggcacccaccattatgcctggctaattttttttttttttttgtatttttagtagagatggggtttcgccatgttggccaggctggtctcgaactcctgacctcaggtgatccggccaccttggcctcccaaagtgcggggattacaggctagattttttgttttttggattgggaggacacagttcaagttcatgacacactccctgttactgatgtctgaacccccgtgagttcagcctgcatcctcatatagaactgtttgggtggatcaaggttgcaaccaattaaaaaattatctaagtttgaaatatattggggatacctcagaatctttttctgtaagagttatgattggttttagttctgtcattttatgttatgttttctgtttttaaacctttaataggccaggcacggtggctcatgcctgtaatcccaggacttggggaggccgaggcgggctgatcacctgaggtcctggcgaacatggtgaaaccccgtctctactaaaaatacgaaaattagctggtagtggtggtgcgctcctgtagtcccagctactcgggaggctgaggccagagaatcacttgaacctgggaggcagaggttacagtgagccaagatcgtgccactgcactccagcctggtcaacagagtgagactctgtctcaaaaaacaaacaaacaaacaaaacctttaataatatgttatttactatatgatcagttttattgactttgtgtgtacatttcttccaataatttgaaagatttacaatctgcttttagttctggtagttatctttgtaactactatgtacctttttttgttttttttttttgagacagagtctcgctgtgtcgcccaggccggactgcagtggccctatttcggctcactgcaagctccgcctcccgggttcacgccattctcctgcctcagctgggactacaggcacctgccaccacgcccggctaattttttgtgtttttagtagagacggggtttcaccatgttagccaggatggtcttgatctcctgacctcgtgatccgcccacctcggccccccaaagtgctgggattacaggcgtgagccattgcgcccggcctactatgtaactttttaatatatgccatcctcaactttttaggcagtgcctactgactcatcaccatgagcttgacagagttattctgaaaagtgttaatcttaacaaaaataacatttattatactttatttttaaagaaaatgtaaaagtttaaccctttccacagtgttgcattgtatggtatctatcatacacattttaaaggtggggaattcaaggtgtagagaggtaccagaacttgcccaaggccatttatgttagtatctggcagagctggaatgtgccctggagtctgtgattccagagctttggccttgatgctgccttgttgggcctgcacattttaggaaactgcgtctcctccctctttggagccgggctctgtggagggagtaactgagagctgcaggtcttagtgggacttggatctaccctgggaatctgggtgtgtctcttcaggggtgctcaggcactcattcaagcagtggcctttttttttttggcacagtcttgctgttgcccaggctggagtgcaccggtgcgatcttgcctcactgcaagctccgtctcccgggttcacaccattctcctgcctcagcctcccgagtagctgggactacaggctcccgccaccacgctaggctaaatttttgtatttttagtagagacgggtttcactgtgttagccaggatggtctcaatctcctgacctcgtgaccctcctgcctcggcctctcaaagtgctgggattacaggcgtgagccaccgcgcccggcccctaagcagtggctttaatatccccttgatgtgacctgtgagcagcttcccaaggcaggaaattccagaagtgagtcagggccagggccctggagccacttccctgggtccccagaagcagcctttctgtggctgtcagaggggcatagctgggtgcacaccagggtggggccagtccagaagctggcagtattgatggagacccctctgtgtcccactccctgcttgggggagccattgaggcatagtggccagtgtgggaccctgcatctttagcatttgtatctgcagtgttgtgcacatacaagtgactctttttgttttaatctgttagcctagaggggcagagtagcagactgagtctccacggctttccactaccccagccttcagcattccatctccagcttctctagggacactcccactccatgaccacctattctgtggacttacagtgaggagcaattagctgtgtcagtcagggtttgcatggagaagcagaatgagtaggagaaacagacagaaacgtagatgtaggcatattcatgtacataaacacacatgcagttgtagacacatacactagctatatagacatacgtgcatatagccacagacacacatgtatatacacacatagacatagacacacaggtacacacacacaaatgcagatatacacatttttatttattgacttatttttgagacagggtctcgccctgtcacccaggctggagtgcagtggcagtcacggctcactgcagcctcaacccccggactcaaatgatgttcccaccgtagcctcccaggtagctgaaaccacaggcatgccccaccatgcctggcgaatttttaaattgtttgtagagatagggtttccatatgttgcacaagctgctcttgatctcctaggcacacgcagtcctcccgccttgacctcctaaagtgctgggattgcagatgtgagccaccatgtccagcccctgcattttaaaagagagtttttacagaatattagtcttatgtcattgtggggctggctaagtagtctctgttgggctgtcatttcaatgtctgatgctggagcttgaagtctacgggaaaggtgaagttaagaagagaagatcatgagcaggctagaacctgtgggcatgagctggaaccccacaaggatggaataaaattgtctttgactttgatagtgtgggtatcctgcagaatctggggccctgtgtcatggacctaaccaatgtatcctggctcaggggttggataagctgacaaaagctccaggagagggtggagcagttgtgggcctagccactgctttatgccagtgaggcaagtcagcagatcagcaacaatgtgtttgagctgcagaatctctgcttcttccctttcccgcaccatatctcccagaaatcttcctgtggtctacgctaagcagaatgtataaggaaaggaattctgggaactgaagttcagcctagccatgttgacacagtagaaagccatcacattgctagaagattgagtgagctggtaggaagacagtaggcttgggagtcagaactatttaaattgtaatcctgacttccttgctgtgtgaaattatctgatctgtgcctcttcattagtggggaataataatacaaattgcagagttattaattagattaaatggaattaagaatgttgagtatctcactttgctcctggacctgggataagaaatctcagacctttcacagttcttgatactaaccaggaacataatatctctacataattaagttagactctgtcccctggacaaatggtttcttcacgtagggcttgtatgttccttgtgttaggtttattcttaggatgttgataatttcttcttgttattgtgagtgaaatttagttatgttttaaaattggttatagatgatacatggttccagaatgttgctaataaatagctgtgttcctgtctttagtgggaattcctctggagtttcctcataactccgatactggctgttggttttagatagcatttatattttctatttagcattttaatgtcctttttgtgtctgtttttcagtgtcttcctggagaatataaaactaggctggcgctaataccaagaagaggtatttttaaaggcacaaatagatgtgggattttatcaaatgatgtcttgtcagcatctctcaagatgatcatatatttttttcatttttgaaatattaatatgattaacaatatgaatagactttctagcaggatagaatattgaaatccaaggtgacttgatggaaagagcataggacagagtacctggaaacctcgattctagttctaggtttgttttttttgttttgttttgtttttgtttttttttgagacggagtctctctgtgtcgcccaggctggagtgcagtggcacgatctcggcttactgcaacctccacctcccgggttcaagcgattctcctgcctcagcctcctgagtagctgggattacaggtgtgcaccaccatgcctggctaattttttttgtactttttagtagagacggggtttcaccatgttggtcaggctggtctcaaactcctgaccccatgatctgcccacctcggcttcccaaagtgctggtaatacaggcgtgagccactgcgtccagcctctagtttggttttttaatttcaaatttgacctggacaagccagtatgttttattattccctttaacaaatatcccacattcatatttccttttctgtaaaatggcgatagttatgcatgtcctcccttccttactagggagttggaaggataatcatgagttaagaagtccttcctttacatttatttaagtgccttcacatctgtaaaagaactttggccggatgtggtggctcacgcctgtaatcccagcactttgggaggccgaggcgggcggatcacgagtttaggagatcgagaccatcctggctaacatggtgaaacccggtctctactaaaaatacaaaaaaaaattagctgggcgctgtggtgggcgcctgtagtcccagctactcgggaggctgaggcaggagaatggcatgaacccgggagatggagcttgcagtgagccaagattgtgccactgcattccagcctgggcaacagaagcaagactccgtctcaaaaaaagaaaaaaaaaaccttgaaaaaagtataaaatgaagggacctgatcttatttactgtaccttggtcaaccaaaaactctttcctttccctccctcccttcttccaacaaatatttattaagaaacttcaatgtggtctggcgcggtagctcacgcttgtaatcccagcactttgggaggccagggtgggcagatgacctgaggccaggagttcgagaccagcctgaccaacatggcaaaaccccgtctctactaaaaatacaaaaaattagcttggtgtggtggcatgcacctgtaatcccagctacttaggaggctgaggcaggagaattgcttgaacccaagaggcagaagctgcagtgagccaagatcctgccattgtactccagcttgggcaacaagagtgaaactctgtctcaaaaaaaaaaaaaagagaaaacttcactgtgctaggaattgttctagacacagggaatacagcagttacaaagtaggcaaattccctgcactgtgcagcttacattctaagaaacaaacactcatatacatgtcagctaagctatatatactatgaagataaataaagtgggggagaggggtgagggtgaggggggcaggttgtggggaagtttactttaaatggggtagtcagaaaagacctctctgaggtgacattggagcagagaacttaatggagagggaatgagccatatggaaatctggggaagaaggttccaggcagaggaaacagcaagtgcaaagaccctgaggaatggcggtgatgcccacgaagctcgagttgggtgagcaggtaggagagggagagtatttgcggtctctctctctctctttttttctttttaagctgggtctcgctcggttgcccaggctgtagtgcagtggcgtgatctcagctcagtgcaacctctgcctcctggaatcaagtgattctcccacctcagcctcctgggtagctgggactacaggtgtgcgccaccatgtctgactaattttttgtagagacggggtttcgccatctttcccatgctggtcttgaacttctagactcaggtgatcctcctgcctcagcctcccagagagctgggatttttacaggcgtgagccacgatgcctggccagatttgaggtctaagaggtcaaagagggtcagataatggaggaatttgtgtccctcccactgtttttttctaagcgtgaagggaagcctttggaggctggtgagctgtaggcgacacaatcagtcttcgtgtcttgcaggatcacgctggctgccccatgcagaataggttgaagctggttttaaattgaggcagacggacagatgcgaggggtcactcagtctgggatgataacagtggagatggtgtcatgtggaggatttgagtccctttttgcaggaggtgctgtctggatttgcagtgcattgaagatctcatctttgggacagctagttggcttttcctgtgagaagaaaatgcatcagccgcgctgccttccccagtctggaaaatctggcttgccttttccacagcaccgttgatgcggagttgggagaaaccccgagcttagccccagcaactctccaaacctctggctggactaagtgtcaaaaataactaaagggtttggatgtccccaggagaaattcttttctgaggcccaacccagaaacagatttcatggtttgatctgatacccagaggaagtggctccccactcacccagcctcccccgtggatctggggaggcttgttcagaaaggaagatgagcaagttggcctcatgccacacagttacagtttgcattagtcataggacacttcgccatggggacattgtgattaattaatagaagacggagacaacatttgggaggcatttgtttttattcggagtgtctggtcccttcagacggtccttggtgttgttccgagctgaaccacccccctgctcagtggggccaactcgctaagtcatgctcttgttctttaaactgtctccccacatctgaactccaaaaagtctcgtcttcatctctccctaatattacagcctcaagtcttcccctactgttttctgctaagttgagttctctgttgatcttctgctgacaatttatttccttctcagagcataggcatccaggcctgagcattgaaaacatcctcctttgctggtgggtacccccctccccccagttcggaggtctgtggatgtctgcagtgggtctcataagcttattggacatggagctcagaggtggtaccagagctgtgggtggataggaaagaaaaagaaggcattgtgccctctctgctggcttattcccaccacgtggagatgggaaaccacacattaaaaacaacattaaaagacgagatcaggaacttaaacagatataaaccagcagagcgtgatgggggcatttatagctgctcacccccttaatcgaagagaaatctctcgggcgggctcagtccctggactttctggtgaagagccagtctgagcaatggacagagggacaacattgcagaggtctgaaaagctggttttgaagcagaaggtgggacttgactctggaggtgggccttggacacccagccaaattgaagactagctaaaacagaggcagggtggaagcagctttccaaaacacacacccaccactgcgccaggtcattttaccattgccatggcaacacctggggattactgcctctttccatggcactgactgaggaccccagaattaccacctttttcctagaaatttctgtgtaaactgccctttaatctacatgtaattaaaagaggatgtaggccgggctgcgttggctcacacctgtaatcctagcactttgggaggccgaggcaggtagatcacaaagtcaagacatcaagaccatcctggccaacatggtgaaaccccgtctctactaaaaatacaagaattacccgggcgtggtggcacgcacctgtagtcccagctacttgggaggctgaggcaggagaatcacttgaacttgggagccggaggtgacagtgagccgagattgtaccactgcactccagcctggcgatagggcgagagactgtcttaaaaaaaaaaaaaaagtggatgtaaatatgagtgcagaactgccccgagcttctactgtctgcccagggggtagccctgctctgcagcggcggtcacagggctatagtcacagggctataaccctgtggcttcaatagagttgttttcttccatcctaccacatggattgcccttgaattctttcctgggggaagccaagaacccttatggggtaggccccactttggggctcacctgtcctagatcaatttcaggataagagaaagggccagtccttgtagagcaaaagggatctttgcacagtgttggtggggaatataaatcagttcagctattacggaaaacaggatggaggttccacaaaaaattaaaaatagaattaccatactatccagggatcccactactgggtatatatccgaaggaaataaaatctatatggaagaggcgtctgccctcctgtgttcattgagtcctgttcacaatagcccagagagggaatccaccaatgaatgagtggataaagaaaatgtggctcacacctgtaatcccagcactttgggaggccgaggcgggcggatcatgaggtcaggagatcgagaccatcctggccaacatggtgaaaccccgtctctactaaaaatacaagaaaaatagctaggcgtggtggatggtgcctgtagtcccagctactcgggaggctgaagcaggagaatggcatgaacccgggaggcagagcttgcagtgagcggagatcgcgccactggactccagcctgggcgatagagcgagactcccatctcaaaaaaaaaagaaaaaagaaaatgtggtacaggtcaggcatcccaaatcagtgctgtcatgatgctcaaagaaaatggtcattggagcattttggttttggatttttgggtatggaatgcccaacctgtatatatacacaatggcaaactattccaccttaaaaaaagagaaaatcctatcatttgtgacaacatggatcaacccagaggacattatgcaaagtgaaataagccaggccacagaaagataaataccatgtgatctcatttatatgtggactctaaaaaagttgaactcatagaagcaaagagtagaatggtgatcaccaggggctgggtggggtggggctatgggttgcgggtggggaatatgctggtcaaagaacacaaaatttagttaggaggattaagttcaggaaatggtgactatagttaataatagcgtattatattttaaaaattgctaaaagagtggattttaattgttctcaccacaaataagtatgtggagtaatgcgtagattaatgagctcagttgagccactccacagtgtatgtacaccataaatatatgttgtacaccataaatatatacaattttaatttgttaattaaaataaaatctggcgaggcgcagtggctcacacctgtaatcccagcactttgggaggccgaggcaggcagatcacttgaggccaggagttcaagaccagcctggccaacatggtgaaaccctgtctctaccaaaaatacaaagtttagctgggtgtagtggcacctgcctataatcctggctacttgggagactgagataggagaatcacttgaacccaggaggtggaggttgcagtgagctgagtgccactgcacgatctcaacctgggcgacagagcgagactccatctcaaaaaagaaaaaaaaaaaatataaaaatatataatctaattataaaatttgaaaaaagtagacaggactgattttgaagggaggggtatatgtgagagagttggtctgtctgttggtctgtgtgtctttcagagaaggatgcctgcaggggagaaagaccaagtcagaggggcttgggaggaatttaaagtctttcggtgaaaagaaggaaagggatgttggggtggaggtcggaggtgcagctgctaagcctgtgagtcagtttgaaagaaggggatgaaattttaaatgttgctacatgttatgaatgaagcccctcccccagcctttttaaaagagactttaaagattaaattgctttaaaaatgatttttttttttagttgagacagggtcttactctgtcgcccagactggtacaatcttggctcactgcaccctccgcctcctgggttcaagcgactctcgtgcctcagcctcccaagcagctaggactacaggcgcgcaccaccatacccggataatttttttgtatttttagtagagacggggtttcgccctgttggccaggccagtctcaaactcctggcctcaagtgatccacccacctcggcctcccaaagtgctgggattatgggcatgagccaccgtgcctggccaaaaataatttttgaatgatgcttgagtgatgtttctttaaatgtgataccacatggagacggagtcaggcccgagtagacaaagactgagatgatgggtgtgcacgtagggtggtggggtgaggttgaagatcagcaagttagaccaggtttaaaaggaagaggcattcttcaggggagaaggtgccagctatcatcacctgagcaaagatcaggtaaatctgaataagaagtatttagttatgggcaccagatgtttaggaaacaaaaggggtaagtgaaagaattgtgagtacgtgagcacgtatccatacgttcacgagtacatgtattcatacattcatgcgtacattttcatgcagtactcatgcaatcattgagtacattttcataccttcacgagtacatgtattgagtacatgtttttatacatttgtcagtacatgtattcatatgttcatgagtacgttttcatgcattaacatgtttttatacgttcatgttttaatacactcatgagcacatgtattcattcatgagtaccttttcatgcagtcagtacatttttatacatttatgactacatgttttcatgcattcatgagcacatttttatacattcatgtcatgttttaatacactcatgagcacatgtattcattctcgagcccgtctatttatgtattcatgagtacatgttttcatacattcatgagtatatacattcatgagcacatgtattcatacattcatgagtacatgtattcactgagtacatgttatatgttcatgagtacatgtattcatacatgcaggaatacaggaatacatgagactttgttttgttttcttttgttcttttgagacagagtctcgctctgttgtccaggctggagtgcagtggtgtgatcttggctcactgcaacctccgcctcccgggttcaagcgattcttgtgcctcagcctcccaagtagctgggattacaggcatgtgccacacgcctggctaatttttgtatttttggtagagacagggttttgccatgttggccaggctggtctcaaactcctgactttaagtgatctgcctgccttggcctcccaaagtgctgggattacaggcgtgagccaccacaccctgcccaggaatacatgagactttgaagttctgattgctaacccaagcaatgttggctgtaattatcaggccccgctgtgttcagaaacttaaagtttaggtgggaaagtaaaactcagtaatcataggtaaacagagaccaagtaagcgctgctcttcgaggtctagatatagctgtggcaagaggcacgctggggaggaagaaaagttctgggtaacctggaggggtcagggaggagtttcagaaagtagtcgtggccttggcttgggtgtggaagtaatagcaaactcagcaagataccttttatgttttgataacggctttatggagatataatttgcataccattcaattcacccctgtaaagtgtataaatcggtttttagtacattcatggagttgtgcaatcattaccatcatcaattttagaacatttccagcacctcaaaaagcaatgccattcccattagcagtcacttcccgttccccccaaccacgccttccttaggcggccacttatctatttccatctgtatagatttgcctattctggggattgcttataaatagaacaatataatatgcagccttttgtgtctggcttgtttcacttagcagaatgtttttgaggctctttctccttgtagcatgtattaggacttcatttctttttatttctgaataatggttcattggtttggatagatcacgttttgtttatttgctcatcagttggtgggcatcatttggttggtttctactttttggctctttaggaggaatcctggtatgaacgtttgtgtacatgtttttgggtggacatgtgtttttaattttcttggatgtatatccaggggtggaattgctgggtcacgtggtaagtatgtttaaccttttgaggaatggccaggctgttttccaaggctgctgtaccaccaggatcgtatgagggttccaatgcctccatatccttgccaacattggtaattatctacgtttttttttttttttttttaaatcatagctgttctagtgggtgtgaagtggtatctcactgtggttttaatttgcatttccctgaagactactggtgttggctggccatcttttcttgtgccttattgaccattcatgtttttttgttgttgttttttgtttttttttgtttttttttttgaggctgagtcttgctctgtcatccaggctggagtgcagcagcacgatcttggctcactgcaacctccacctcccgggtccaagagattctcctgcctcagcctcccaagtagctgggattacaggcgcgcgccaccacacctggctaattgtatttttagtagagacgtggtttcaccatattggccaggctggtcttgaactcctgacctcgcgatccacctgccttggcctcccaaagtgctgggattacaggcgtgagccaccatgccctgcctcatgtatcttctttggagaaaggtctatttagagcttttgcccattttgtaattgagttacattatcaatgtcttttaattattgggctgtaagtgttctttatatattctagataaaagtcccttatcagatacgtggtttgcaaaatttttctcccattctgtggtttgtcttttcactttcttaatgatgtcctttggaacacaaaagttagtaatttcaataaagaccagtttaccgattttttcctttgattccttgtgcttttggtgtcatatctatgaaggcatcacctagtctaagaaggtcatgaagatttacacctatttttttgaagagtttttttgttttgtttttgagatggggtctcactgtcactcaggctgtaatgcagtggtgtgatcatagctcactgcagccttgaccttccggtctcaaacaatcctcccacctcagcctcccaagtagctgggactacaggcatgtgccaccctgcccagctaatttttaaacctttcatagagatagtgtcttcctgcgttgcccaggctggtctcaaactcctgagctcaagtgatgcacctacctcagcctcccatcgttgctgggattacaggcataagccatggtgcctggccaagagtgttctagttttagctcttacatttagtcttttgatccattttgagttaattgtatgccgtgtgagcaaggagtccagcttcattcttttgtatgtttgtatctctcatcgcagcagtttgttgaaaagatggccctttcccccattgagtggtcttggcgtttttgctatcaaggctcctcttacctatgttatttatttaagtcaaagggtgaaaaaatgtcttctcatatatgtctgctgacccacagggagataccaaatcaatcaggattatttaggttaaaagatcatttggtttggaatttgaaaaaagaaaaagcaggccgggtgcagtgactcacgcctgtaatcccagcactttgggaggccgaggtgggcagatcacgagggaggtcaggagatcgagaccatcctggctaacacggtgaaaacccatgtctactacaaatacaaaaaattagctgggcgcggtggtgggcgcctgtaatcccagctactcgggaggctgaggcaggagaatggtgtgaacccgggaggcggagcttgcagtgagccgagatcacgccgctgcactccagcgtgggtgactctatctcaaaaaaaaaaaaaaaagagaaaagaaaaagcaaaacgatcacttatttcactgaaaatgaaaacaggcaagggatgttgttgcataaatgtaagtaatgaaatgctgggttttatgttctggcctagttaagggggtgagagggggaggcatttggcctcagctagctttggaattcaatgatctgtggattgatactcagaactgattgtatcaagtatggaatcccgggctgtgggtttgtgggtctcccatccacccctcccgtccactccctctaatggctcctgggagcagccagaggtcagcacagggacaaccaggcagagggaacagtcgtctgtggactctccacaagttgtttcttggccttgatttaggaaggggattaggaaattgtttcctctcgaagtctgcaccgcagagtggaatcctggagcactgtggcctccacctcccatgtgtgggttgggcactggagccgccccggaactgctggtgagggctggggaggatgtacgcatggcctccgtgtgtgactcgggggccccagccggggtagggccgagccctggctcccaggcctggctgggctccctggaaactggactgaatccctcgccggtgctgcctcccctcggagtccatccaagctgaacgcctgagagcagaggattagctaagccccagatgtttaggggtctgactcagtgtgtgtgtgtgctccgttgagagcttatgtggcccgagtggtggtcctggaatttgctcagatctttgcgtgggttctggtgtttaatcagcatttccaaggagatgcttgggattccaggatttactcgatttactcagagattcctctcctagtccacttcgcctggttggagcttgcccagtcttgggggtttagggggacagagactggggtcggttcacaccttggagggggccttctgcccctgctttccatcagagccctggaatcgggggattttctgcgcaagatctggtgttttcctggttcagattagtatctttaaaattaaaattcttgaatgaggattgtgtcctgcggccctgagtctgtccctctgtgagtgcacagctaaaatactttcagggctgctgggtgggactgtttgatgaggtgctggggcaaagaaaaatggagcgttccccacaggaacttgagcccaggtctcctccaggccgtggactcggtgtgcaatactccccgcctcctgacctgctcatccccagctggcacactcacttcctgggccatgtttggttcatctttacacagcaggctgtgcaaaagtgagagggcaacatggggcccctggaaaccaggcgttcccctgacgcaagctgaggctgcatctgaggaggggctcgtggaagcactgctttcttcttcccagggcttcctgttaactcactgtccagagccgtggaaggttaaactaacttgatttagggttcaaaatgcagggagcatcagccagtcattgggaacacatggccagctggaaatccacactctcccaattgtgtaatgttgccaattgatttaaactaacaacaacaacaaacaatgtaaggtgctggccagcacctaccagcaggctggctccaaccttcaggccagtaaacagcctgcactcacacccaggtttctagactcccagcctctgatgcaatctcccttcaaggataccaggactctctaggggaagaaacagagacccaaagaggttaaaaaaggtcacacagcttaagcggcagagctggggtttgaagccagaactggttcactgtctgctgtgctctcactgggactagagtcagagccggcttggttccggagcatagtctcttccccgtgccccacgctgggactggctcctaaccctcaaaagaaggctgttgtttaacaagtgagtggcttccccgaattctgggcacttctcaggagcaggaggaagatcttgagagagagaatatgtgtgtgcgcgagtgtgtgagtgtgtctgcatgtgtgtgagcgtgtgtgtgtgaatgtgtgtgttttcgagagtgtgtgcatgtctgcgtgtgtgcgctctttgtgtgtgtgcttgtgtgtgcgtgtgtgatacgtgtttgtgtgtatgtgagtgggtgtgagtgtgcgtgtgtgcatgagtgcgtgtgcgcgcgcgcgtgtgtgcatctgcgtgtttgtgtgtgcgtgtttgcacgtttgtgtgtgcatgtgcgtgagtgtgtgggtgtgtgtgcaagagtgtgtgtgagtgtatgagtgtgtgtgtgagcgtgtgtgtgtggcatgcacacattcatgtgcatgtgatttctctttccctcacaccattcattaagggtttcttccctgagaactccaggaagttccaggagaacggacaggattagagcaaatactttctcctgtctgagaagcgactcccccatttaacccttccccttccttgagtccctgggacaatcactgctggagatttggtggccagggaacccaaatagtgtggccaccacccccgacccctgctgtgggtccctggcaggtcagagggctgctctgcgatgggggccagggaacacatcagcgcaggcttcatactgcacagatgggttgcacccgtggtggtcagaacgcacatggagccagccttgtccagctctctctggctctgctgattccaagtctgtgataggaatcggggcgggtgtatgtgagggtagagaggagtggaagggaagtgtttatataaataacacagggtggaggggcttctgaaagatttactagctaaatattttccggatgttttcatcatcctttaaggcccttccagaggaaggctaaacaagacttagtctaattcccccagtggccagtggctcccacccacagctgaccccctcacacccgggcctcattctctacaccaccctgccctcctccctcctcatctccccatcaccctttactcccctctttcatccaactgggaaagaaagaacaatccccattttatccttttatgatcatattatacacacagttgtttgaccttttttttttttctttttttttttaagatggagtttcgctcttgtcacccaggctggagtgcaagagtgcaatggcaccatcttggctcacagcaacatctgcctcccatgttcaagcgattctcctgcctcagcctcccgagtagctgggattacaggtgcacaccatcacacccagctaattttgtgtttttagtagagatggggtttcaccatgttggccaggctgatcttgaactcctgacctccagtaagccatctgccttggcctcccaaagtgctgggatcataggcatgagccactgcgcccagccttgacctattttttttaaatttaatattctcagaatatatttctatcattaaatatatttacaggtttgttttagtgtttgttagtcacaatttggataaactattaatttgcaatccccttatgatggacactgaggttcttccacaccccccctttttttttttttactgctattaaaaattactgaagataaccattccttgtgatgatatctttttgcacggagagtaatttccaggaaatgtggaccactcaagtgcacattttgacccatggtgtcatactgctctttatttttatttatttattgaatttttttgaggattctcactctgtcacccaggctgaagtgcagtagcgcgaactcggctcactgcaacctccacctcccgggttcaagcgattctcttgcctcagcctcctgagtagctgggattacaggtgcgcaccaccatgctcagctaatttttgtatttttagtagagacagggtttcaccatgttggccaggctggtctccaactccgaccttaggtgatccacatgcctcagctcccccccaaactgctgggattacaggcgtgagccactgtgcccggccccacactgctctttagaaaggttgtaccaagtccttgagaatatccagtgccccattcgctggctaagcctggcatttgcaggccgaaagagagccagcaaatcatgagatctgtagccacctgcaaatggtgtgctgtgggagctaggcaggccagagccccgatctgccagtggggatttgtgcgcatgtgtggggtgcctaggatgtctgggttccttccttcgagatttagtaaggaactgtgttgtgtggaggctgcgctttcctttaggagcccgtcccattgggtctctccagggagtgagtgtgtgtttctggtcaggcctcacgggctcaagtcttgcagagtgagggaggggcagtttgcactgggctctggactgtcatttccatgtccaccttcagcttggccttttcttgttgagtgcaaggccccgccacgaggggctggttggagctgggagccgcgcggggagcccgcccaggcacagtggcggctctgtttcccactccgcctcctcaggggcccccattcacgggaaggagagtcacacattcccccttgagataagaatagagcacgactgtgccccaggacagagtccagcttcttcagccagccctgcgaggcctggcaagggctcccagatggtactggcatgagtgggccctggctgcctgccccactggcctcttgtgcattgtgtggcccggacactgggtacagtgtgtgtctgtccggggcccccctccaggaaaaccactgtctccaggctctgctcaagatggaggggcttgtctcaaatcagctgttccagggctctgctgcgcccctcctcttacctgtgggccttggactccaacctccctgccttgattcctccagccactggtgtctattcctggacgggcagaatggagcccacgtttgttgggggagcaagctctaggtgagggctggtggctggaggttggaggcaacagcctggggaccccaaaagtgctgagagatgataaacaggaccagtaggggccacagattgtttgagtgatgatcagagttttggggctttcacccttagccctgcctgtgtctgaggctcaagatggaagagctgagagtcagatcaacagcaggactggaccaggcaagaggcatgggtacattctggctcctcttggaaccattctgggtgacctttaatgtactttccagccttcagattctagggtagggcttcttaaagtgtggtccctggaccagcagcaacagaaccagcatctcttgggaacttgttggatggagctgcatattcccaggtcctgccccagacctgctggctcagaacccggcagtggagcccagctgtctgtgttttaacatgctctggaccacagctctaagtaggatgacaaacaatgctttccagagtctgacaggtgactccagtgagtcttgaggcccaccacaacctggagagcacatgccccacctgaaggccggatgcagtggctcatgcctggaatcccagcactttgggtaggccaaggcaggccgattgcttgagcccaggagtttgagaccagcctgagcaacatggtgagaccccgtcacctcaaaatctaaaaaaatcagccaggcgtggtggtgtgcacctgtagtcccagctacttaggaggctgaggtgggaggattgctcagagcccaggaggttgaggctacaatgagccatgatcacgccactgcactccaacctgggtgacaaagtgagactctgtctcaaaatcaataaataaaaatatataaaaacttcattttatttattttatgtttaaacatggggtctcccagccagccttaaaaaaaagatcttcagcttgcactgttctagatatttcagttaattgtacaactgtctgaggtagtgttttgggtttatgggtaaaaaaccaaggctccgtggaggtaaataacttgccatatggaggagttgtgattgaaagctggggcttttcaccacaagtgggggtaggctttcaacccccctcttcatggctgttaatcaaaccagcagtcagccagggagggtgagggagggcgccagggagggcgaggctccttctgctagggagttgttgttgagtcgggtcccagggggcctttctcgctttgttctgagaaaatgggtgtgtttttgagtatttgaatagggccatcacataaactgactgggaaagtgcctagaacggaggctgtctgggtctcgatctcagtgtgcacgtgtctgggagggagaggaaggatgagggtttctagaagatgctggctaaagacagagctctgtttgcaacccctcagtgggagggaaggatgaatgaaaacacaggggctggctggttttggggccttaggagtttcagaagcatcatctcctgggtgggtaccaccggtgtgcacagataaaagtgtgctcccgggagatgcaggtcacactgtacgaggaggagtgagtcgtgtcctccctctgtttacatctcgttgatgatggtgctgatgctattttgggccttggtgtgtgccgtttgagtgtggaagttgtatggctggccttcggattgtgcctcagtgcctttgttggaggcgaggcacgtgtttttggaggttccaggtagcctgggcccactaccttccaaagtcccccatgagaactggtctcagtggtttctgagatgactgtgggagggggtgcattccatgctggggtactggtggcacccaggcatcttctgagcttgtgagacttttttgggaggcttggggctggggaagcccaagggagaggttgacggggtacagggaagcatgcttggtggtctgaggttgcatcttcaataccccatgcttttacttatctcctcaacccacaggtgaacaaatcgtttcgtgggtggagagaatttttaaaaacagatctgtcgattcaggagcatttaataataatagacagcatttacataatatgattttccagacactggcctaagcactggaccttcattcactcatttaatcctcacaatagacctgtaagtagtattcttatgcctgtttgacacatggggaaactgaggcacagagcagtttaataatttccccagcatcacccagccagtgagtagcagaaccaggccatctctctccagagcccaagttctttttttaaatttttaaattttttatttgttttttgaggcagagtcttgctctgttgcccaggctggagtgcagtggcccagtcttggctcactgcaatctctgcctcccgggttcaagcgattctcctgcctcagcctcccaagtcgctgggactacaggtgcatgccaccacgtccggctaatttttgtatttttagtagagacggggtttcaccatgttggccaggctggtctcaaactcccgacctcaggtgatccaccctcctcggcctcgcaaagtgctgggattacaggcgagagccacagttcctggcctagagcccaagctcttaaccactggcggctgtatacattccaatcttctgcaccccagcccgtagagaggagatggaggaccgttgcagctcctgcagctctgccactcctgccatccgaaactcatctgcgtgcccaccttggggttccagtgggcctttgctttcatgtggcagttgtgaaggaaggaaatggtgagaaaggatgagaggaggggtgggggcagctgccgtagctgccgttctccaccctccctccccctagcagcctgccctttcctctcccccggctgcccacgtgggaagctgttggagggtgcaggctcctgagcagccctcctgagaatcttcgctgtgcttttttgttgttgttgttgttttgtttttgagacaaagtctcactcttgtcccccaggctggagtgcaatgacgcgatcttggctcactgcaacctccgcctcccaggttcaagcgattctactgcctcagcaccccgagtagctgggattacaggcacctgccaccacacccagctagttttggtatttttagtagagacggggttttcgccatgttggccaggctggtctcgaactcctgacctcaggtgatccacccgccttggcctcccttcactgtgcttttgagaacagaccttctactcgtactcttaggattgagtccgtcctggtctcgtggaaccatttgtgggagactcagcagaggaaccaggaggaaaggcagtggccccccatcctccacagctaacactctggctgctctcaaatcctcccaacttttgaggaagatgagagcggaagcatttctgcaagaatggagggaggtggccggtggctggcctggctcctggtggccgtaccttctgttggtagctgtgtcttctactggggcctggaccagcacttccagctggatatggagtgggaagagatgggcgggtccagagctggggggggattgtcacggggcgggggcagggggacaggcatgaaggccagccttgcatttcttcccagcaggaaaacccttggtgctctgctcactagcagtcctgcctgtggttagcacttccgaaagcgagtgccagcttgtggtcagaggcttgagctgccaaacaggtttggcctcctggtgtgcctgggtgtgacatcctcttctgctcttcctctgtccccaggctgcctggctctgggcgtgagaatagtcaggcaaaaggaaccaaactcgcccagcaggtgcttggatcagcactgccaggagaagacagcctgaaggacccactcgttgaacttggtgcttctaaagaagatatgctgggtctgaagcatggaatgtcaagttagctgaggaggcctaacaccagcaggtgctttggggtggcaccaggcaagttctaaggacagtgggcagcttctagagaaaccactgagttgtgatttcctgtagatgagaagacagcagttctaactaactcagggtgtggtgtgttgggagaggaaggaggagagaagtgggccttggaccttaaacaagaatcaaggacactcttgggagcatcccccagcttgtttagcatgtttcgtcatgattggcatggtcgtaggaatcccctgagacatgctcttttctaacctttctataattagttgtcttaacctctgtctccttaaataaaatgtcagcttcatgagagcactgagggcctgggccaggcccacggtgagcactcagtaactacttaatgaaggaataaatcaatacagtgagcagaagagctagaaagatctttagcaagggtaacatcttgaactctctaaaattgccacccacactccagtctaccctgaactcctgattccctttaccatgttctattcccccgatcaccttctgacattctttagaattcacttttttattgtgtttagtgtctgctccccgcaacccattcccacctcatgctggagccgtcactccaggaaagcaagggtttatttcccttctgcttttttcattgatgtgcccccagatacttagaaacagcgcctggtgcatggtatatgctccataagtatttgtcaaatgaatgaatggctgaaagtgcccggaaggcactcagcagtgccatctgtccctggggacagatgtaagaatcctcttacagtgcatgtcaccatgtggcatgtgtacgttgtgctggtgtccagtgggaggggaacacttgcctcctctgggaggtgctgcacaggctggccacctgcgctgggcctgcttggtcctcatggttaactgggccccgggggtaggaccacccccctgataagttaagacagcccagagatacacaagggcttttttttttttttttttttttggagacagagtctcactctgtcccccaggctggagtgcaatggcgcaatctcagctcactgtaacctccgcctcctgggttcaaatgattctcctgcctcagcccccagggtagctgggactacctccatcacacctggctaatttttgtatttttagtagagacggggttttaccgtgttggccaggctggcctcaaactccggacctcaagggatccaccagccttggcctcccaaagtgttgggattacaggcgtgagccactgcgcccagcccacgagggctttttggaattgactggcagggcagtgagggcccccagggcaggccggagaggctgaccaggtagtgagtggagctgttcacagatgaggattttgagcctgtggttgggctgcattccagaatccagctgtgctcccatgacttccttcccaccttatgcgctgtgagaagcggaaaaatacctggctgagaaaccgagggctcaggcgatatccctgtttactccatctctatcatcttgtcttgcaacgagtgactgacttagaaatgtaatccgggatggtcttggctgtctccacgccctggagagcaacagggtcctggtgctgcctgttaccctcggggaaaagtgcagacccaagtaggtccagctgtgtccttgacatctccacttgtcctgtccaggacgcagttgcctagcccaggtctgggctacagtggcttctcacagctcagtaaatggctagtttgtccttccagccgctggaggcaaaaaccttgactcccctttttttctcacattccacattcagcatgttgagaatgcaggttggcccttcttgcaaaacagatctttaaacacaggatcacttctcaccaccctaccactgtagccttggactgagccacagctgccaccacaatgctgccgggctgttgcaggcgcctcctggctgctctgctggtccctagtctgttgttttcacaggaagggtctgaacacatcgtgcttctgcttaccacagtccagtggtgccccatgtcggcagagtgaagacgcggaagccctacagtggctgatgaggtgctacataattgggtccccattgctgtcctgacctcagcacctgctcctccccgttggtctcactcctgtgtcactcctgcctctgtcctccgccttccgtggtgtttctttaaatgttccaggcatgcttcctcatcagggcctttgcagcccaactccctgtgggggctgagtaatggtcccctgaagatgtctaccttctaatctctggagcctgtgaatatgttaccttctgtggcagatgggattttgcagttgtgattaagttgagaaccggagatggggagataatcctggattatccacgtgggcccagtgtaagccaagggtccttatgagagggaggcaggagggccagaatcagtgttaggagatgtgatgttggaagcaagaggctgagtgacgagaggaaggggccgaaagccagggaaagtgggtgggctccagaagctgagaaaggcaaagaaatggattctctcctagagcctccaggaggaaccagccagccctgcagacatcttgactttagccctgtgaaacctgtttcagacttttgacctccagaactgtaagataataaattttcattgtttgaagcccgttagtgtatgggaatttgttacagcagcctcaggatatgaatagacctctttatctcctttcagtctctcactcactctggcaggtccacccctttgctctgttttttcttttccccccctcatcatttatcaccttccagcaaaactggatcattgacctgtctgtctggcttgttgtgggttgtgtatctcccctgctagaatgtaagctccctgaggcatggatctttgtcttgttaactgatgtatcccagtgtcgaaacctgcgtctggtgtataagaggtgttcaagaaacctgtgtcgaataaataaatgaatgaatatgaatgaatgattccttggtctggaataccttctcttcccattgtctctgccagctgccctctaagtccacttcagacccactccctacccgcaagagctctcctgtaagtgacttccctggcaggatgcggctggtgctatctgctggtcacctttcctgagcacccagtggctgtgagcagcccggccagttgcagagacccgctcagcccagggcactcttcttcagcttgcattccccggggtaagccctgcagcagccaggtactctggagagtattcattttgttccatgcatttcttacagatgagcactgtcagagtctaagggacccagctgatctctaaacccaacatttttttttttttgaggcaagagtctcactctgtcccctaggctggagtgcagtggtacaatctcagctcactgcaacctccgcctcctgggttcaagcaattcttctcctgcctcagcctcctgagtagctgggaccacaggcacacgccaccacactcggctaatttttgtacttttagtagagatggggtttggccatgttggccaggctggtcttgaactcctgacttcaaatgattcacttcccttgtcttcccaaagtgctgggattacagtcgtgagccaccatggccggccaacccaacctcattttgatgatgatctggagaggtgaggggtcccaccaaggtgctgagcaaatttctagggcttctaagtctcagaagtcctggttggatgatctgtttgggagagctccttctctccactgccacccccagggacagcgtgcctcactcgtagaaggtactaagaatttgcctggatattggagctttggaatctgtcatggctggggaggttggtgagtggggcacggttttaagggaaggtataaggttctccccagggactaggggcgggggagaccaaaggatttgtcttgttgttaacaacagtagtatggaggatggggagtttggaaaaaggaaaggaagaaaagacaagaaatggtaataagtatgggcaagagttgtgtgcccacaatggacacctcatgctaggggacccccaagtgtatggacactgccaagaaggggcaaggagggatgagagaggccttctctgtgctgaggtgtgcttccccggggcacagctgcagcctgtaaagggtgaacagttaggaacacttctttctgctgtcttctctggggaggacacgtgttgcaacacttcctgagttggggaggaggtgacactttgccccccaccctccttcagactgctgatgaagtgtgcttagttatgaacctacagctgtgtttttgcagcgttccccccgcctgtgcacccgccagtcccacggggggctcccctccctccttccgtccctggtccttccctctgctggctggtgactcactcagctcttgtgcaacagcccaggctctcgctcagagaagagctgttttcctccatcccataagcccccgtcctaatttatgtcttttcatttgggttaatgctttccacatttaggtctggagattagcgtgtggctcattgatgcaaccaccaaaaccccagtgccagcttgggtctggcacagagaggcagccagccagccagccagacagacagacagacagaggacagcttggagcatgacccccagcctgttggtctgcagctggcccagccctgccagccacagaggcagagcgaggaggcagccctgactcctggcttgccagagaatcattctcatgccagtttcctgtgaaggacacgcatcttggaatggcgtgaagaggagattgccccaagcctgtgacttctcattgaggaaactgtgtgtcgggaagtgagaggcacaagttctagggtgtggaaaaatgcgatctctgtggctttcaaagctgtcacacaacacagtgtgtgtgtgtgtgtgtgtgtgtgtgtgtgtgtgtggtttttctcttctctttagaacaataatattacctttgttgctatggtgttgttatgggggtggctaattggacacagccctgatgctggctggtgtgtggtgtccatagtgattatcagacggcagccatgggacctgctttgattttcttccctggagtgagaagcaggcagaggatcactcggtggctgtgtataccctgcctttggtggtggcaccccagtcagaaacgggaccctgaagctgggatttaggtaaggggaggacctttccaaggcttgtttacagctcagatttgcagaggaccaggtatttgggaactcctcttctgaagaaccagattgcagggcagggcacaacgaggggcctgttgcatcttgggagcacagggctgtgtgctctggtaacctgggcccactcacctggcaggcactggcttccttcccagtgagactgtagcattgacggaaaagtgcatggtggctcatgcctgtaatctcagcactttaagaggctgaggcaggaggatttcttgagcccaggagtttgagatcagcctgcgcaacatagggagacccccatctctacaaaaaataatgaaagaaaaaaaaagattagccaggcgtggtggtgcatgcctgtagccccagctactcgggaggctgaggcaggaagatcacttgagcccgggaggttgaggctgcagtgagctgtgatcacaccactgcactccagcctgggcaagatagcaagaccctatcttgagaaacaaaagagacagaagtatgtttggtcagtatgtatacccaaaagtatatctgttaattttatacttatcaaataggtaatatatgctcaggtctgatatctgaaaggtacaaaaaacgtagagtgaaaagttggtctccttcccatccctgtcctcaacctatcagttcccttcccgagtggcaaacaagtgatcagtttcttgtgggtacttccagaagtagtccaggaatttccaaatatgtttcattttattttccttaacccaggaaaccgtgtgtcgggaagtgagaggcacaagttgtagggggcggaaaaatgcgatctctgtggttttctgaacacaggtatcccctctatacttctgcaccttgctggtgctactgatgctttttgttaaatcatataacatatcttggagtttagtcaataggaagagcttcctcctcctgtttaatgcctgccccactcatttcaccaatgggcataaaggttgcttctaatctttctctgttacctttacctgttgctgctgtggatagcctcgtatatccatcattctgcacgtgggtgagggtctctgaagggcaagtttctgaggttgaaaggttggaacaaagaatatatgtgtttgtagttttgacagaaagggccagattgcctctaacaagactgttctagcttacacttctgctagcagcgagtaggagtgcctgctttcccatagccttgccagcatcgtgcactttcagatttttttttaatttctgcttggaaaagtttgtctttactttctgttgaatttctctcccatggctcccccactctattgcagcctcccatgcaggcagtgagtggatggggtccctctctgcttccctgggccatagggagtggaccctcagaggaccctctgtcttgcagatcgttgggtggacttggtctagcctctctgcaggccagtcggttgttttacatatagatcttaagggaaagaatcctttgcaacacttgaattttctacttgtgatgacactactggactctcttttctcttttctttttctttttttcttttcttttctttctttccttccttccctctttcttccttttctctctcttttcttttctttctttctctttctctctttctttctttcttttttcttttctttgtttgtttttgagatgcagtttcactctcatggcccaggctggagtgcactggtatgatctcagctcaccacaacctctgcctcccaggttcaagcaattctcctgctgaattcagcctcctgagtagctgggattacaggcatgtgccaccatgcccggctaattttgtatttttagtagagttggggtttctccatgttggtcaggctggtctcgaactcctcacctcaggtgatccacccacctcagcctctgaaagtgctgggattacaggcgtgagacaccgcgcccggctagactccattttctacatgctactcctattatcttttcctacttccctcctctctctcatctccatctgccctaccttgctcctgcctgagtcttcctcttgttttccagtgttctgtgtcttctgcctctccctttccaaagatagagtcttttcagtgaaaagccccacacgtgggcaaacacccctggaaagcatccctcgctgtgtgtcttcggtcacgtgctcgaggatgcatccacggtggaattggatgcagtgacagcatttctctgctcccaggcttttctaagtcagggagctggaggtgaagctgtagcaaagaatgcctggagagatgccctcaggcagcacagcccagtagaactctctgaggatggcaatgttctacttttgtgacgcccagtacggtagccactaacatgtggctggtgcaactgcggaagtggttctttcatttggattaatttatattgaggggctgtatgtgtccactgactaccatatgggagagcacaggtctaaactgtatgcttttagcatgaaaataagagtctaagaagcagagtgtatctggtctaggtttcctcaagtcgaaacacggcagcagttcttcatcagggtatccaggccccatgacctggtccaattttggaactcccgaatttcgcctattggaaacacaattggggttaggctgccagacccaccaaggagggtcgcaattcccttggaatataggcctcccttaaagacttatttatttatttagagacggagtcttgccctgtctccaggctggagtgcagtggcgtgatctcggctcactgtaccctctgcctcctgggttcaagcgattctcctgcctcagcctcccaagtatatttctggttttttgtttgtttgtttgtttgtttttttgagacagagtctcactctgtcacccaggctggagtgcagtggcacagtcttggctcactgcaacgtccgcctcccgggttcatgccattctcctgcctcagcctcccaagtagctgagactacaggtgcacgacaccacgcctggctattattttgtatttttaatagagacggggtttcactgtgttatccaacattgtctcaatctccttacccatcatccgcccacctcggcctcccaaagttgtgggattacaggcgtgagccattgcgcctggccatttctgtatttttagtagagacggggtttcaccatgttgaccaggctggtctcgaactcctgacctcaaaggatcctcccatctcagcctcccaaactgctaggattacaggtgccagccaagacacccggcccccttaaggacttttgatatccatagatgtacacagcagttactgacctacaagttgtggacaccaaagcaaactagccctgtctaaatagagcatcttgtgttattttactttttaatcgacgcgtaatgttttacatatttatggggtagatgtgatatttggttgcatgtatagaatgtataataattgataagtcagggtatttggggtatccataaccttagcgtcagtcattgctgtgtgttgggaacaaacattcttctagctgtttcaaaatgtgtgatatattgttgctaactataatccctctgctctgctatccaactttagaacttgtatcttctggctgggcgcagtggctcatgcctgtaatcccagcactttgggaggctgaggcgggcagatcacttgaggtcaggagttcgagaccagcctgaccaatatggtgaaacaccgtctctactaaaaatacaaaaatcagccagacgtggtgacatgcacctgtagtcccaactacttgggaggctgaggcttagacaggagaattggttgaacccgggagacggaggttgccgtgagccaagattgcgccattgcacttcagcctgggtgtcacagcgagactccgtcttaaaaaaaaagaaaagaacttatatcttctgtctaactgtatgtttgtaccccttaaccaaactctcttcatcccccctctttcccacacacccttcctagcctctagttaactatctactctcatctccacgagagcaacttttttagctcctacatatcagtgagaacactgatctttgtctttctatgcctggcttatttaacttaacataataacctccagttccgttcatgttgctgctaatgacatgatttctttctttttcatgctgaatagaattccacggtgtatatataccgcatttttttatccacttgtccattgatggacacttaggttgattccataattttgctattgtgaatcatgctgcagtaaacgtgtgagtacaggtatctctttgatatcttttttttttttttttttttgagacggagccttgctgtgtcgcccaggctgaagtgcaatggcacaatctcggctcactgcaacctccacctcccgggttcaagtgattctcctgcctcatcctcccgaatagctgggattacaggcgcccaccaccacgcccagctgatttttgtatttttagtacagagggggttttaccacgttggccaggctggtctcaaactcctgacctcatgatccacccgcctctgcctcccaaagtgctgggattacaggcgtgtaccaccgcgcctggccctgtttttgtatttttaagtagagacggagttttgctatgttggccaggctggtcttgaactcctgatctcaggtgatccacctgccttggcctcccaaagtgttggaattacaggcgtgagccactgctcctggcctgatgtcttttgatatcctgatttctttttgtttggataaatacccagcagtgggattgctggatggtatggttgttctatttttagttttctgagaagtctctgtactggtttccccagtggctgtaccaatttgcattcccaccagtagtgtacaagagatcccatctttcctcatccttggcagtatctgttattttttatctttttaatgatattttttatctttttaatgatagctgttctaacggctgtcattagcagcaacatgaatggaactggaggttattatgttaccttaagttaaataagccaggcatacccgttctaactctggcgtaagatgatagctcgttgtggttttaatttgaatttccctggtgattagtgatgttgggtatttttttatatgcctgttagcaatttgtatgtcttctgttgagaatgtctattcatgccctttgcctactttttaatggttattttatttttatttatttttatttttttaaattttttttgctgttgagttccttgtatattctggctattagtccctcatcagataaatagttttcaaatattctctcccattcaatagattgtctttccactttgttgactgtttcctttgctttgtaaaacctttttagtttaatatgggcccatttgtctatttttggttttgttgtctgtgcttttgaggtcttaactgtaaaatctttgcctagaccaatgtcctgaagtgttctttctagtagttttatagtttcgagccttagtttaagtctttaatccatcttgagttgatttttgtatatggtgagagataggggtccagttttattcctctacgtatggatatccagtttcctcaacacccctgattgaagagactgtcctttcctcaatgtgtattcttggtgcttttgttgaaactcagttggctgtaaatacatggatttatttctggattctctattctgttccattggtctacgtgcctgtttttatatgaacgtcatgctatctggttactctgcagtgcaatttttaaatatctgagctaaatacaaagacagatcctccaaaatctgaaactttttcaggactatatgatgctcaaagaaaatgctcactggggcatgcattaaatagaaaatcacagtgcatggtagacacacttgacagcaataagttaagcataccctgagaacgaccctgtgtggtagatgcaccagaatgtgtgtgtggatttccatgctaaagaatcaggcagtggccaactcagagattcattccttacctatgagaaacatctgagcccttggcccgtccagtggaacacaggccatatggaggaccaaggccctttcttttgggttaaatgaaggttgccaggtggaggttgttagggagaggatgcaaagcaaaaatgctctataaactgcatgcttcaggcaagtgcttgcagttctcctgcctagctggccacgctgggccatgtggttctccagcccagcccgccactggactgtggtacagtgattctcttgcccagaccccctctggactatggtaaggtggttcccctgccaagccctccactggactgtggtaaagtgattctcttgcccagtcccccactgggactgtgtgtaaggtggttctcctgcccagctcccactggactgtgtgtaaggcggtttccctaaccagcccaccaccactggactgtgtaaggcagttcccctgcccagtcccctactggactgtgtgtaaggtggttctcctacccagtcccctactggactgtgtgtaaggcggttctcctgcccagcccctcactggactgtgtgtaaggcggtttccctaaccagctcaccaccagtggactgtgtgtaaggtggttcccctgctcagcctgccaccactggactgtgtgtaaggtagttctcctgcccagcccaccaccactggactgtgtaaggcggttctcctgcccagccccccactggactgtgtgtaaggcggtttccctaaccagctcaccaccactggactgtgtgtaaggtggttcccctgctcagcctgccactggactatgtgtaaggtagttctcctgcccagcccgccaccactggactgtgtgtaaggcagttctcctgcccagcccgccaccactggactgtatataagctacttctccttcccagcctgccaccactggaccactctgtatgtaagtttccagctgataaaaccctgtgtctcattggctggctctgtgtctcgtctttggcctcttgaacctggggccgttcctataaaggttaatggaggcccagcaagacagacaaagtagaacttcaccttgtagtgttatgtaagaggaagtgtgttagtttcccattgctgctgtaacgaatgccacaaatgcagtgacttaaaatgcatttatttactcatagttctaaggatccaaagtctgaaatgagttttacaaggctaaaaattaaggtgtcggcagggctggtccttctggaagctccaaggagaatctgttccttcctgttttcatcctcttgaactccttccttggcgcctgtttccaccttggtgtaaggaaccaccttaccacagtccagtgggactgtggcatcagcctctttcttctttgaccttgtcttcctcttagaccctgtgattgcatttagaacctacccagataatccagaataactcccccacctcaaaatccttaagtcagtcatgccctacaaagtcccttttgccatataaggtaacattcacaggttctggtgattaagatattaatatatttgggggggggggcactttcaagcctaccacagcgggtatcttttaataattgaagaagagcaggtttgtgtgagaggacgttattcgccaagtcggtcactccccaggagttctgagttgctggaattggttaagtgatctttaactagaggctgggaagggtgtgtgggtgggagcgaggatgaagagaggttgagctattcatgttgaaggtctaatgctctaaagatgcaaatctcaaatctcctaaggaaggtggaaaaagtacagagattcagactctatcctgcttccgtgagcctggacctgtgtgttcttcattagctctcccggtgattctgatcctcagcaaagtttgagactgttgaattttagacatggtcttggggattatctgtgtgcctgcacatgggatgtgagacttcttgagtaagagccaaagctgggctgcagacaggtgctggagaagatcagaggaggggccggtgtctgcggaggagccgccacccgagccacacctggaaggtaagagaaggtgtggccttccctgagaagcagggcaggtgctccaagcagagggagaggccttaccagcagcaccgaggtaggaatacgcatggcacttttggggatgtggaggctatttgggaccagaagatggaggaaccgggagttgatatgacaagaggaatgttagtaggagtaacgtgctaatgtttgcagggttgactggagggcagaggtaggattctgtttatagtactgcccaggaggagaggataaaggccccgcctgggtggtggcagggataatgatgagaaggtgatggttgtgagagactcgagaggaaatacgaacatggcaaggtctggcagtccactaacacttactgagcagagtcatcgggcagatgcaggaggaggagctggaatgcagtggtgagtaagactacccaggtccctgatctcacgagtatactttggggtggagaggtggggtagagttggggaataagctgacagacgcaaacaagaaaggcatgagctagtgatacgtgctctgcagttacacgggctcatgcgattgggaggaagtgggtggcttctttggattgggagcttagggaaggcctctctggagcggtgacgcttaaactgttgtctggatgacaagaagcagctggccacagggaggggaaggggaacagcattccaggcagaggtgacagcaagtgcaaaagtgtcatgcaagatcagacctgcctcatcctgggaatgctagaacagcacagtccaatagaaatttctgcagggacagggatgctctaggcctgtaccatctaacatggtagccactagtcacatgggaccgctgagcacttgcaaaatggctagtgagaccaaggaactgaattttatttgagtttgaataagagtcaaagctgggctgcaggcaggtgctggagaagatcagaggaggggccggtgtttgtggaggagccaccacctgagccacaccacacctggaaggcaagagaaggtgtggcttccccctaaaagcagggcaggtgctccaagcagagggagacgccttaccaacggcgtcgggtaggaatacgcatggcatgtttgcattctatttgagtttcaattaatttaattttaactttaaatagccgtatgtggccagagtctcctgcattggacagcacagagctagaaggtcagggtggctggaggggaagagcagaaaacagtgtaaggtgaggtagtcagaggcaggctttattgctttatgaattagggtaaatggtttgggttggtttttctaggagtagtgcaaagccttgggatgattttagttacaaggctgacataatttgatggatgttttataagttccctctggctgcaatgtgagaatgaattggaggggatgaaaagtggaacaagaagatcatcgtaataatgtagggaacagcatggcagcagtggagaaggaaaatgtggatggatcaggatgttttagagatagaactgataggtgagaggaattggatgtggaaggtgtgtggacttgagaatcctagattttggggtgtaagcaacaggatgatagatggtggtaccatttattaaaatgagttatggagagcaggtctagttttgtttttggaagtgaagaaaatgagtcattagattcgttagattcctcctgagcatcagcatagggatgataggtagccaggtggccatgggtctggagagctgggacaggtcagggctagagatattaatttagagtcattgggaatagagaatgtctgaagctatggaacagggtcaggccactacagggagtgagtagatagaaaagaggtggggcaggagtgagctctgggcactgtgacatttaagaacacacagaggatgatccaaaaaggtgactacttgagaaaacccatgagatgtcatgggagcccagagcagtcatggtttctggaaaaaggggacattgaatgttgctggctggccaacgactctagaagagagacagatgcccttggatttggtgacaacatggaggtcactggtgacattgtggagagtaggctcagtggagtgggaaggagggaattagaggtaaaagattcgaagccgtgactacaggcaacatttttggtgaaaattttttctgttaggagaaggaaatgaataaaggaatggagaactggggtcaaaggatatatttatctttaattttttaaatttaaaggtaggtattatgtgctgatcggtagaaagcaggtaagttgcctttggtaggaggagttactgttgtgggagggaaggctgcgagcgtgggctctgatgtgggtaggataggatgaatttgggctgtgggttgatgagcagctactatgggttctatgggtttgcttctttttttttttttttgagattttttgagatgcagtcttgctgtgtcacccaggctggagtgcaatggtgagatcttggctcactgcaacctctgcctcccaggttcaagcagttctcctgcctcagcctccctagtagccgggattacaggcatgtgccaccacacccagctaatttttgtatttttggtagagacggggtttctccatgttggccaggctggtcttgaactcctgacctcaggtgatccgcccacctcggcctcccaaagtgctgggattacaggtgggagccatcgcgcctggccgggttgttcctatctttctaagtgaagtgtgagagaaaacatttcccatcatctgagaaatgaaatcgttgttttggaaaatggaaaacagtctcactgggcagctagagtagggtcgctagatggcatgagctgtgcttctcaaatttaaatgtgcaaaccaactacatgggggttggttggttggtttgtttgagacagggtcttaacctatcacccagactggatggagtacagtgttacagtcacagctctcactgcagcctctactccccaggctcaggtgattctcccaccttagcctcctgagtagctaggaccacaagtgtgcaccaccacgcctggctaatttttttagaggaggggttttgccatattgcccaggctggtctcaaactcctgggctcttagcaatctgcccacctcggcctcccaaaatgctgggattacaggtgtgagccactacgtccggtcagggtttgttaaaatgcagattctgcatttctaacaagcttctaggcgacaggaatgctgctggtgcctccctggatcccactctgaggatcgagattccacagcccttcctcaatgggaagtttaggaagagacagtttcctaaaatgtgtccaggatatgcctaattactcgcctattgaacattcatttggggcagagtaagcaagagttgagtgcctgtttgggatttgtggctctccgtttaaaatgggtcttgtcaatgttggaattatctggggaacataaagacccggaaaccaaaccaaaaaaaaaaaacagggcctgggtattttgattttgatggaggttgtgaattaattggtatagagtgtgtcctgggtaccctactttaaaaaatctcctctggtaattcagatgctcatccaggcttgagaagtctggatttaaaataccaggtcaggggatgaccactggaataggtagccaaggtggtgtggaggcagggctgcccctagaacgtgtgggcacttgtctatgtaagcaatgtgggtcactcaaaatcagcatgcggaggccattctagctgcccaaccttgcgtagtcccaccaaagaaatacttagtcagctagccgactaagagattagactactatgctggaaactctgattttcatggctgggacagtaggaattagttctccttgaaaattccagactctttgtacaaattacccttaatttcagctgaattggtgtagcataattcaggggtcaccttgtgctcccctctgaattagaaggctgaatctcagtggtcaacaatggggaagattcttttttttttttttttttttttttttacgggcactctttcttttcttccttctagatcaatcagatttctttcagtgcgttttcaaaactcattcagcttagatctggtttgttttcttccttgaaaaaaaatgtattaatataataccacaatctctgagctaaacaatgaccctataggcccactgttcagagctccttggggtgtctggattaccttatgcatgggcactatttggggagggagttgcttagatggttctgccagtctctgctggtcccagaccccttagaaaatttcatagaagacaggcagagggcagggccccatgtaccaggcagcctggccaagaaccagggcagaagcacaaagagcgtgaaaaactgagaagccaacttagatgggtcctggcatccctttgccaaaacgcatggtgggaacagtgatagaagtcaggggctaatgcttctctttaaccaatgagagggagtgcctggaagagtcagccatgactgtaacaaggagttgtggtaaagtccgagggaccctgggttttaagtggtagcagcccaagtcaaaccagctgagcgacagtcacagagtgtggggtgcagggatttattggccctcatgaatgaaaagcccacaggcgtgtggctgtaggtaccgcctgttctagagatgtgttaggtggcctctaagatggctttctgtgctccctgcctcctggtcactcttgtgtaatcccttccccttgagtgtgggcgggacacagtaacttgcttctaacaatagatatgacagaatgtcactcctgagagcaggtaacaaaatggccgtggcttccgccatgcttgttttctcttgcctgcttgctggttggctgtcctagggagagacgcatgtggcaagaaactaacaaatgcctcaacagcctcaacatgaatgagtttggaagcagattctcctctgattgagacttatggtgactacagccctggctgacatcttgattgtagccttgggagagaccctgggtaaggctcggggtctgggaaaaccatgcgtggatacctgctccccagaaactgaatccataagtgaccatatttggttttttttgtttttgagatggggtcttgctatgttgcttagactggtctggacctcctgggctcaagtgatcctcctgcctcagccttccgagtagctgggattacaggcatgagccactgcacgtggccaaatgactgttgttttaagtcgctaatttttgggcaaatttgttacacccagtaaataaccaatagaagaagcaaaggcagtgtcatcagaaatctccatctctaggctttgcatccctctgttttagcttcattttctagcttagcaatcttctcagaaaaccctttttatcccgctttggaattatgaagtttttagaatctttctgactctaaaaactttctgattctaaagactttagagtctttctgattctaaaaacttcgtaattccaaagaggggaaaaaaaccaggaaagtcacctagcagctttcagatggagcctggatgggggggttgggaggtggatcagccccatcctcaccacctgggctgagaagggagcaaatgcaagtcagctgatacctgagggaggagaatggatgtctacccacaatggtaactggtaagatatggtagtgatggaatccttgctctcacctggatgggatttgagagatccggtctagctctcaggcagagatggaagcaggatggttagtgttagagaagttgtagagacctgaaggaatagagggcagagaggagacctctgggaagtggcattctgtgctgaactttgtgtgagtccatgtgcctgaatccacacaaagggagaaaaagatgctgaggaaatcaagatgaacagatacagatcatttctttgagtgtccggcaacatgtttttgatcatctgtgctaaataggagataaggttgcaggttgagctagaaatataatgaaatcaaccacaaaaagtcaaggatgtaaagagccgtgtatcaattgttcagttcaattatattttaaatccgaataattccactgagtcttcttttaacccaaagttttcatttcctctttcggagcctttaaactcctaataaggaggataatagatggatctcaacctcctcttttcttgtctctttccattcctgatcttctatgtaggtgctaagggaactggtctaagaagctaagaatatttcttgaacccattaggacagaagagtgttctggccttccactgtccactgtccctgttatatgcttttagagattgacacagtcttaagtcttaagtgaatttggaagaaaggtaacgaattacactcttaggttttgaatatattaggttggtgagagggtataccttggggagaaggccagggcagagggcacctaaggactgggacacttaggtgctgcacccagggtgactaatcttgcaaaagtcacagagattcagcttccctttcaaaatgaagagttgtatatgtacacacatttgcattgttatatctggctatgccttgcccaggatgggtctctttcctattgtgtggaatgtctccactcccccgccgtccaaaaaaaagtacattggaggagaaattaagcaatgtaattcattcttcactttcggcacccccagtgcagggtgccctgccagaaccactccagggcggtggaaagatgctgctctcggatcacttaacagcatgacggtgtttaaacttttcaccggccagaaagatttgcaaagtccctgcctgctctggttgtaccctgctgcaggcagatctgcctctttcggcgtctgtggtagaagcctcacagggccatgtggaacctgttttggggagggctccccaggaatgcaccctaagcttagcagtgggctggtggaacaggcgctgtttggtaaatgggtgggcagagggagggtttggatgggtgtgtctccacctctccatgcattttctgatgactcacaggcttattactggaaggggcctctgagatagattattaaatccagcaggcctatttcacaagcataaggagacagggcttagagaaagtcctgctactagctaatggagagctgacattcggtacccatctctcacctccatgcccatggccacaactctgcccttcatctaacctgtgttatctgcattctttttttattttctttttttgagatggagtctcgctctgtcatccaggctggagtgcagtggcacgatcttggctcactgcaagctccgcctaccgggttcacgccattctgcctcagcctcccaagtagctgggactacaggtgcccgccaccacacccggctaattttttgtatttttagtagagacagggcttcaccgtgttagccaggatggtctggatctcctgacctcgtgatccgcccatctcagcctcccaaagtgctgggattacaggcatcagccaccgcgcccggccacctgttttatctgtgttctgaaggagagtgcctggctagggatatgcccacttcccatggctctgagccaatccttgtagctcctgtcatacctattgtagcatataatcccactttacactcttcctctgctgtctcggccactgggacaagaaggtctgacccacctttggcaaacaaaggcttctttcttgcttggagcctgaaccacctcatcacctcatcaccctgcatcctcgttaggttcattttgtggtggatggagagatctgggcaaaagcagccactacaggacagcgtggaagacagcagtgggcagccctggctgcatggggtgagtggagagttgtggctggaggtgtcttttggcagcagctggggaagccacctcctgctctcctggccaggctagtcctagagggaggtccccacagctgtccctaccccttgtagcccgcggctccagctcactctttattccatgtgctctgggtgcccaagagtctcctggagagaagaaaagggtggcataaggtgaatgggggcatggagtggcacagaagtttggggacaccccagggtctcttgggcacaaggaggcgagtcccaatgtacacttttttttttttttttgagatggagtcttgctctgtcacccgggctggagtgcagtggcacgatcttggctcattgcgacctctgcctcctgggttcaagtgattctcctgtctcagcctcccaaatagctgggattacagtcgcctgccaccacctgtggctaatttttatatttttagtagagacggggtttcgctatgttggccaggctggtctcgaactcctgacttcaggtgatctgcccgcctcggcctcccaaagtgctgggattacaggggtgagccaccgtgcctggcccccagtgtacattttttaccacccaccccctgacccagagcgagggcagaggttgcctagtgtgtacctgtcgtgcctgccatacctgcctgcggattccgatagaagcacagagcccacatgggttattacggctctgaggtcctgagtttgtaaaaatgtgaaaaactcagcagcctggaagggatctcatggaggccagggctttgtgcttgtgccctgcaagagctgctgcacctgcttcacctgatttgtgtgtccagtgtgtcctgctcgccctgcttttttggaggtgagctgtgtgccccggttcctctcgtcaccctgggaatgtggctgtgtgtaagatctatacctggcagagccccgagagactgagtaaccccatccggggagtctctcttctgctctgccatcttcctcccattcagtcaagcaagtattttttgagtcaccttctgggttaatgcagagatgttgtgagtgggccctgaccactgccataggagcttgcggtcttgttggaagagccgagtttaagcagggaactgtagtaaatgtattcagaatgttatgggggctcagagaagggagaggaaggtgaggaggccttacagaggagtaggattccccaagactagagagggaaggcagcccagcgccagagatcggcgtgggcaaaggcacagagacatcagaggaatgcttgggaattaaataaggcagctggcttgaaaagttttttggggtatttgttgtgtttttgatttagaaaatgtctggcatagctgcagggtgaggggatggtgagatgatgagggaaggaaggaaattgcagcctcggatgggaccctttctattgcaaaggctagaaaaccagcccagtatggcttaagccaagaagggcgtgttttggacgccactcgtggatccgtaggttctgtggctacaggatccaaagatgtcaggatgtgcgctttctcacttgagctgcacgttggaagctggcagctccagactggtatcctccctgcgctgagaccattggcaaaagacagctccttttccataagatgaagccccatgaaatggagtggcttgtcagaaccaggtgctggttctgaattgactgggtgatggccttaggcctgggtctgttgggtgggtagtgctgtccatacctgagaatggagaagtgtggctccccacaggaaaatggagtgccatccttggaagaaggccactgtggggtatgcaggcccaagtgacagattcctcattggcttaccacaacatggaagctccctgaaggacttgtgcttggattttgcctgtagggcccattagaagttattttgagtgaggacaccctcccctggcaaacagaagaggggaggcatttggaggcacagaaaaaacttggagagatcttggcagttgagtacaggggatttgggaagtggttgactgtagggaatttgataaattgaaaagtctgattttggtttggcttctagggactataacatagaaaatatatatatatgtggcagagactggttggggcaaacagaatttgcctttgcatatcctgaatttgaggtgtcagtggcctgtgattctcagactgagtgtgctttatcagacaagttggggccttggcgcagacttgggagtgatctgcagagacgctgctgagggagcagatgaacctggcaagagaatgctgtgggggagaaagcaggaccagggatggagccccaaggaacatacccgcaatgggcacagccaggttgaggaatgaggaggaacaggaaggtggatcagtgacttcagagaacacgtcattctgcaaaggaagggaaaggactgggttaaagaggtttgtgctgtttgtaggggatggagcacacgggcagaggtgttaagatctgagaaccttatttttttttttttttttgagatggagtctcgctctgtcaccaggctggagtgcagtggcatgatctcagctcactgcaacctctgactctcctgccttagcctcccgagtagctgggattacaggcatgcaccaccatgcccagctaatttttgtatttttggaagagacagggtttcaccatgttggccaggatggtctcgatctcctgaccttgtgatccgcccgcctcagcctccgaaaatgctgggattacaggcatgagccactgcggccaagatctgagaaacttacacatttgtcatcaaactggaccttcaaaggatgaattttattgtctataaattccactgccacaggccagccgtggtgactcacgcctgtaatctcagcactttggcaggatcacttgagcccaggagttcgagggcccagtgatttctggagaatttgggatagcagttccttctggaataaagaatggtcagatcaggaagggacactcagaaagcttcatggagtttactttattatgctacacatttatgtgttatgcaatttttgtgtatattatgttgtctaatcaaagtttagaaaatagatttcagggaataccaatataccttcctatgtgccaggtgtaatttacacttcttggcacattcagcgtccataagagccctgtaaggagggtcctattatcattgtcaatgcgtgaggaaacctaggcacaggaagttgtgcagctgggacttgaacctaggccatctggttccagagccctttttgttaaaggccgcgtggaaagattgcatgtggcgatctggaggccatccagttgagtgctgaggggtggaaatcatattgcggatgacagaaatggaaatgaagggagagtaaggcagtgagaaggttgttaaaagacgggatgataaactgtatcttcttgctctgcctgaatggtggttacaaagacttactgttttattaaattctgttaatcccctcgtgaggcaggtttttagcatcactgttttaaagatccagagagtggccgggcgcggtggctcacacctgtaatcccagcactttgggaggccgaggcgggcggatcatgaggtcaggagatcgagactatcctggctaacacggtgaaaccctgtctctactaaaaatacaaaaaattagtcaggcgtggtggcgcgtgtctgtggtctcagctacttgggagtctgaggcaggagaattgcttgaatccaggaggcggaggttgcagtgagccgagatcgcgccgctgcactacagcctgtgctacagagcaagactctgtctcaaaaaaaagaaaaaaaagaaaaagaaaaagaaatatccagagagttcccatggctcgcctaaggacagaggtaggcagtggaagggacctggagctctggccttatgacctgtattcttttaactcttgtgttgatactgtgactgtgaggtcctgacagctggcagctgagctcatatccttcaggaatgacccagctgtgcattcagggagataccaggtgttttctctctgctaagtaagtgggtaccacacagggcacagctgctcagctaactgccagggcttgctgagtgcctggggcctgcaagctgctgatcttggggtctttgccttaggttagcgattagcagtctgtaacccatggaccattggtcgtattccttaggttcatggcagctgccataggtctgtgctgaggaagagggataagcagcaaagagttgtcccctatttgcaagctgatttgatgtacccatcacttagtccatgggttaaggaagttcccacatctttgcttcttatgccagaaggggaccttgatggctgtctcctgagagggtgctgagccatgtctgatttcttgggagtggctaaccagcaaaggatttaaaatgagaggtttcaataacacgtattgaaatacgtagtagtagatgaaatacatagtagatgaaatacgtagtagtgttcagtgaaaaaaatggggtcagctgaacatagagtctaatgtcaactgtattaagaataaatttcgtgaaatactcatagcaggattgtaggtatttgattttttccccgcataacaactgttcgtaggattgcaggtggtgggagggaagcttttggcccctctttccatgggagctcctgattttgattcttgttttaagccctcagcaagcttttcagctttttttttttttttttttttgagacggagtctcactctgttgccaggctgatcttggctcactgcaacctctgcctcctgggttcaagcgattctcctgcttcagcctcctgagtagctgggactcaggcgtgtgccaccatgcccagctaatttttgtatgtttagtagagactgggttttaccatgttagccaggatggtctcaatctgttgaccttgtgatctgcccgcctcccaaagtgctgggattacaggcgtgagccaccatgcccagctgcttttcagccttttaaaaaactcaatataaaggctcaggatattagatatgaatggactcatagaagcaacagcttccttataaaggtgagatagtgggggcttgacaaggggttggtcttgtccaaggttgtgtagcattgggactagagcacagtctcccgaaccctttcctaaaaccctaaaacacagcaacgacattgacataagtgagcagcagcacagttagcgagtatggtggactaaagactggctcctacagatattcaggtccttatccttagagtctgtgaacttaccttatatggcaagacggattttgcagatgtggttaagttaaggatttggggactaggaggttattttggattatctgggtgggtcctaaatgcaatcacaactgtgcctctgagagagagagggagattttgccaacacatacagaggagaaggtgatgtgaccatggagacaaagatcagggtgatgcaaccacaagccaaggaatgctggcagctaccagagaatctggaagagacaaggaacaattttcccctagagcctccaaggggggcgtggccctcctgacaccttgatttttgacttggttttggacttctgacctcagaatattgtaagagaaaacatgtgggttgaagccaagaggtttgtgattgttacagcagtcatatgaaactaatgcagcaagcacttgtcaaagtcaacctgttgaacgctcacctgccaagatgtcccttggggaaaaaatatccctggacaaataactttgaaccttagggaacatctgcatggacattcattcatttaacctgtttctattgaacagcagttgtgtgtcaggctctattttgggtgctggccatttctaacacagtccctgccctcactgtttagattctgctggggaaagcagaccactaaaagccactaactgtataacaaaatatcaggctagtagtgtactgttttcctctctcagagcaaagggtggcaggagatggtattttagatgcggttggcagggacagtcttgggttggtaacatttgagcaaagacttgaatgaaatgagggagcagccttgtaggtgtcggaggaaagaatgttccagagagagagagaatacatgtgcgaagtcagagaggtggacaccgacttggcctgtgtgaggactcagaggaggccattgtgtctggaatagggggagaaacgggggagactgtttaggccactatagacatgggattttactttgaggaaggtgggtgtccactgaagatgttttagtcagggcacatttttttttttttaaattgagacaaaattttatgacacaaaaagtttcatgatggctggatggatcccaggagtttgagaccagcctgggcaaacatggcaaaaccctctctctacaaaaaaattacaaaacttagccagatatggtggcatgtgcctgcagtccctgctactcaggaggctgaagtgggaggatcacttgagtccaggaggtcgcggctgcagtgagccgagatggtgtcactgcactccagcctgggtgacacagctagactctgtctcaaaaacaaaaccccagctgggcgtggtggctcacacctgtaatcctagcactttgggagaccgaggcaggcagctcacgaggtcaagagatcgagactatcctggccaatatagtgaagccccatctctactaaaaatacaaaaattagctgggtgtggtggtgggcacccgtagtcccagctactcgggaggctgaggcaagagaatcgctttaacctgggaggcggaggttgcagtgagctgagatcccaccaccgtgctctagcctggggacagagcaagactccgtcccaaacaaacaaacaaaacccaaaaaagtcaccactctaaagtaaacagttcggtggcatttggtacattcacaatgttgtacaaccgttacttctctctcattccaaacattttcatcatccccaaaggagacctcatgctcattaagcagtcagtccccagccactcagcccctgacaaccacccatctgctttctgtctctgtggagtttcctgttgtgctagatttttaatgggtctttttggaaggatcactctggctgctgggtagaggatgaatgggaggtaaaacatggccacaataaaagcagggagagcattgaggggagcaggagccctgggctgtgcgtggcccttggtaggggtggaggagagaggcggtgagaagggttgggagtcaggatgggttccatcattgcctctgagagtcctgtggggagagaaaagccttcttggcttggtttcatccacatttgacagtggaaccccacttttcaagcggctctccagcatgtcgaagtgttcagaacacacactgatgtggtggaaggagtgctggattggacttggagtaatcatgttctgaggttgccatcccgtcgttttgagactttgggctagtcactccctatctgggcactccacgtcctcatccaaaaactgaggatgttaactggcttcagtgatttcatgccctggcatgaaattgatgtcatttgtgaaatgcactggcattgagggaaagcaggtgtttttttgcaacaccacaacctgaatttttccctctctgccaggctctgaaagccacgagtgagctgcagagagggctagcatgatggagtttgaaagagttcaggattttaaagagccgtttagatttgcagtttcccattctgacggtgtagtatgcttgtgtctctgtcggctgtgaggtgtgttgcagagatctgttcttactaattctgaagtttgtgagagatctccttttgtgtataaatcaggacaaactcaaggttattcctgtaacacatactctcatttacattgcatcctggtgtgtgttctttcctcattttccatgctgtaaactgaaaagccttagtttttattttaagcgaaaggaataaaatgtccatcgttaaaaccaaaatcaaattgtactgaaggacttagaatgcaaaacagcacactcacacctcactcctcccctttccagccatgctgctttttttttttttggagacggagtctctctctattgccgaggctgtagtgcagtggcacgatctcggctcactgcaacctctgcctcccgggttcaagccattctcctgtctcagcctcccgagtagctgggattacaggcactcgccaccatgcctggctaatttttcgtatttttagtagaggcagggtttcaccatgttggccgggctggtctcgaactcccggcctcaagtgacctacctgccttggcctcccaaagtgctgggattagaggtgtgagccactgcacccggcctccagtcacacttctaagggtttgcttttagttctcctggtggttgcctccagaattttaaatacaacaattgtatgttgtttctcgatttattaactttgaaactaccaggttcctgttataacagacaaggaatgacttctttacactaagcactgcctctcctccttacctttctccccaagtgtgatggttctcttatttttactccttctgtgagcagggcctttactgacaactaggttgtaggaactgtagccagaatgtgatacccatggaatgcttctgaaggacttagttcaaactaggggttaaaataaacagcactatgaaactcatggtctttaaatactttttttttttttttactgtgttctctttctctgaacccgtaggaggaatttcttttggtgttagcacaggaatggttgtgcttgcccggagcaggtggtttattttatcttgaggacactgcagaccatgtagccaagcacacttctcctttggtgctggctgcaaagctccatgccagatttgcgggcttgcattttgtgctggaggattggattgaagaggtctccagttcaccctgaccttatctttttttctactgttattttgtcttcatttagtttttcactctgggtgactggatgggggaagacagtgcatgggaactttcactaattcttttttcttttcttttctttcttttttttcttttttgagacagagtctgctctgtggcccaggctggagtgcaatgacacgatctctgctcactgcaacctctgcctcctgggttcaagcgattctcctgcctcagtctcctgagtagctgggattacaggcacctgccaccatgcctggctcattttttttgtatttttagtagagatggggttttgccatattggtcaggctggtctcgaactcctgacctcaggtgatctgcctgcctcagcctctcaaagtgctggggttgcaggcatgagccaccatgcccggcctcctaattctcttttcaaatcctgcttgtctcagagaagctatggttcagcttgaacccccctctcctcctagcttttccctgctctgaaatgggccctttgaacttgacatcccttccctgggttttttgtctacattgcattttccctcccttccagcatgggaagcaaccgctccagaaatagagacagcatggcagctcgccctgtataattgggatgatttatttccctgttaaagacaccaggctgtgtgaggatttaccttgaatccatttagatgtcatggctgagcctcgtaaaaagatgcttggcaattagtgctgcgtggaactgcccctcctgcccgggctgcacagatttaacaagagtcagagtggccaaggaactttatgttgggatgctcgagtccccttttcctgaacccctcattgcctcagcctggaggctcagagtattggagtgttagagccaaaaatgatggttgttggcagccagctgcctggggttttgtacctgcccctctatccctcctaaggtcacccatggcctgtcccagtggtacccctaacagagccagggttgtgctagctcactccttatgcatatatacatatttattattattattattattattattattattattattgagatagagtctcgctctgttgccccggctggagtgcagtggcgcaatctcagctcactgcaacctccgcctcctgggttcaactgactctccttcctcagcctcccgagtagctgggatcacaggcatgcaccaccatgcctggctaatttttgtgtttttagtagagacagggtttcaccatgttggccaggctgcatccatatattttttaaagcagcccaagcccttcttcccttttatttactgaaattgtgtagcaccctagtgcacatttgaggtgaagtgggtcttccctggctggagcgaggatgggggcaccaaaggctcccctgctgactcctctgctcttggggtctccctcccctccttccaaatatgccactttgtagacagtttccttattttcgcttactttcttagaggattctgagagacctgtggatttttagaagtgagaagggccttggaattcagcactgcttccttttctctatgataaagagttcagaaatgttcaatctcccccaggaccccattgcagccttcttttcagagttcagtggtaacagtcctggctgtgttcggggaaccctgacgcttactgcttcagtcccctgtggtaaggaaggcttgcaaaccatttgaggaaactgtccagaaagcctcccctgcctccttccttcctttcttcattcatcagtgaactcagtgaacctttattgactgtctgcagcatgcaaccatggctgctggctgctgtggacaaggaaacttggccctttgtgtcccaagagcttacaagctcatcgtccacctgggacacacatgccatactcccacctaaggaaggcctttgatgataagagctactgagttggtgttgatcatgagtgtgcctcagaaaacatgctgggccagttcttctctatcagtgatctggtcattgtggggagggctacctgcttagcagaagtgggggtagctgaacccatgtgctcttgtgagtttgcgtgtagagctctcccggcgagctcaggctgaactcaccctgagatctcagtctcctggtctggtggattgtccctttggggtcttctccatgcacaccagagctttaccaccttccaaggaattaagtgggaaccacatgttttcacagaccctgatcagtctctgctgatgcccagtagaggtcctttgtcaagtttgtgacattatttcataactggggagccactcaagattttctaggttgatctgataggctccttgcagcctctggaccccctctttttgtagggacactggggttgctttggcttgtatgacacggctcttctgccctgacctcagctccctccagtatcattatctgtgatgcgttcccgtgagctggtggctaagtaatgtctcttccaagattcctcttcctcctccctggaaatgcctaggactgaaccaaatcactctgagattatacctgacccatggcaggatctgccagaattatttcttccacatgccacccttcaaggtgtattaatgaataagctttggtctgaaatcagaattctgcacctcccagcagttcctagtgattttaacagcttgtacaaccccaatttcttcccttttcatgccatgtttcattccctaccctacctttggctttcactcaaactctgtcaccattctttctgccgattgaggaagcccagaacaaacccagattccttaacaatggttcggtaacagagaccatgccaaggatcgggaatgccgggtgaaaatgaaggagacataatcctggccttcagagttgcagggggacactcatagaccccgcttatctccccagatatgatcagtgctgtcatgcacacattccaggctgattagctaatgactgtggacgggactcctgcactgccaaaaatgagtcacacagttccaggtatggacaacagtgagcatgctttgttgccatgggaacacgaacatgtattcatctcaatgcagaaagaattcacttccactcctccagggtaaggatgtttcctacaccattcctcaggcaccaaggctgctcctcacccccaccctctgcgcccccattcatggtcgcgcctgcctgggtgggtgccctggctcagtgtacacagttgacccccctcaatatgttgtaggtgcagccaacatccagtcatgcctctgacacctcattgaagtctcagtgactgattgtttcttgaggcgaggcaggaggatgaagtgacaagagctaggctttttcaagttagacagatttggctccaattctggctctgtcactcaggagctctgccaccttgggaaaacatttttcttgctcagcgtcagtgtcttcataggtaaattgggataatccctatgttactaggctgttggaaggactaaattaaaatgtgtcaaagtgcttgtcacatcactcagtaagggatggttcctctttctttctttctttctttcttttttttttttttttttgagacggaatctcgctctgtcgcccaggctggagtgcagtggcacgatcttggctcactgtaagctctgcctcccgggttcatgccatccttctgcctcagcctcctgagtagctgggactacaagcgcccgccaccatgcctggctaatttttattttttttggtatttttagtagagacggggtttcaccgtgttagccaggatggtctcagtctcctgacctcgtgatccgcccgcctcggcctcccaaagtgctgggattacaggcgtgagccactgcgcccggctggtatggttcctctttcattctgtctcccagcaggcctaggggatggaggtggggaaatcgagatcctgagaagttggcttcgtggctgacactcccaaggacaggtgtccacactccagaactctgggctgtgggcttggtctcccttgggctggttgggtgatgtgtcactcagggttctttgattataaatattagaaactgattctggctgatgtaagccaagtggaatttattgcaaagacactggaaggttatagactgggcagagaccggggaaacctcctgaaaacagatagaaaccaaggtgctcagcagtgtgaggccaggaagtaggaataataagaacagtcttatagcaaaaacagcatggtcaggcctgtgggtcaggatggatgacttccatgcatccctttcttgctcctcttacccataatttaaagtatcagcacgaagtgtcctgagggggccatcggtcacacacctgtaccctgtgaaggagccaccggggaccgcttggcgtttgttgtggagagctggcacctggattaatagccctacagagaaagtgcccagcaggggagagagaatccccttaaaaaagagcgggctgctattaagatatagggaaaggggccgggcacgggggctcacgcctgtaatcccagcattttgggaggccgaggcacgtggatcacctgaggtcaggagttcaagaccagcctggccaacatggtgaaaccccatctctactaaaaatacaaatattagccaggtgtggtggcaggtgcctgtaatctcagctacttgggaggctgaggcaggagaatcacttgaacctgggaagcagaggttgcagtgagctgagattgcaccatcgcactccagcctgggggacaagagcgagactttgtctcaaaaaaaaagataaagggaagggatactgggcagctgaaataacaggtatctgctgtagtgatcttggacaaatctcacttggggcctcttttctgaaaaagagacgccaggaccagctgatctcaacggaccctttgacttctaataggaccactatgattattaaatagacaactctaccactgggaagaaatgaattaacattgtaaaccaccttagttttttattctccccctaaaaattcctgcccccaccaatataggccattgataacccatatttttaaagtctgtttatatttatttttatttttttgagatggagtctcgctctattgcccaggctggagtgcagtggcatgatcttgcctcactgcaaattccaccacccaggtttaagcaatcctcatgccgcagcctccctgtgagagcagcaggaggcagccaatgcctaggtaggcaggggcaggtccctgtgaaacctcacctccaggccgaagacagcttaaatcctgaaagccaagctaccatttaaatccttggaccagactgagaacttgtcttcctgtttggtgtgctttcctctgattgatccctacccttcacctattttatgtatacctaccctttcctaattggttttctgtactgccaggcccacttctgcgtggtgtctttgctttaaccttttttgcatactcacaaaccaatcagcatgcactccccattctgagtccataaaaggccctggacccagccacatgggggactttcctgccttcaggtagggggaccacccctgtgtcccctctgtatttaaagctgtttcatcattcaataaaattcttctctgtcctcctcacacttcaatgttcagtgcatcctcattcttcttggatgtgggacaagaacttgggaatcagtgcacaagccagacttggcctgggaaggccaactgggcagggcacctcctgcggcagatagcatgccctgggcaaggcctctggcatcgccagccagaagtccctgactggcaaagggaccgagaaaaatcctgcatcaccgagtcactgggattacaggcgtgcaccaccacacccaactaatttttgtatttttagtagagacagggttttaccatgttggccacgctggtcttgatctcctgacctcaagtgatccacccatctcagcctcccaagtgctgggattacaggcatgagccatcacacctggcctaaagtctgtttaatttttaataaaatatttaagtctacagaaaattacagagatgttaacaaatgtatctgccattcgtatttttaaaatcaactttactgagctataatttctcatgaaatttattacatgcgtacaggccaatgagttgacaaatgtatacacccttgcaaccactacttgaattagtcagtgtgtaagacatcttcccagaaagctctcctttgcccctttgcagtcagtttctctcctctgtacccactcatctctccaggtcacttctgaatctgatttctatcctctaggttagttttgtttgttctagagtttcacagaaatgtgtcatgcagtatgtactcttgaatgtggcttcttttgcacaggataatgtctgacattcatcctcattgttgtaccaatggttcacccctttttattgctaatgagaattccattagttgaatttactgcaatttgcttatccttttgtcaattgatggacatttaggttgcttccatgatttagctattatgaataaatctgctgtgaacatttgtgtataggtttttcggacacattttcacttttctggcataagtacgtaggagtgaaattgctggatcatatggtaagcatgcatttaactttataagaaatggcaaaactattttccgaagtcactgcttcaatttcctcatcacagcagcgtatgagcttctgttgttctacctccttgccagcattaacaaaaattcttttagccattctagggagtatgatgtagtttcccatggtgcttttatcttgtattttcctgaaggttgatgatgctgaacatttttcatgtgcttattaccatctctggatttgacaagtattaacattggccacatgtcagtcagaaataacacattatttgacattaaaaatcctgtgtgttcttccaattcctttcccttctttccttctcttcctggaggcaaccactgttctggggttggtatgtgtttcccatgagcatgtttaaaatctttattaacgtgtgtatatccaaaatactgtttagcaatgtcttgttttgaaacttacatgagatgtgccatacgatatttataccttggtaatttacttttttcacacaatgtgtttttgagtttttttcgtgttggtgcatgtagagctagttcatcttaactgctgcgtactgttctagcatgtgcatgggccacctttatctccattggtggacactttaggtcattctaagcaatggtgtaatgcttatccttatgcctgtcccctcgtgtaccggcctgggtatttcttgggtccatatacctagaaggaaaatatctgggtctgagaatgtacatctggactttcctaaatagtgtcaaattgtttttctgagaggttttgcaaatgcagactgccacccacagagtatcagaatttccatttgccttgccaacacatcagacttcttatttttgccatccgagggtgtgaaataccacaccttggatttaacttgcatttgcatttccttcattgctagtcaggtcgtgtctgttttcaaatgtttatttaccatttgaatttcctctcttgtgggtttcctgtgcattctctgctcatttttctatttcgcagtctttcagtcattgctttaccgcttcattttctaatgatgtattttgtcatgcaaaacttttttgttgcaatctagtcaaatttattaatcgattactttagggattttgctttttatgcctcatttaagaactcttggctgggcacagtggctcacacctgtaatcccagcactttgggaggccgaggcgggtggatcacaaggtcaggagttcgagaccagcctgaccaacatggtgaaaccccgtctctacaaaaaaatacaaaaattagctgggtgtggtggcacatgcctgtaatcccagctactcaggaggctgaggcaggagaatcgcttgaacctgggaggggaaggtttcagtgagctgagatcgcgccatcgcactccagcctaggcaacaagagcgagactccgtctcaagaaaaaaaaaactcttatggtgaggtcatatatggtcttaacttttctgaaagttttaaagatttttgtttgatgttgagatctttgatccatttgtaatttccttttattgtttgttataaggcaagagcccaattgtactctttttctgaggagcctgtcatcttgttattacttattttaaaaaatccctctattctcacctcgctgatttgatgaccacctttgctgtatgtttttataaatgtgtgttctgttgctggggtctttcttctggtttcattggactatttgtctatctgttcactattttaattgtaactttgcaagaagttttactatctgatggaataagtcctcattcttcttcaaaattgtcttggatgttcttggcccttgactatttcctgtgaattctaggattacctccttgagttctatgaacaactattgcattaaaatggcactacgttttgagattaatttgagaagaaagatctccttggtaatattgggcttcctatctagaaacaagttgtatattcccattgatctagatcttctttattgtatctcagtgttactggaaaggggtcctgaaccagaccccaagacagcgttcttggatcttatgcaagaaagaatttggggagagttcatggagtaaagctaaagcaagtttattaagaaagtaaaggaatgaaagaatggctacttcataggtagagcagctctgagggctgctggttgcctatttttatggttatttcttgattatatgccaaataaggggtggattattcatgaattttccaggaaaggtggcaggggcagggggcagttcctggaactgagggctcctcccctttatagaccatatagggtaacttcctggcatctgtcaactgtcatggtgctggtgggaatgtctcttagcatgctaatacattataattagcgtataatgagcagcgaggatgaccagaggtcagttttgttgccatcttggttttggtgggttttggccggcttctttggcacagcctgttctaccaacaaggtctttatgacctgtatcttgtggccacctcctatctcatcctgtgacttagaatgccaaatctactaggagtgcagcccagtaggtctcagacttatcttttacccagcctctatacaagatggagtcactctggttcaaacacctccaaagtcagtacattacattgtctccatataagtcttttactctttagttatatttactcatagctcacttatagttttgttgccattgtgcgtggtgtattttttttctttaaatttgatgttgtcaatgaaaagagtgaaactctgtcgaatatttgaagagttttattctgagctaaatatgagtgaccatgaccgtgtcacagtcctcaggaggtcctgagaacatgtggccaaggtggtcagggcgccgcttagtttttatacattttagggagatatgatcagtcaaatacatttaagatatacattggtttggtccagaaaggtgggacagcttgaagctggggtttccaggttataggtagatctaaaatttttctaattggcagttgattgaaagacttatcaatagaaaggaatgttgcaataagagaccaaagtttcatcatttagatgaagcctccaggtagcaggcttcagagagaataggttgtaagtatttcttatcagacataaggtctgtgttgaagttaatgctggagggttgtaatgaagcatgtctgatccccatttcccttcatgatctgaaccagtctttcaggttaaactttagagtatcctggccaaggaggatgtccattcagatagttggaaggacttagaattttattttcggtttacagtgtttatgtttatttttatcaaagtaatagagttttaaaagagcattctcctaccatactccaccccaaatgcttctcagagtccaccacttgtaacaatggggctttatctccatttggggtttttgttattttagagagaagggtttgctgtgtcacccagccaggagtccagtggtgtgatcatagctcactgcatcctctgctttggtctgtcgctcttcaagtctgaacagttgtcatcttgatctttcttcaccatcatctgattactttcctttctttctcttctttctctgctcaagcgatcttcccacctcagcttcccaagtagctgggactacaggaatgcaccatcacacctggctaattaaaaaaatttttttttgtagagatagaggttttgctatgtggcccaggctggtcttgaactcctggcctcaagcagtcctcccgccttggcctcccgaagcactgggattataggcatgagctgctgcacctggccctttttctaaatgatatgtttatactgttgtatatccccctacctaccaattttacacactgtctattgaacttcttattgcagaagattagacctggcttttccaccaacactttactttttcctttcctccatatataacctcttccctcacctcccacaatggtggtcctatggtgatatcagggtctggtgtttatattattatgccagtgtaaattacaactgagctactgattgccttctacttctttggtggaacaacaacaagaaagcaaataaataaaaacaaaagcaattggttttatttacttggttttctctgtcccttgcaccaattcttctctcttcactagccctttaaaaacttccacaggctaggtgcggtgactcatgcctgtaatcccaccactttgggaggctgaggcaggttgatctcttgagcccaggagtttgagagcagcctgagcaacatggcaaaaccccatctgtactaaaaatacaaaaattagccaggcatggtggtgcacgtctgcagtttcagctactggggagcctgaggtgggaggattgctcaagcctgggagatcgagactgcagtgagctgtgattgcaccactgtactccagcctaggtgacagagtgagatcctgtctccaaaacaaaacaaaacaaaacaaaacaaaacacacacacacacacacacacacacaacagaaaaaacaacaaacttccgcatgtactgtcacctatcaccacataaaataatctatcaggtctgttttttcatctcaatagaagcatctatttgctctgttctggtctgttgctcttcaagtctgataaatagttgtcatctttatcttccttcaccatcatcctatttctttctttcttgtctgctttttggtcatttcttagatctcatgtcttccccttttcttggttttctcccttgttttattggatcacaccctgcagtagcttcctgaaaaaggaaattggtctgatcttaatctgcagtatgtaaacaagttgcctcattgccctgttttcattatggcttgttacctgtcctctaggtgtctctgagtccagaagctcaggactagtttgccttgagagtcaacccgttgttttctgccattgggatagggcagtcacttagttgctgagggtgtggaggaatctgtaagctctcctccagcctcctttttaagtctttacctcatagatactttgtgctgtgagccttcctgggcctttctgagcttctgcattataaactgctgatttcttgtcatacaagaagacatacaggtttctgttcactcatctatgctaagtccttgccatttatccatttgttttccattgtccaaaattatgttgacatgtctcatttattgtcaactcttacttttttcttctttgtggctttgttaatggggttttaggagggcatggatataaacagcccgttttcaatcagccattttaatcataagtatttattacattttctgattattgtcgtttactgtagtgtaagggaaccagagatcacctccaacctccttgttagctcttaacgggctctttggctggatctggaaaccaaattgacatcaggcagattaacatgagaaaagtatataaattttattagttttatgtgtacatgggatcttcacaagacagtgaagcccaaagaagtggccaaagcaacatatctttatactttttagatagagtgataaacttgatcagaaataacaaaacaaaatatggcaaagggcagtcaattttctggcggagtcactagaagttgtattagaggtggggtaaaacaggtgaaatgtaagagttattctgttcatgatgtttagtcaagtccattgcaggcttgattccggctctggtgatatgcgctgttttctcgccctggtactgggagggcagccctcgtacaggattctctattgcttggtgcatgcaggaagagacagttcagctcgtccgttctgaaactacagtttctccaatgttttcaacttgaaatcatcagtataacaatctggcatgttttgtgatggcatatcctttaccccttcagtagttagttactgtagaatattggtaatttttatcactagatcttgaactgtcttattagttctgatagtttgtagagtttcttgattggaggggtagacaattataatgtatgaatatgtcagccgtttcttcctttgcaatctcttttctttttttttcttttcctttctcctttcttttcctttcctttcctttccctcccccgactccccctccttccctttccgcctccctctttttcttttttcttcctttcccctcccccttcccctccccttttctgtcccccttgcatttctgtcacctccccctcccctcccttcccctcccctcccttctcctcccgtcccttctcctcctctccccctctccccgtctcccctccccttccccgtccccctgtccctctccctctccctctcccctccccctccccctcccacttctccctctccctttccacttccctttccctttccctttccccttccctttcccattcccccccttcgttttccctttccctttcccctctccttcccctccactttcccttccctcttcccttcccaaggctggagtacaatagtgcattcttggctcaccacaacctctgcctcctgggttcaagtgattctcatgccttaacctcccaagtagctgggatcacaggcatgtgccaccacgcctggttaatttttgtatttttagtaggggtggggtttcaccatgttggtcgaggggttggtctcaaactcctagcctcaagtgatttgcccacctcagcctctcaaaatgctgggattacaggaaggaaccactgctcccagccttttttttttttttttaaaactgagataaggtctcactctgtcacccaggccagagtgcagggggacagtcataactcactgaagcctcaatctcctggtcccaagtgatcctccttcttcagcctcctgagtagctgggaccacaggtgtgtgccaccacactcatctaatttcttaattttttgcagacgtagggtctcgctatattgcccaggctggtattgaactcctcagctcaagtgatcctcccacctcggccttccaaagtgctgggattagaggctttatttcatttatttatttctttttgttgcctcactgtgttataatatattcagtgcagaaaggaaaccatgatggtgaatggcattgtcttattcctgactttaacagaaaagcttccagggttttccattaagtatgaagtttattttaatttcctttttcttttttttttttgtgagacagtgtcttgctctgtcacccaggctggagtacagtggcacaatcacagcttactgcacctctgcctcctgggttcaagcgattctcctgcctcagcctcctgagtagctgggattacaggtgtgtgccgccacgcctggctaatttttgtatttttagtaggggtggggtttcaccatgttggtcaggctggtctcaaactcctgacctcgtgatttgcccacctcagcctcctaaagtgctgggattacaggtgtgaaccaccgctcccagcccttaattttcaatagttataatttatcagactttagtcctggtgtgtgtgttttaatcacaaatgagtgtcgagttttgtccggtgctttttctgcatccagattatcctattttttttttttgtagtttcttttgatatggtgagtttaataagttttctgatatttcaatatctctgcatttccaggatttgctaatgtttatttagaatttttacacctattctctaagtgaggttaggagcttttacttcctttcttctcccaattgtttttctttgaacttgatatcagggtattataaaaaggagctgaatgttttctatttatggaagagattggattaagtggttttttcttaacgatttgagaaaacttatcagtaaaaccacaccgacaggtacagttttttaaggtaggttttagactgccgaatcaattcgtttgaaggttatagacctattcaggttttctatttcctcttgagtcaatttggaatttttattttcctggaaaattgtcagtggcaggagagaacaaataaccagggagttccagaacttgggggaaaatagcatctttgtctgattcattgctatccaacactgagaaggtaggagggaggagatcgaagtgaaacccttccagggttttgtattattcagaaggagaaaagagctattgattagctttctgcttgaagtcaagtgtacatgttaaaaatgtcagtgtaaccacctaagtagtataaatagactctataaatgcaaagtttgtggagggagggggaataaagaatatgcaatcaatccagcagaaagcaagatgggagggagcaagaaaagcagagaaaagcctggcaaggagaaagcctgtccttacgatgacctttgggcagcacccccctcccaggaactttctggacgcccactcctttctcagcacctgctttctcctgttatcgttgcatacgtccatcacactgctgcgtggctgcctgccatctttctctcttccagaaagtaagctctgcctgggacagggctggggtcattcatctgcatattctcagcgcctgacatatagtaggtgcccaataaatgtttgagtaagcatgaagcacagataaataagtaaacaggtggataaatacatcctgagatgttactctgccaggctcaatggctatgggaaaacattttcatctgagattgccttggttgataagtgagttagagaactgaggaagtagctgcagccttgaattcagttgagaaaaaagtcagggtgagatgcctcgactgaaactgtctcgaaattcctcaagcgcccgtgtagctgtcacgcacttgatcagtacctagtagtacctagaaattcccttgtgcactggtaaaatagctcataagctttaaattagtgctgctcaaacgttaatgtgcgcacgattcacctgaagcacttgttatacagtctgatgtaggaggtcttgaggggagcggggcgcagatgctgcatttctaacaagctcagtgttgctggtctatggaccacgtcttatataacagcaaggctttcagtagcaaggtgtagattgtcacctgctctccccaggtgcttgaggacagcaaaatgatcctgtgcttggagaataagtcctgtgttctgacttccaggattgttaccagtgagtgtgaaggatccaagcctgcactggctggggaggagtgccccttgactttaaactgtgcatcccgaaacaggcctgtctccagctgtgtcagagcccctggggtggaattagttcactgaggtacctgcatagtgattacatctgccctcattttcttgtttctccggctgagccacacggcctgttgggacacgtcgagtcctgggaagccctcatctgtgtgattcacatgtcacttgtcactgttctctggctgtgccacgctttgtgtatgcaatcaaaatcccatttccttgcctcattccagcgagcctttgccttgctgtcactctggtcctgggccggggagggccaccttttctatttccatcgtgccacctgccctgggttagacatagaccactttgctccatttacttagaatgatggaatggacctgggagtgatgacaccactttcttgtttttttgtttttgttttcttttttttttagttccccatttttagagaaatggcacaaaaccagtgggaaataccccaaattgcagataagccactaatgcaccaatcctggggccagacagactatgggcgccagcacttccctgagcctctctccccatcacgtctcggaaacggtgctggcaagccgtctggtctgttctttaccttacatttatattgactcctgtggatcggggtagggttgtggacagatagatgcttctatcagagagggatggaaccagaggtttctaaggcgatggtgtggctctagggttttacagaaagcatatttgaaggcagaagcatctgttagacagcaggagaacctggaacttgaatgctcatgggactcctgccttggctcttctctacacagagtcttggccttcaggagctttgtccttctcagggtggacagaggtaatgcagccatgggcgaaggctgggggaggggaacagggatgccaagccagctcctcatcccctccagtgaagacattgtggagtggactaagttaaagctggggctgccagcaggggcctgggtgctgggtttgtcttctggggccccagtctttccttattcctgaatcttgcctgaaccaggtatcggggcagatagtgtctgggcccggcaggtaatagcgctgagtgaggcaggtagaggtgcttcctcagggccaatgacttcagatcagccccctacctccagccctagggatcctggtttaatgggacaggggcttcctagggcatttctaagctctcaggtgattctcatgggcagccagggttgcagactactgtgatagagaatggtggagaacgtggcagcatttctcctcatcctgtcgatagcacctgcagtatggtccacctgacttttcaagagacaactgaatcttttcttttttttcttttcttttttttttttttcttgagatggagtctcactctgttgcccaggctggagttcagtggtgcgatcttggctcactgcagcctccgcctcctgggttccagcgattctcctgctttagcctcccaggtagctgggattccaggcacgtgccaccatgcccagctaatttttgtttattattattattattattatttgaaggggtttcaccatattggcaaggctggtcttgaactcctgacctcaggtgatctgcctgccttggcctcccaaagtgctgggattacaggcatgagccactgcgcctggcctttatttgttttttcacaagacctgtcttggtttttgtatgcttgaagctaagtcaaaacttttttttaaaaaggtctgcaggtcaagcaaagcacatccagtggtcctgtaggcagcctctggtctgcagggtgagccctcggctgtctgcgctgcctccgattgcacccacctcctcatgtctggctgttctctgtgacatgggggtgactatacttgtactttgccttcacccattttctgttcttgtggccccagtcctacagccagctctgggaaaataatgtatcctgggcacagacccagggtgattcgcatcttcccacaacaaccctgagtagtatgtgatatttttggttccatttctcagatgtgcaaagccacttgcccaaggggatggtggagtcgggactcaaacacagctctgtttgcctcatgagcctgagctctcaagtcgcctcactggctctctctgcttggagttttttggggtcctgctggctgggaacaccccaccaactggcttctgtgtgggaccctctgacccagtcaggtggctcctttgagttcatgattgggctgagcaggtgttccagatgccaggccagaggattgtgtaggagtcagacagggatggggatgtgggagtccctggtttctagagaaatatttaggttggtgcaaaagtaattgctattttgtccatttttaatggcaaaaaacgcaattacttttgcaccaacctaatagcacatttctgacttctactctctgtatgctcttccttcgccaccaccccaacctctgtcccataggttgtgatgtccccattctgcctctgcctccctctccctagactctagatttagaatagggcaggagggacggcatctttgctggcattttctctctgcaagaccaggctagtagcctggtaagctgagcagaacccatgaaaacagaaagagaatgaagggaggccgggcacagtggctcacgcctgtgatcccagcactttgggaggctgaggcaggcagatcaccagaggtcaggagttcgagaccagcctggcgaacatggtgaaaccccgtctctactaaaaatacaaaaattagcgaggcatggtggcgcaggcctttagtcccagctacactggaggctgaggcaggagaatcgcttgaacctgggaggcgcaggttgtagtgagctgagatcgtgccactgcactccagcctgggtgacagagcgagactccatctccaaaaattaaaaattaaaaaaaaaaaaaaaaaaaaaaaaagaagagagagaacgaagggagagctgggctgggaggctgggcagctgacccaggctggtggctggatgattcccaggacttagtggccacaaaagttggcgaataaatgagaatgaatgagagaggaaggagatggaacaaacctcaagactggggatagaggagtggggtgcatagaaagctaggagtccctgctgggactaatgagctcaacagggcaggtcatctagtgcctatggtctagtatagcatttcccgagatgctgtgccaagatgggtttaggtggtctctggacgagactttcagtaccagtgaatcacatcaagagaagggtattccttttgcagttctctccttgcttctgattacattgaggagaaagttttgggaggtgccgggtgagggcaggcctcagcaggtagcagtatccagcaaagattgaataacattgcttggtgtttgttgtggttatttttatggttattatagatttctggcaaatgtcactagttttccattcacagactcacatcaattttctgttcagtgcaatttttaaaagaaaaaagtgagtcaactaaaaatattagcaaataagaggaaaaagtggtatgagagtatgctgaaaattagaatggtgatcagtgaaagataggctcccgggagatactgggtgtgggaggttcagggtctccggctgtggggtcaaatggaccacagttcaaacccattaacactgtgaccttgggcaagtcgctttgcgtctctaaggcatagttgactccatcataaaacattaatattaaatgagctcatgcttgtcatgtgcttggcccaaggcctgacccaacatcatagtagtggtggttattatgtgaagtgtttattggcatgaaatactgaactcagaggctggtgttcctggactagcaaggatcacaggccaacatggaagaggaagctttgtgagggagtgagctctctgtccgcacaagtgtttgagaggcttgtcacctgttgaggatttagtggcaggattctgccactggatgggcagacaaaaggggaaatcccttcaagtaaccattccacggacatggtgcagagagagtcaacgtagcaggccggggagccctccttagaaaggcctgctggcaacattgttccttggctggtgtctgggaacttgcatttaggaagggctcccactattccctgaatagtaagggtggctgttctctaaactgttcatgtgagtaatacggtttgtgctgaatacctggatttcttcagggagtctgcaattcatgtttgtgctaggcaggggatgcctacatgaccagctccttataaaaactctgggcactgagtctgtaatgagcttacctgctagacagtgttttacacatgctaccaggactcactgctggaggaattaggcacatcctatgtgactgctgggagaggactcctgaacttgcgcctggttttctcaggaccttgtcccaggttctgtgtcccttcactgattttgctttgtatttttttgctgtaataagacccttaaaaaaaaaatagagacaggatctcactctgtcacccaggctggattgcagtggtacgatcctagctcactgcagcctcaaactcctgggctcaagcaatccttccatctcagcctcccgagaagctggaactgtaggcgtgtgccaccatgcctggctaattttgtgatttttttttttttttaagagacagggttttgctatgttgtctaggctggtcttgaactcctggcctcaagtgatcctcctgcctcagcctcccaaagtgctgggattacaggtgtgagctactgtgtctggccataagtctttaccagaagtaaaacatatgctgagtcccatgagtccttctgggaaacatcagagctgagggtggttttgggaactcccagcatagcctgcctctgttttcaggtcagggaaggaaacccagggcttcatctgggtcagtgggtcatcctggttcaatgggtcaggggctttctagcaaaggttccgcagaagttctcctaggatcaaacttagggaagcgccctgaaggagttgatgatgcttctgggaagagccggcctatcaagtgcatatgggggtgcctgtccctctttggggtgctgtgtgatgtcactgtgcttcgtacaaagcagcttaaaaggtttgggaggaagtattggagtgtgtttatgtgtggctgaagtctcaggtatggtttgtgttaagcctctgaaggacagagcacaatcccaaaatagttttcatgggaatgaccaaggtagagaccattggtttggacctataatatcagagaggccacaccccgattctttacaaaacgtaacagtgaccacacctcagtggttagtgtcaaggttaaggaatgttgatatcaactttcctccgaaggacctgattcagttatgtatgaatctatttctcccggtctgagcctctgtttagacttacaggagatggttgatggtctccgatcaggcccaccctgaaccagggctgggcagggttaatggagagtgtctgggatgtattttcaaagaactgtcatggtgtagggggactaggacaggtgtttgcagacattcctagcttgaggttggcctgattattctgtgtgaatcaccaggcaggtattcagcattggtcctattggtcttccttctgattaccccctagccagagggggtgggggtatagggctgaggtaagctcagaaatggggcacttggccaggtgtggtggcgggcacttgtaatcccagcactttgggaggctgaggcaagatcacaaggtcagcagttcgagaccagcctggccaacatggtgaaaccccgtctctactaaaactacaaaaattagccaggtgtggtggcatgcgcctatagtcccagctacttgggaggctgaggtaggagaatcacttgaacccaggaggcggaggttgcagcgagccgagatcgcgccactacactccagcctgggcaacagagcgagactccatctcaaaaaaaagaagtgggacacttgtctgcatgaagaagtgaagggagttggaataaaatggaaggcagaggagcctctgctgtggtgggctggaaactccactcccgccaccccatccctcccccatatttcatcagagccttttgtaaaggatggcagaaccatggagctgggagaaggagctatcacttgcctgcagtgtcagcaaagagaggccaatttttaatgctttgtgtacattattaactcacttgatccttgtaacaggtattattattaatacttacatcatcattattattttttgtcttcacgggaattgctgacttgagattgtccagctagatcaagcaacttgtcctgggaaagcatggatttgaacccaggcagtctggctcccaagtctactctcttcaccactacactgtcaggacttggtgacctagaaatgctccccctgactccaaaattcagtgaccccaggagccaatccaagcagagaaaggctgtcctgatgtcctgcagaatgacagtcacatctcaggctttcaaactacttatatgttttttcctaattaatagaccttgaaataaacagttaactgtttttaaaaaaattgaccttgtaggccaggcacagtggctcacacctgcaatcccagtgctttgggaggctgaggtgaggggatggcctgaggccagctgttcaagaccagcctgggcaatatagcaagagtctgtctctgcaaaacaaaaaacaaaacaaaaaaaagtagtctggccaggctgggtgtggtggctcacacctgtaatcccagctctttgaaaggccgaggcgggcggatcacctgaggtcgggagtttgagaccagcctgaccaacatggagaaaccccatctctcctaaaaatacaaaattagctaggcgtggtgacgcatgcctgtaattccagctactcaggaggctgaggcaggagaatcgcttgaacccgggaggcggaggttgtggtgagccgagatcatgccattgcactccagcttgggcgacaaattagcctggccttggctccttgtcacagtctctcttgtgcttcttcagtccctactttcctctccctcccatttccactacagatggtgccttcctaccctacgccatagcaatctggtcactggggaaatggggttatggagaggggtatactgtaattcccttcatcttatctcaaggtcaagttacattttggccccaagcatacagccccctaacttgagctccggatagacctcctttggggctcccaatcctgctgaacctccctggcactctgtgctcttgcatatcttccactctgagtccagctccaacattctggctatttcttcttccagtgttatgtgactggcacagttggccccagaggtcccagccaggaggacctggggaagcatcagaggtattgacagcaacatttctgatccatggtccaacttggcctgatgagggcagctgatagtggctctccaagattgtctacgtcctaatccccagaacctgggaatgttattttatttagaaaagagtctttgcaggtacaatgacgttaaggatcttgaattgagaaggttttcctgggttatctgagtaagccctaaatgtaatcacaagcatctttataagagagaagctgaaggagatttgactgtagatagaagacaaagggtatgattggggaagtaggatttgagtgatgcagccacaagccaaggaatgccagcggctaccaggagctgaaagagtcaaggactgagttctccccttgaccctctgggaggagtatggccctatcaataccttgatttcagctcagtgatactaatttttggaagcttggcatccagaactgtgagagaatacatttctgttgctttaagacaccaagtgttatagtggccaaaggaaggtttttagaaatgcagatatctttggaagagaagcttacccacaagtgcaggctcaagaaaggaaccaaatctctaaattctccctgctttatgttctttagttttgattgttgctatctgtataccttgccctttaccaaggaactattagccaggactctttctattaaatgttacagaaatcctattcaggcttagacctgtaatcccagctctttgggaggtcaaggcaaaagaatcacttgagcccaggagtttgagaccagcctcagcaacgtagtgagacccccatctgtataaataaaaaataaattcactaggtgtggtggcacacacctgtagtcccaggtacttgagaggctgaggatcacttgagcctaggagtttgaggctgcagtgagctatgattgtaccactgtacttcagcctggggacagagcgagatccagtgaaaagaaatcccactcaaattggattcagacaaaaaaggaacagtcccaggaagttcagcttcaggcatggtttgatcaagtggcttaaacaaacagtgtcagcagtctgatgtttctctatctctgattccctgtcttcctcatcagccctcttccttctgcattggctccattctcagtgagacttctgcgagttgtcagcgtgaccatcagcagcttcaggcttgcatcttgtcatagtaatacatctttccccagtaattccaaaaccaaattccaggtatccagccccagatgggtaatatgccccttcgtgaactagtaccgtggttggggagagggcacgtgctaattggccaggcaggagccacttgctcccggaaacctcgagggctgagaatgaggtgaggtggttccacagtagaaaaatcagggtgcttctttcagaagccggggtacgtatggcctgctgggcaggcccacacagcatacagatgctacgagagcctgctgtgctttgtaggtcacagacccccacggtgtgcttggaaatgccagatcatgctgtgaggcttttcctctgccccagcctctggcacgagactcccacgtgtgaaaagcagactcacagtccctgcgtgtcgtggagcccgggaaatgaaaacgtcaatctgggaggccccagaaggtgtaggggattgagtgagagagccaagaagctgcagcagccgccgctgctgggacttcgtgtttacaaatcacattatcggagcatctttgaacttctgttggcacgtgtgtgactaatgttcgagctggtgagggccatgttgggaaatggaaaagggaagtggggacgagcgctcgtgctaaaatggtgctctctttggcaatggcctttggaggaggtgactcactaggggcattgaggcaacaaagaaactgctgtggctggatgaaaaaaagatgcttcctctgcccccctcaccacccgtgcaaggggaagcccatgacctgagtgtcttgaaggaagcatttgaccagggagggtgacccagggtggagccatactagacggtggtcaggaagctgccgtggtgaacaggttagagtggaggtgatgagttaagagttccagagccagatgtgcagggctgagccctcagtgtcgtatcttgttagcagcctgaccttggatgagatcctcaccctgacaccctgatctcggcaccgccattattagctgtttaagtgtatgcactctgccccagtttgcctggggcaaactgccgaactgtttgaaccttgaattcattctctggaataagcataatcatagaaactagatgatttgtcagggttttgccggagctgctgcttctctgctttggagcagagatggtagctttggcagaaaatggtggatcattgcaactgagaagttaaataagaggtttcctcagcagagagagcaggatggaaggggtcctcctgaggtgtaggacatggggacgtctttgtgagtatcatgcgcacgcacacacacacacagacacacaaacgcgtgcgcgcgcacacacacgtgccaggtgccaccatgccgttgcctattattttgatggaggtaggcaggagcaggaactccttttgcaagaatgacaaagaagtggcattagcaagttctgcctgtctgttcctctaggggaaaccccatgaaaccaccacagagccactctgcttccctttcttggcccactctggcaaacccagccagcaggtaagtgggagcacagagcgaggcaagggttgcctttgctgtggggaggggtccatcctactgtgtgccccctgatgtctgcacagtgtggatggagctccctggacatccctgccttcccctgggctgccccaagtactgcaggcctcactcacgtggtgcaggactgctcggctacccacaggatcctggggggtgagagggcatttgcggtgggagctgagatctgcagggtcattaggaattagtgtcagctaatggtggctcagcactcctgggggagagaagaaaggaaagggagagaatagggatgtgagcagccctgatttgctggttcagggatttctgagaccaaaaagcaacccaccagcaaagcagaattagctgtgttatttaaagttattcacatcaggatatttaaatgatctgtgcccactgtgttcgtgtggtttctatgggcaagatgtgttttatgtttttaaagtttgtttaacttttctctatatccatggagaatcattggaagatcaaatgatatctcgatcagttgtagaacttattttattttctattttattttatttttgagacagagtctcactctgtcgcctgggctggagtgcagcgacgcaatctcggctcactgcaacctccacctcccgggttcaagtgattctcatgtctcagcctcctgagttgtcgagattacacgtgtgcaccaccatgcctagctaatttgtgtatttttagtagagacgaggtttcgccacgttggccaggctggtcttgaactcctgacctcaagtaatccacccgccttggcctcccaaagtgctgggattacaagcatgaaccattgtgcccagcctagaatttactttaaagtaattaccagaatggtaaatttcctccttcatgtaggtcagaacttgtctgtgatctctaaaagtcctgagcttgatccctccgtggacatgcacctgggtcgggggcaccgggaaccaactgaagcctggtcagtgtgtctgtaccagggttttcggccatgttactgttgacatttcgggttggatggttgttttgttgtgggcggcggtcctgtgcattgttgagtgtttagcagcgtccttggccagtaaatgtcaccaagtattgccccattggcccctggggaaaaagcgcccctagttcagaaacacaggctacacatggagtgccatattgttcccctagaaaccaggagaggaaagagttcctctgttctggcctgagagggaggctgggagtgggaacgcccagcacagttcgctgtgggagaaatgaaccaggggcctgaaagggggtgggtgccacagctgccccttcctacagcttccccccagaggctccagagctgtcacactgtcattaacgacaccgcattcctgtcggtgcttgtgtgcatctttggacgaagctagaaaagaagctgaactatcttcaactgtgccataaaagaggatataaaaaaactcaataaaacacgaaaatgtcagccgaagcaggattgcttgctggggccttggcaaggaggggcagacagcaggctggacgcccctggcgctgtttgtgggagtcatgggtggggaggagaggccaggagagcccagcccatgctgggggccaccaagcctgggctctgggccaaacacacagtcccctggtttcttgagcccaaccccaatgctgtaattctgtttattttgctgaatatgaaatccatatggttctgatttcttccttgtaatccgtcatctctgtgtggcttcggagccagcaaccacgcaaagtggctttgaagttgttgttctgggtaagtaggaagttgtgttcttccagggttcagtggggcaaccatgaggtttgcatttggtttgggaactgctccaggagagggaagcagattggcacagtcagttttggtcctggcttaggagcttgggctgggtcagaagggagaccatttacagagccttcggtggatttgcacagccaaggccactctctagccctcagcttaggtcagagatactcttggttctaggtgtctctttggaaacaacagaggtctctgcagggagctaatgcactcactcagcctctcccacctccgtcatgacaacccataaatgtgtccaaggcttgccaaatgtcctcaggggggacaaagtcgcccctggttcagaaacacaggctacatgtgggatcgctgggccacatggtaaatgtatgtttaatgttacaggaaactgccacactgctctgcagaaggaccataccattttgtgttcgcacgagcaacgtgtgagaattccagttgctctgcatccttgtcggcacttggtattgtcattctttttaatttcagtctttctagataacacttgattttgacatttagaaatgagccccagaaaggtccaagatttgttcaaggcccctagctccttgaagaccagaatctaggcattctgtcttggggactgcgggctttctgggtggtggccaggtgtacagaatgaaagtgacagggttattccatgtgccagacctgggaatcagtaacttctgtctggccctggggcttcagcaatatccaagaggaatgtagaaaaaggaggtggtggtagcagggaaaagttgcacatcccggagtcatgaggttgaagaccctgcgctgctgctccctcctcccactcccagctcattttaagctggaagctcagagaggtacagaagcctgcccagtgtcactcggctagctggtggcctctcgactcttcgttatggcaggcagtggcagaaggccagccttgtttccagaagcacccttactaaagcaccagggctgcttctcctcggcgctttaaggagtagagtttttgcaaattgctctacctggttggattatcacactccctcagtgtcttggccttgggtccactctagaccggaaggagcatgtgcaggggatgatggctgctgctgaaagcagagtgggtgacctaatggggaggtggaggttcatcaggaccaggcacttctccagaggcatcccacccaccctcagggggaaagggcccagctgccctggaaggctgtggacatgctttcccgattgcagaatacttctctttcattttgaatatcatttgtttggttgccacggcaacgtcaagtctctattttaatgctaacctgcgtggctgcaactttctatatataaatgctgctttgcacagtgaattagccgatgccacggggaagcagcggatgtggggatggtggcagaaaatgaccagcgtgtcagatttgcataaggacacaccacaaggctgaggtgagttggaaccagggctctgctggttatctttgatgcagatgctcgaagctaattggaccaggttgagtgcgaggcagccgccactcctgcaggaggagaaatcttccttggatgacctcttgcttggctagggtttggctctgctctgggggggatttgggggattcttctgtcttcccgtgtatcagtcctcctcatgcatccagtgagtctgggtcgcaccatgacccaagggtctggaaagaagagaaagccacttgggcaggggaagtatctgagatgagctctgtgggaagtgagtttttcttgatttccggggatttacctcagtttcctgttttggatcttctcctcctcagtttgccttttcttaattccccagtgtagcgagaatttgtagaggccacgtggctccaagtagcataatagagttctcaggagaagcctgaaaaggcccttgggaaccagcagatacagttcccccaggttctagatgagggagatgctcagagaggtgacacgctctgccagatgtcacacagctgccctggggaaagtgggatgggaaaccaggtccacactggtcttctgacttactcatgcatgccacgtttgtgcgcattctgtcatgggaccaggcagcgtgtgggtgtacacaacagtgaaaggggatacagcgtggacagcataccctgatgttcctttctggttttgcaagccggagacgtgtaatgaacacaggattgtataacttgatctggatcggcctctggaaagagcatggaagtttgaatctacaaaacttggatttgcgtggattcagccactttctacctgtgtgaccattttgtcaacttttctgaggctctatttccccacctaacctcaagatgtgctaaatatcttcccctggcattgcaatgagtcaatgttacggccagtgtgaacctattgaggactgtgataggggtgtgatgtgtctgagagcagagtgggttgcaaactataaggcatctcaccatagcaggccacagctctgttctcctgagtctgggagaggatggcaccggtatcagaacactggcccagccagaggagttgtccgaagatggagttcttcagacggctcctctgatcagtatggtgtgaaatgtagtacaattttattgctgtcagaatatgtcattcgggcttctcctataacatcaaacatttgacagattttttttttttttttgagacggagtctcgctctgtagcccaggctggagtgcagtggcgtgatttcggtttactgcaagctccgcctctgggttcacgccattctcttgcctcagcctcctgagtagcttggactacaggcacctgccaccacacctggctaatttttttttgtttgctttgttttgttttgtttttgtttttgtttttgtttttagtatttattgatcattcttgggtatttctcgcattgggagatttggcagggtcataggacaatagtggagggaaggtcagcagataaacaagtgaacaagggtctctggttttcctaggcagaggaccctgcggccttccgcagtgtttgtgtccctgggtacttgagattagggagtggtgatgactcttaacaagcatgctgccttcaagcatctgtttaacaaagcacatcttgcactgcccttaatccatttaaccctgagtggacacagcacatgtttcagagagcacggggttgggggtaaggccatagattaacagcatcccaaggcagaagaatttttcttagtacagaacaaaatggagtctcctatgtctacttctttctacacagacacagcaacaatctgatttctctatcttttccccacatttcccccttttctattcgacaaaacccccatcgtcatcatggcccgttctcagtgagctgctgggtacaccttccagacggggcggtggccaggcagaggggctcctcacttcccagaaggggcggccaggcagaggcgccccccacctcccggacggggcggctggcggggcgggggctgctccccacctccctcccagacggggcggctggccgggcgggggctgccccccacctccctccctgacggggcggctgccgggtggagatgctcctcacttcccagatggggcggctgccgggcggaggggctcctcacttctcagatggggcggccgggtagagacgctcctcacctcccagacggggtcgcggcccggcagaggcgctccccacattccagacggggcggcagggcagaggcgctccccacatctcagacgatggggggccgggcagagaggctcctcacttcctagatgggatggcagctgggaagaggcgctcctcacttcccagactgggcagccgggcagaggggctcctcacatcccagatgatgggctgccaggcagagacgctcctcacttcctagacgggctggcggccaggcagaggctgcaatctgggcactttgggaggccaaggcaggcggctgggaggtggaggttgtagcaagccgagatcacgccactgcactccagcctgggcaacattgagcactgagtgaacgagactccgtctgcaatcacggcacctcgggaggccgaggctggcagatcactcgcggttaggagctggagaccagcctggccaacacagcgaaaccccgtctccaccaaaaaaaaaaatatgaaaaccagtcaggcgtggtggcgcgcgcctgcaatcccaggcacttggcaggctgaggcaggagaatcaggcagggaggttgcagtgagtcgagatggcggcagtacagtctagcttcggctcggcatcagagggagaccgtggaaagagagggagagggagaccgtggaaagagagggagagggagatcgtggggagggagatcgtggggagggagacgggagagggagagggagctaatttttgtatttttagtagagacggggtttcaccgtgttagccaggatggtctcgatctcctgacctcgtgatccacctgccttggcctcccaaagtgctgggattacaggcgtgagccactgcgcccggcccatttgacggatattttaagtgttggagccgaagactgagaccttgttcttttttttttaatttatttttattttttatttgcttattttttccagagtcagagtctcactctgttccccagcctgaagtgcagtggcatgctcatagttcattgcagccttgaatttctgggctcaagcgatcctcccacctcggcctcctgagtagctgggactacaggtgtgcaccatcatgcctggctaattttaaaagtttttgtagagacaggctgtcactttgttgcccaggctggtttcgaactcctgggctcaagcagtcttcccacctcagcctctcaagtagctgggactacaggcacacaccaccatgcctggctaatgtttacattttttgtagagatgggggtctcactatgttgcccagactggtctcaaactccttaactcaagcgatctcaaagtgctgggattatagatatcaaccactgcacccggacattggacactgttctagaaaagagaaaaattatatgactatcatctaagtgcccgtgaatgatatacagtctgcaggggctgggagattcagaattggggataattcacttctacctggcgggtcaaagaaagtatcatgaaggaatcctttataggggttgttgattgagatggagttaaaaaaagagattctaaaaatggagattgggaccaggtaaagcattgttttccaaaccatacatcatgagtcacacaatgcaagcaatcagtgtcaacctgcacaaaaaccagagcggaaaaatatcagagcgcgttatgtgtggcaagggcaagcattgttccatgaaacttttgctttgtttttgtatattgagttgtgaagtaaaatgtgttttttattgtgaaccagactttgaaaataaagtttgaaaactgctggcctccagcggtggctgaatgggcctggactgtctccgggagatggctgctgatttccttgtgggggaaaacctggccaacctggaaagggaggggacgggttttcagtggggtggggatcaggatgcaacgtcattttgggaagctgatgtgcagtgcggtacagacagggatgaacaagccaactggaaagcaggaagtctgggaacagggaggtggccagggcctgaggtccgccaggggacagcttctgtgggcagagtgaggatgcctatggccacatcaccgtgcattcttcccagcggccccagagcacatgttcctactctccctacctctgcaggtttgggtaccttacatctcccacgaggcatggatccaaccttccttcccaccatgccccatgttcccaggtgctagcttccagcgcttgggcttgctacccatgggcatctctctgctcaccatgatggctgtgtcatttcacattcagacctgaggatgtgcactatcctaccccaggccactgtgcctggctggcttcctcctccgttcccaaattcctgctcttctatcagcctgcttgatgtgtggtgtcgcccctgactgctttctcctggtggtgtttgcctcattccttaacctgtttcagctttcttacgcacctcctccacttccaaaccttctcagctgatgggctgctcctctttccagagactgagtaggacaggctttccagggtcccttctgcctcaggaatcttgtcttgtgcttcctttccaaagaaggttaggcccaggctcagggagcccagttctcgggtgggtgggagcaggccacacatttgcagcccttggaaggggttcacagatcccgtggaagctggcatccagctgcacccaccagtgtaagaggtcctggctaaaaggatgtgtggtatggagcagacgtgctgattggtactttagtctaaggtgggtggtattcaattcgttagaaccagggaaccccctcttcaaacgactgcttataaaggcccccgacagttacaatcaggggttgcacactggtagccggtgtgcaaaatcaaatacagaatcatggggggtttttagtggttgttttgtttttggttgcccatggtttcacttaaaaatgtttcagttggttgccaacatcttaaaatctgcaggttttccattaaaaatccagatttccagcttctcttgcaaaaacgagatgctctagcaacaccaagcctgccgccctgcttggcaacaatatgctgatgataagtagtgggtttccaatttgcgcagtctccacccatctctgctgttaccagcgctaaggccaatagtggaacagttgccattattcatttcatttggattccttttcttatggttagggaaagcaggaaatattccccgcacccatgtctatgaaaagaaggaaagtaagagggccatgcttttcaaaaaaaaaaaagttaaaagagtctctttctttctgaaagtgaatttatgtttcctaaagattaatcttctaggtccagaggtcgatttagaacagaccgtctttgtttttctcttgaaactagtgattctcaaagtggagtgcctacgtgtgcaacagctgcatcagttgggggcttgtgagaaattcagatagttggatggtacccaaacctacggatccagaagcttggagggtgggcccggcagactgtgtcctaacagcccttctgatgcatgctgaagcttgagaatcaccgctctgatgctcaggggatggataggacgccagcacctcttattgtcactttctcctctccttttaagacccatgggggagagaggtgaggctccctagccaaagaggagttaaggatctcactgccgtgcccctccaggcagagtcggtacctgcggagagggctggaggagttcttccagattttgagatctcagcaaatctcagtcccgttttttctagacgattcagcacttgcatctgtgggctccacagatgccacatcgatgaagagacctggtgccttcaactgttctggagagatggttcctgggctcccttcccatggggctggtggtgtgtgaccctacaaacaagggcttctccagggtgaccaggcattcaggcgctgggggtccttgggtgaaaatatgccagttctttaaaatcatgtaggtaaagagccagccacacatgtacatttcagatctagcattggtaactcagactgctgttttcatagaagatcacttggcctccttcagctttctctctaatggctttagttactttagtgggcagtgcacgtgagccaagaaaccacgtcttttccaaatgtatttacttggagggccccaggctcgcgaagccgttgttgatcttttccccttggtccattttattcatttgtggtttggggacccctgagagcatttaagtagcccagactcctcctagggtaaaatagataaatgtgtgggtagtgctttcatctctgccttcttgtttccctctcttcctccaccttgctgcctgggtgaccacaggaaagtaagaaacccactttctaggtgagctgaaaaccctactcagagaccaggaagaactccatgtagccaatgtgtgtttattgtgtacattttctgtgcctggggatggatttgagtatgacactattgttgttctcaaggagctcccatgagtaagggatgaaggccgcttatctcaggccacccaaaggagagccgctgtgggggtgaggtgtggctgtgcacgggggaggagaagctgggcaggggcaggggctaaattgcccaggagaaagccccaaagtgaggagcctggcccactagacagagcaaggtggttccccttctgggctggagagttgaactcaagctcccagaattcagcctacacgagaggggctttctggtgactgagcgtgagtgcgtgagggtgaggacggagcctctggcagcctgtgccgcttacttgctttgcatgggtgggcagggggtgccttctgggactcccagctctgccagctgaaaaacaaaactgctcacagctacgcagtgtgtggcactcagttggcatccttctagggtgtcatttcactcgagggtgctggtcacggctctttgctgtggagatgcttctcttggtagtttcctacccaccctcttagacctgtttctccccgctgggacccctcccactagttaatgaggcttcccactggcaatctcctgttaccttctacctgattatcaatttgacagttgatgatcaaggccttggcaggtcatggcttcgactgtaacttcaaccctggagtatttgcctttggatattggattcctagacgccgcagaggagtctcaggtatgatgggaaagtgttttgggaactgccttttgcagttctcggtcagggaccaggtttgtttctggggctcgttttcattcagcccatcagctttctatgattgtaaatggaggaatcgggggacagtgtggggtgagatggaactagcaccagtcttggagacagactactgggttcaagctagcccgattataaaatgaaaataaatacttccctcccagggtttttataagggtcaaataaactactgtatatcaagttactggtccacagtagtcctttagctactaaaaacaacaaaaagataagatctaatggtgagataaaggcagtgaatgtgatttgggggatatccaatgctggggaaaaagggaaacttaacccgtttttcctgcctgttatccagcctgtctcatttttgggagcttgagcgatcgatctggggtacgaaattttcttggagtgcccttgcccatgttcaaatgaaggcacatgaggccattttcagaagtttgccagggtcttgcactggtttgtttgcagttcttggtcaaggaccatgtttgtttctgggtcttgttttcatttaccccagcagctttgtatggttgtagccctcgtggacttgcgtgtgttctccgccctgtgagttttactggcagggtctccttcagctttctctttgtctaatggctttagttactttaggggacagtccatgcgagccaagaaaccacgtcttttccaaatgtatttacttggagggctctaggcccgcaaagccattgatgagaacctattctgatgtttctttgaattctagtctcgtcattcacgtgctctttccttcagtcagctcagtttatgtcagaatggttagaaggtatcattctggagagtttagccgtgctgttgggaaagtccgggcaacatgagtgactcagcgttggtgacctcagttgatggcttttctcaaggggatggaaaagtatgggatgaagctaatatgtacctaccattgtttctactgtcttatttaatccctgcaaaaattctatgaagtaggtggtggcatctgcattttcctatgtgggaaagaaaaaagatgaggtttgtagaggtgaagtgccttggccagggttatatggctgagaagctgtggaacctgcatttgagcttcctctctgcttggctgaagggcagaagctgggtttaggggtaagcacatggatgtctgtggtcaactgagtggtttgcagggcatctatcttctgttcttagccccacccacaccccagtgcaacaagacataccttcttttgagaatctctgtagcagaatggaagttttggtttctagaagctgctggagtcttccaggcccccttgtttgaatggagctttgcatctcaatgatgtaggggaaaaaaaattaggcagaagaggatttgccaaaagggaaagtcaagagggcttatgacttcacccctcgtgtatacacagatgtttcctccctgggcccttcctttcgtggggtttgcctggctgctaacagacgggaagtagcttgtgcttcaggagaagagagctgggcctgatggagagggtcaccttttccagcagtgtggaggtcatcttggggagtggtcctgaatggggccttggttctgctgtgccatctgaccatgtgctagccctctagtcatgggggtgacatctgcacccaggtttagggtgggcagagggcaaggagagggctctgtgtgggtactggggagactcggtgtccaagctctgtctccaggcctcagtttgtccatctgtaaaatgatgagatgtgatcagatgattactaaggtgccttctgtctctaatttttgtgttagcgttgcattggttgagaaagtcattttgtctctgttttcttaaagataaagcccccccaccccaccaactgtcttgccatttgaaagataatacaataaaccctacctgataaatagtactcattttaggggatgtcaaatgtgatgggatatgtcaaggagggttttattggacttgtttaaataattttagtaaggtgatattcatgtactagctgataatagaaaataagcttagaatttttaaaaggcattaaaattaatatgctcattatagaaaacatggaaaatatagaaaaacagaaataagaaaataattaggggcattcttttttatgttgtgtatatttttctccacaattgggatcatatagtatatttaggattgtatatgatgatttgctgattgtaaaactaatttcagaccgggcgcggtggctcacgcctgtaatcccaacactttgggacgccaaggtgggtggatcacaaggttgggagttccagaccagcctggccaacatggtgaaaccctgtctctactaagaatacaaaaaattagctgggcgtggtggcaggcacctgtagtcccagctactcgggaggctgaggctggagaatggcgtgaacccaggaggcggagcttgcagtgagccaagatcgcgccactgcactccagcctgggcgacagagtgagactctgtctcaaaaaaaaaaaaaaaaaaaaaaaaaaaaagaagtaatttcaaaacacgttttaaaaatcaaaaaattattttaaaatatttttaaataaagtaaaattttaaaattggtgaaagaaatagaattgaaacaaccggagaatcccccaatacaaagataagctttgttaatgtgtctgtgtctttctttagtacttcatttgggtgagggagtgctattttccatattgagatcatactgcatactttgatttctaaagcagggacagcttttagagggaggatgatataaagagggctttgatgacagaaagcattgccatggggtggtttattggtcttacccaaattaaggaagaaaacaagacttggtccattcaatatgagtttttaacatgcagaaaataaagactgaagttccacggcgaagaaaatggccactgtggtgccttacatagcacagtgttgctttggtggacacgaaaaacaaagacttcttgtttctggatcctcccagcagagtgtccctaaagcttgaatagtcctcattgttggtatgcgcctggacagaaagggaacatcagttatgcgtgctcctcacacatggcccattgcttcatctgcactggccttgtaggagaaactcgtatcctggttctgggatggacaggagcagaaaaggaggtgaatgaaatactaaggcactaatcttcccccccgcaatgagctggaaaatccaccaggcagcacacagttctctggatttttgcattgggagtttgtactgagcaagaaatgacttacatatgcattgtatttgtattattacttccccatggctgtgttgtcttcctaattttctctctcagtgcctggagggtaaggagatggtgtcttcacttgcatgcctctaacagaaccttcctatttctttcacttgaaatactcatacaacttgatggatttgtatgtcttgaattacaaagttttgggtaaaaattcacatttgcagtttagcttcagcaaatatttattgaatacccacagcaatggacataacaatgactgtaccccgtgaagctttaaactcagtggggtttgtcttctagcactttccaaggggtgatgccaggccctgtatgcaccgtgatagagcagtgagcaaaacaaaatccctgctgtatggagcttttattctagtagaaagagctctctagccattggtagggagggtagaggagaagtctgaggaaaatctgatttcctgggtaaccctttctctttttgcctgtttatatgaatgattttttgttgttgttgttttgagatggagtttagctttgtcgcccaggcgcaactgcaatggcgcgaggttgcaatggcgcgatcaccgctctctgcaacctccgcctccttggttcaagcagttctcctgcctcagcctcccaagtagctgggattacaggtgcgcaccaccatgcctggctaatttttgtatttttagtagagacagggtttcaccatgttcaccaggctagccttgaactcctgacctcaagtgatctgcccgcttcaccctcccaaagtgctgggattccaggcatgagtcaccgcgcctggcctatatgcgtaattttagattatttttgcaattcattattaattttattaatacttgataattttaattgcaattggttattaagtttaacctattctggtctttaataatggaatatttttaaacatatatgttacatagactcttgatttccttgctttttgtcctttgcaatttggggacacttttcctgttagccccgcaagtcactgatttaaatgtttatatttgcagttacccacaactacaactaaatatggatttaaatgagcaatttttatataatcctcacctcgtccactatcttctttgtcatcctttttattcgaactgctttttttttcctgttatgatttgctgttcctctttcaaagaaatcacagcttcttacattctgacagtttcctgacagtttttcttctgaatgattttctgagacgtgctcttcctttgtgctttcaggatggtgtttcctcaccctgcttttgcatatttcccctctttatgcattcttgacacggcaggatctatgtaaacgtggcatgtaccaacagaaagtatcgactgtcactagccttggcacactgtcggcttgggggaaggttgacttcccctcacagctacctgcctgtagggttcgatggtgcacccatctctcagtccagtttctgttttcgaattggcctttgcctggtgaactgtcacgttactatctggtcctctgatactccgaattgatggagaacatgaaaactcacagttcctggggtctcttctcaatgccctgcagccagggcattggctgggcttggcctgtagcatctgtacctttccgaacagtgagcacccctcccacgccccttgttctaccctgcacttcctgctctcttgttttctgggacttgctgtacctaaatggatgatgggcagtcctctcagacagcatctgtgctgagaggagagggctggctgctcagtgttcaggtcagtgcaaatcctgcatctcaaattagagacatggagtggcagaggcatgaagtgcagctcagattatgggcagagagtggtgaaggtgtgaagtcttatttccccttttacaactcatcttggtttgcaagattttcttttcttttcttttcttttccttttcttttcttttttcttttcttttctttccttccttccttccttccttccttccttccttccttccttccttccttccttccttcctttctttctttctttctcttctttctttcttttcttttctttttttttttttgagacagagtcttgctctgtcacccaggctggagtgcagtggcgtgatctcggctcactgcaacctccgactcccaggttcaagcaattctcctgcctcagactcctgagtagctgggactacaggtgcccgccatcaagcctggctaatttttgtatttttagtagagacgaggtttcactatattggccaggctggtctggaactcctgacctcatgatctgcccgccgaggcgggcagtgtgctgggatgacaggtgtgagccaccgcgcccagcggtttgcaagattttctgcatttccttcattggcctcatggttctcgagtttttttttttttcctccgattctgtttgtcatttttggattttgtttttaagattggatgagttatttcctgttcttttcctcttattgctggtttgataggcagtgtcctggggcagctgtcagatgcttcttacagggaagtcccctgcatctccttttgccatgcccttaatctcccagagattcagtcacacgccgggtaccgtgttcctgtcgttgtggggacgtagtcagtagagaattcaagttcagttttctggattaaaaaaaagaatctccagaaccactttgtggatgctgcatggtgacttgatgtgtagccagagacagtgtttctcaaagtgtgctgagtttccaactaaggatccgtgagataattttagatcatgtggagatgacagttttaaagttatatttattttagtgtgtagtagaaagaaaccaaatcaaatctgtgatttcatagatattattgcttagggccagactacatttcagtgggatataagtcagttcgaaaaaaatattgagtaaataatagtgcggctggtacacagtgatggatggaacaaggtgtcacagtgggatatgaatgactgcaggaaggggaaaccaagctgtgggatctcttagaatcagggctgtttggaggccttttcaactgggtgccgtttctgatatgtccacttgatacttgggaattttttttgagatagcgtctcactctgtcgcctaggctggagtgcaatggcgcgatctcagctcactgcaatctctgtctcctgggttcaagcaattctcctgtctcagcctgctgagtagctgggattacaggcgaccaccaccacactcagctaatttttatatttttagtagagacggggtttcaccatgttggccaggctggccttgaactcctgacttcaggtgatccacctgcctcggcctcccaaaatgctgggattacaggcgtgagccaccacacccggccaatactaggaatcttttatggggtgggacacatagaaattttataagggtcctaggactctaccatgatatgtacaagaaactggctgcagtcacctcacgggagccctctgcccagcacagcccttggtctggagccagccacagtctatggcctgtcctctttcttgttctcttctttaatggcatcttatctaaagatcttgcttccctttgcatcctatgctcataggtccttgtgtgcctgtgatccaagtctacacccatcactcttccatatttctctttccaagataaatgagacacaccctttctgtattcagcgagcattttctttggcatctcacttggacacttttttttttttttttttttgagatggagtctcgctctgtcgcccgggctggagtgcagtggcacgatctctgctcactgccaagatgaagtgattctcctgcctcagcctccctagtagctgggattacaggtgcccaccaccatgcccagctaattttttgtattttcagtagagatggagtttcaccatgttagccaggatggtctccatctcctgacctcatgatccgcccgcctcggcctcccaaagtgctgggattacaggcgtgagccaccgcgcctggccggacactcttaactacagttgaccctcagacaatggatttgaactgcacagatctacttatatgtggattcttttcaattaatatattggaaaatatttttggagatttgtgataatttgaaaaaaattgaagacagactacctagtctagaaataccaaaaaaatttagaaaatgttagacatgccgtgaatacataaaatatattcgatactagtttatcatttactaccacaaaatacatacaaatctacagaaagttaaaatttttaaaattttacccacacaaacactcagactgtgtatggcaccattcatatttaagcaaaatgtaaacaaaggcaaagatgtagtattaatcataactgcataaaactagccatagtatatactgtagtaacttcatggccacccctagttgttattgcagtgagctcaggtgttgagagcatcggcttgtcatgtgatgctgatcagccctggatgaacagttcatcactccagtaaattgggtatcgcagtaaaatgtaagccctcactgttctatgtatttttcatcatgtttagtgcaatgccataagcctcgaataacaccatgggacccatagagtgtgccactagtgatgctgaaagcattccccagaagcagagaaaagtcctgacattacaagaaaaagttcaattgcttgtcaggtaccgtagactgacgtctgcagctgctgctgccaccatttcaaaggtttcatcttttaaacagatgatgtaaacttatggcatcagtaaatacagtacagtactgtaggtgtattttctctttcttatgattttatttatttatttagagacagggtctcactctgttgcccaggctggagtgcagtggagcaatcttggctcactacagcctcaacttccagggttcaagaatactcttgcctcagtctgcctagtagctgggtctacaggcatgcaccatgccaggttaatttatttttattttttatcttcacttatttttgtagagatgggctctcactcaccagactgcccaggctggtctcgaactcctgggctcaagccatcctcccacttcagcctcccaaggtgttgggattataggtgtgagctactgtgcccggccccttatgattttcttaacattttatttttctctagcttactttaggaataaagtctgtaatatggataacatacagaatacatgtttatcaactgtttaggttatcgctaaggcttctagtcagcagtaggttgttagtagttaacttttgagggagtcaaaagttaggtacagattttcaaccacatggggagatgggggttagcacctctaaaccctcgtgttgttcaagggtcagctgtacttatttcttcttgtatcccccctcttcatttggtttctctgcctgattctcagaactcacatcgttcattccccatgtagcccctgagtgttgagcactagtctggttagaggtgaaaaagatgaagacctggttcttgcctttgaaagtcttggagaggggccctgggggtgttgcatgcactaatgaaaggcacaggagagggagggattgggcctgaggcatgctgggggagaataattcttctcccactgcttaagcaagagcatgccccaaggttcagctcaaggtcctttctttctctgtgaactccttgtcagcctgtaggatctcaccaccatctctgagcagatgcctccagctccagctccatgtgccaagggccagactcacccctactccccaccgaacactttgaacttggatccatggtcaacagactctactgcatccccctaaactggctgtcaccatagccacatctcttcgagttactggttcgaacttctgtcatttccttccgaatcaacttcgctgtctctcatttccttatgtcccgtcctttatcaaaccttattctgcttcgtacatcatgttcctcgggctccagtcaagcccttgttttttatccctgctgtgaggcaagttctttatcttttgggaagcctccctgtaccatcccagccaagagtgacctcgccctcctctggattctgaaagctcttattgtctgccagcttatcacatagcatttggcactgttgaagactcctttgatacttattccttttttttgcccatgtttgcgacttagcttccgaattttaggagtcaggtcctacatacaatacctgcctgcatcccacacaggattcaggaaagggtagttagtaactattagttggttgattgatcatgcagacagggggccacgtatggaggaagggggcgtccctgagaccctgtaccctagagactgcttgggctgatgaataatttttccgttcatgactgtgaagcagttacaaaagtgagtcatcaccctacccagatgtgttttcttattaattatctttttttttttttttttttttttgacggagtctcgctctgtcacccaggccggagtgcggtggcactatctcagctcactgcaacctctgcctcccaggttcaagtgattctactgcctcagcttcccaagtagctgggactacaggcacgtgccaccacgcccagctaattttcgtatttttaatagagacaggatttcacaatattggccaggctggttttgaactcgtgacctcatgatctgcccgtcttggcttcccaacgtgctaggattacaggcatgagccaccgtgctcggcctattaattatcattttaagacaacccaattcatcctacagaggacaagggcctacagcaaataaggcctattttggttgacagttttcaacttgactgaaacgaaaaaaataataagagggttggtcttatctgatgccgttgaactcaggaaaactcaggttggtggaaatatcatcagtctttttgctttgggatcacggattctctgctgtctgccgttcgtgtgtgtggcttcatatgtagcaacctatctatttgcagaggccacaaggagagaccagtagcgtgtttttcacggccaacgctaatcactaaggatggttaataaaggaaaaccaaagtgacttctggattgagatgctaggatgaacccaaacagtaaacccttagaatgtattcgtgagtcttccatactctgagagattaactttggggaatcctaaagaattaaatgtctgcaggactagtgtgttctgctgaggtcaggccacagcagatcagcctcctggtttgtaatggcccggaaaggtcccttgcccttggctgggggccctactgggatttgcaatgacagtgatttctgtgtgttgcctggagtgatgcattgttgtctgtgattgtatctgttcgtctgtgtgatgcaatgtcaaagtggtgtcggagacggctgttaatgtttaacagcatcaaaactgtcccctctttgctgttacaaaactgaggagtcacaggctatgaaagctttcatggccattttaatttcacaaacctgtaaggactgaaggtgaaggtcttggccatctaggttcaaatgaagttttgcttttaccttcttcttttttttttttttttttaggcagtcttgctctgtcactcaggccggagtgcagctgcacgatcttggctcactgcaacctctgcctcctgagttcaagcaattctcctgtctcagcctccctggtagctgggattacaggcgcacaccaccacgcctggctaatttttgtatttttagtagaggtggggttttgccatgttggccatgctagtctcaaactcctgacctcaggtcatccacctgcctcggcctcccaaagtgttgggattacaggtgtgagccaccgtgcccggcccgcttttaccttcttatgggtgagagcccatctccaagaacagaaaagtatcttggtcctgtctatttctgtagcatgtctgacctcaaaagcgagtgtgtggattcgtcacccggcctctcctcccacactgcagagagaagatgcaaataactcagctgccggtgggggactccccaccgctggatgtgatgctcttgcctcctcttcatggctggtttgggaccattttgcaagtgtaggcttgagcattgcctttctcttgtttttatgatgggtgagaggggggagagagaaagaaggtgggggggattctatagccggtttcctccctctagtttctccctcacatttgacctttttataccctggtatcatgatgatttctacaaagcacagccctgattgtgacttctccctggctcagaatccactgatggtttcttctcctttatagaatcgaaatttcttagttcttggtgtcctcatggcctcccatgatctgatgccatccttcactactatatttctcacctcccatgcctcttaaactctaatgaatggatccacctgcttttcccccacagcctctacccacacggtttctctctcaccttggctcaggctggccccatggcctagaatattgcccctgtggcttgttcttctgacccatcctgcccaatctctcgcaggagcctctgttttcctctgttaaatgagggcgatcatagaattttcctttttggtttgttagagggattaagtgacatgaaacatgtgaagcatagaacagcgcctggtccaaagtgagtgctcagtacaagatcctcacagccactcctgcagcagattgaaacccagcaattagagagggaggaagagtccccccagcagccacgtcagtaactttaggaaggaagagatgggccctgctgtcaggcatgtaagagaaaagaccaggaaggtgggatgcggacacagaaggaattgatatgtccaagggaaaggcacattgtcaccccctctgggagccccagagggtgccacacccctaaacggaaaatccctcgattgacattaggatgctggctgtgtcacctcggtctccccaagattgaacgcaagacgagccatggtgagtgagtcctgctataggtggccagcctcgtcgtctttatttatttatttatttttgagacagggtctcactctgacgtccaggttggagtgcagtggcatgatcttggctcactacaacctctgcctcccgggttcaagtaattctcctgcctcagcctcctgagtagctgggattacaggcgcccgccaccatgcctagccaattttttgtatttttagtagagatgggttttcgccatgttggccaggctggtctcgaactcctgacctcaaatgatccacctacctcagccttccaaagtgttgggattacagacgtgagccaccgtccctggtcccaccctcatcttctaggtgggctttctcttcaccattgccaagaggctggggcagcttccctctgggtgtacatggagagcctgaggtggtgtatctcatgaagcggcttatgggtcacagggtcttttgatctaaactatctctgtgggtcttgggggctttttttttttaatcatggcaaaatatgcatgacatgaaatccaccatctccatcagttttaaatgtatagttcagtggctttgagtatacccacgtgtttgtgcagccatcatcaccaccattaatctccagaatgcttccatcttgcaccagtgacactctggacccattaaacacaaacttcccatcattccctgcccacagcacctggtcacctccattctgcaacctgtcgctattaatttgacttctctaggtgcctcatagaagtgaagcaaatggtatttgtccctttgtgtctggctgttgcactgagcataatgtccttaaggtccatccacatggttgcatatgtcaaaatttccttccaattagccaggcatggtggtgcgcacctgtagtcccagctacttgggaggctgaagcaggagaatcgcttgaacccaggaggcggagcttgcagtgagccgagattgcgccactgcactccagcttgggtgacagagcaagacttcgtctcaaaaaaaaaaaaaaaaaaaaaattccttccttcttaaggctgagtaatattctattgtgtttattttactacgacttgcattgtttccaccttctggctcttgtgaataatgttgccatgaacaggcagcaagaccctcccttcaggactctgctttcagttctttttggtatatacctattaatggaattgctggaccatatggcaattctttgtttaatttttttgaagaattaacacactattttccacaggggctgtactattttacattcccaccagaagggcacaagggttccaacagttctcaatccttactagtacctgttcttttctgttttgttgatatttgtttatttgtttgttttgagacagagccttgctccgttgcccaggctggagtgagagtggtgtgatcctagctcactgcaccctccgcctcctggattctcctgcctcagcctcccaagtagctgggactacaggtatacaccaccacgactggctaatttttgtatttttagtagagacggggtatcaccacgttggccgggttggtcttgaactcctggcctcaagtgatccacccgtcttggcctcccacagtgctgggattacaggcatgagccattgtgcctggccttgtctggttttttttttttaagaacctgtcctaatgggtgtgagctaatatctcactgtagttttgatttgcatttccctcatgattagtgatattgagcatctttaaatgtgcttattggtcatttttatatcttctttggaggaatatcttttgctcatttttttaaattgggctgtttgctttttattgttcagtctggactctttttggacccggggtaactgcagtgcctacctttcagccactggtgatagtaacaacaaaaatcctagctttcattgagcatttacttcgtccactaggtgaaatgtttacatggatgccccacccccaccccctttaatctctcacagcaatcttttgagaaagatactgtgatcatctgcattttacacttggagaaattgaagctggagccgttgcccagggtcttggagctagtatgtagtaaaacaacagcttagctctggtctgactccatccttagacgattgtacttattttcttcccccgacccaaggagctggcattgaaacctcttcataaataagtttatccatttgcttaatagggaaccactcggtcctcaggatcttggtttctctagaaaaccatatttaattctatataaagaatcagttcctaaaaccccaaaggtttgcatctgaaagcaaacacagaaatatgcggcattttgagtgctaaatagtcagctgctccaaaaacctttctaaacggagtgataggatatattcatgaaggatccaagccctgcccaagctcatttagttggtggctgcagtattgctcttggggtccaatcctttctccacttgtaactaatgactttgtgatcctcaggcccctttcagtggagacctcacatgagcctgtctttgttcgttatctgtccaggtttgatggtggcgagggcagagtgaaggcaagagaccttcatctcgcccctctggaggcaccagctttccacacagtggttctttgggggaacattctccgttctttttatgttggtttttatctggccttgggttcacacagctggggccggggccggggccaggaccagagctgtgacttagggttgggaggaagttggccaaaacattctccagcagggcttgggcaggcccaggaagtcccgcctaaaacacagtggacaaagctgcccttgtccacaggcctgggggtgggaggcatctgctcagtgacacaagcttggccattgtttgttgtgacctcagccaacgttttttagctgagaaaggggaaaaagagggagagtgggaaaaaaagaaaggcctccagaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatggtaagaattgatttttcttgcctgcagatgtatgctccagtttgcttttctctgcatgtttctaaaatgactgtgccatggtaaagaggcagctctgaaaactgagatttggggtctaactgctgagctgtggtggtctggggaccctgtgtgctagggggcacctttcacagatccaaggcatgagcagggaggaaaaaaaaaaaagacgtgggtcattgtgtgagagatcaggaaaagcggatgggaggaggagaaagatttatgaaggatgtcttggagagaaaggaagtcttggctcccctagttacctggggagcagtttcgtagttggagctgtgtgatggagaagcagagtggtgatgtgattttaatggagtccaaaccttgcttcctccatgtaactttttccaagtaagaaacttggattctacccacctatctggcttttaccccacggcccagttctagctggggcattgtaaggcaaaagccatttgaggactataaaactttatgaaggtaagtgggagctcctggggtcatggctccctagcagaagtacctgcccagtaatgcactgtgcttccaggcttggctgagacatctttccagcttggtggtggaggctgcaacagtgatgatggaagctcttctgatacttagcagtacaacagccttgtttcaccaatctttccacccccagaagttacgcatccatcttctttctttgcaaaggaggacctccaagagagtggtgatcactctcttgaggctctgtacagctgtgagaggtccaggttgcatggaaaggctggcctgttttggtacatggtctccctccaggatatgctctcccacctccctgggcccatcagcatctctgattctggcatggcttcctgttcccacagtgccaggggaagggagatggtgcttgttatccaggagcatctctaacgggttagttgacctaggaccgtccacagcagtgcttctcaaaggttaacgtgcatctgaactacccgggaacctttaaaatgtaagatccggtgctggggcaggacctggggctctgcattgatagccagatcccagagaacttcatgctgcccgtgcgggggccacacttggagatttgctgctgtgaggaacccagaccaatcactcaagttctgaccaaggtgtggctgccttgggtctgactgtagggcacagggagttctggcaggcctgtgtgtggatcgtggttgggtgcttcatgggggtggagggagtagcagagaagaagaacactgaagggcatgcaaggagctgggaagagccgaagtcaagctcttgggaagagggcgtgtggggtgcagaggctgttggtgggctgcccccaagctgaagtgggctgtgtgttaggggtgtaatgtgagcagtcagccagaagtgctaactgctaacaggcccagaaaaattccactggaacccgcctttggtgcatccagggtgatgcagagacagaagcccaggattccagggcagaaatccagttgctaggcaaatagagctaagaccactcacgtggctcggaggagtgacagggaagaggtggacgcatcaggacagaactcagtgtggtgagaggtggaagcacagaatcctgggtgcagtaaggcaggatccttggtgtttggggcacagcccacgtttcaggaacagtcagatgcctcctagacatgatgcccatgtctacacttgaatgtgactttttttctcctattaaaatggcatgtccttaaaacatatatactaatgctgacatttagaattattgggccgggcgcagtggctcacgcctgtaatcccagcactttgggaggccgaggtgggcagatcacctgaggtcaggagttcaaggccagcctggtcaacgtggtgaaaccccgtgtctactaaaaatacaaaaattagccaggcgtggtgataggtgcctgtaatcccagctaattgggaggctgagggaggagaatcgcttgaacctggaaggcttaggttgcagtgagccgagatcacgccactgcactccagcctgggtgacacagcaagactgtctaaaaaaaaaaaaaagaattattaagtattaggctatatatatgtatatatgaaagcccttggagaccatctggtccaacttccgtgttttagagatgaagcaattgaggcctcccagcagagatggaagaggttgctcaagatctgccagcgagactgctgcagctttaccagctccgattcccatcctgtgttcttcgcacggtggcacagagcagtggtaggtctcacatctccatagcaaggcccttggctgtcaccatttgcctactttatatgtgccagcggcagcagctccagaaatgttagttgaatcgggttggtgagaattgcaccccttactgagtcttggaaacggttccagcccttattagacttcatttccctccagagctcagggttcagacctcatcaggaaccatctctcggagtcagaagtctttgattagaatcacttggagcacaggccgtaggcactgcagtcagtggaatgagtctccgtgttggggaaatgagctgcttccattttccttcagtgcctgcaggccactccagccagcaactggtggccacaaagccaggccagctggatcgcaggtgcaggcgggccgtcagaggcacctactcttataccataatgagcttcagtctgccttctttacaacagcactaattccccgaggaagccagcttttgccccccggtgcatctgcgggcagcagctgtgtcgcttgtgcttgaagatcctttctggtgagcgggctgctttgcatgagatactgagcctgttactgatccagctagcaactttggactccctcccttgcttctgaacttaaatccattttgaatgcaataggacgcttggtaaatttggttctggggttttcctcagaagtctagaaagtgcccaaaacaatgacataaggcatttgggggctttgcagcttaatactaaaggaaggctagggaggatagtctctctgtctctctctctctctgggccataccaagtttggcaaaactctcttgttcccaggctttttctgctgcaaagggaagttgaccagcaatcctttagaggggccctcacccttccaggaactccctagggagtctgttaggtcaacaatctacaaaatgtccttcaaaagtgttttctaggtcaggacaagtgatatcgttatagatatcaactagcatagaaaacctaggatgcatgtcaagatcattaatctttaggacgaagagaaaagtactagctcaactccttcctttgacaaatagggacgtttcagcattaattggccgtaacagggacctgtggcaaaggggaagagaatccccaactgttcagcctccccatacagacctgaggtcatgtgcactatcgcataccgtgatttgggcatgcatttcatttccaatttttggtatatcacttcgctttgttggtgtctcagacaagcctttctttcccaccgattctaagtcagatttggttgagtaaatgaaagggtatctagaccaaaagagtttgagacctctttctctttagagcccaaaagtgtttggagggaagcttgcagcgagcaaagcaatatttcatcaagatttgtgtcttgtcaggcctctgtcgtctcttttgtttatgtggctgctgtttttggaagctgagctggacatttaactgccttgatattttccttgtggttttaggctgtgttacaaaagccgtcccatgcatgggttataggacctcaaggctagcaatccccccatttcacagatgaggaaacagaggcccagagaggctaagataattgcacacatcacagcttgctgtctgggaacacagcacctctttatgcctaggcctttgtgctgtctcctaatgcttttgtcatcctgagttggggctaggatatcagaatggcccacactatttttattctgctagggaagggggaggaggaaagaagcaacattcctcaacagttcatcaggaaatggagagtttgaataaaatgtctctgttaatcaaaagccagcgagcacagtcattcaggttttctggcttggaatccagaagctggaaccggctattgggaggagtctaccttgtcatttaataattacatttttaattgtgctgaaacatcaggaccagagagaccttgaaatggaacaaaatgtagggtttttttttttttttttttctgaggttccccaacccctccaggcttcaaggcggggaagcagtccctgcttcccttgttatttctggagctgttctctgtatttcaggggtgcttgtgggatgacactccaggtcctccaccccagatcctgtggttctaaaacacagtcataaggcctttaggcacctgctccaaacccgtctatcagaggccaaaagagtgactctgatatttggtggcacaattatgctggttcgtcaatgccgagattcttccaaaacatgctgaagagtgggcgtctctcagatccccatcatgccgtatggcgccgctggggagatgccaccaacgaaaaggacgggccatctcagatgcaagaaacatgctcacattcagagttttcctcatttcttgcattgtctcctctggaaccctattaactggcccttctgtcttacattcgtacagcaggtgcaacgaccataaaaatctcattctccagagtcagaggaggaagggtcatgcaggaataggggttctgcaaggcccacgtggaaggcatttctttcctaccctctgccgacagcttgattctcagatgctgcaaggctgtgacatgacttctgacccaggaggggccgtccaactcatccttgcagtttgcaggatcatttgcaaatcttttcatcaatccttgtccccccggagactccatatttccagcttggcaagtttccctgtgagggttgatgggtgaacttcctgtatccttgctgcagggactgcgttgtaattatgttcatcaaaattcctggttaaccagatcactccatttctttacagggtcagaaaatacagagtctattgttctgtgtcctctccctgcccagtcttgacaaacatacccaatgaattgactggccctcagggatgtgctgggggtttgcagggtggctgtgacccttgccaagcctaccaggagctggataggtctggagtgtcccaagtggttcagccttcaggcccatggctgggagaaaactcccatggccctaatgtctacctcttatgatgggtgccagtgacagccacagtgtgaggcttcctcttgccacttcgtggacagaggacagtgatggtgttggggaggaagtagctaatgcagatgaagaagagtatgccggacactccatggcgactggagttgcaacctggttggggagcccaagcgagtcacttttggattcgtccaaggaggctggtgggggtgggcgtctgatgtgagcaagtgggatattcaagccagcgaggtgctgatgattgctgccacatacattgtcaccccattcatctatctacaccaagtagtgaggcctgaggacacttggatagtgccaggtttggaagaggccggaggacatttgcatctactaaagcctcatttgagaagtttcttttagggactcaaggaggcagccctgctcactaggtgatttctaataagaagggtttgaggtgacacacagaggactctggtaatacctccgacaaattttgcaaatagaaaactgggagaaaggaaggcgaccctcctggctcttgtggcttcttgctggtgagaactgcaggtgtgcctcatgcacctgacccccttttcacacgggtccaaccacagttccacaggacatggtcatgctcaggcccaggcccgaaattagccgcatgctcttctctgtattttggccctgagaaccctttgaaggcttacaaagccaaacaggtgtttcagatgaggtctttggaaagccctgggttcctactgatttttccttcatccacaaagtactttggtcccaacctatccacctgaatggattccagggctcaggattccccctggaagctgactgccccctcggggccaatacaacccggtagaggtaagactcaaaagactcacagcaccagggatttgggtctccaaggccccttccctctgttgtgttccttcaggttgagaacctgtcagtttctaggaaaagacaagagtggacatgagaagcaaggacagaggatggatgccaactggtcaggtacctgatacctgatatttggcaggagggacaacaggacacggatgcttcactatggggacgggaggaaggtcagcgttttgtttccatctccctcggtgttctcatgatctcagtgttcctcctgcctcttgatctcttctagtatatataattataattattattattattgttttttttttgagacggagtctcgctctgtcacccaggctggagtgcagtggcatgatctcagctcactgcaatctccgccttctaggttcaagcaattctcctgtctcagcctccctagtagctgggactaaaggtgtgcaccaccacgtctggctaatttttaaattttttgtggtgatggagttgctgtgttgcgcaggttggtcttaaactcctgggctcaagtgatccccctaccttggactcccaaaatattaggattataggcatgaggcaccgcacccagcccttttctagtactgtctatatttgagactcaggttataatttcatttttttacagtatatattgagaatagcaacatgtatacatgattgtataactagaaatgcataattacgtatgcatttctgtaagctgctttcagcgttcagcctggatccttttgtgccgtgatttcgtcattcttcacctttatttgtcttgctctttcaggcagttgaagtacatctcttaagtacttctgctaaggaggacatgagtacttgtctctagaagaatatgtttctgttgccttcccttgtgaaagacagcttggctaccttgaagtacaatgaaggtcgtggtattttccccatcatgcaccggagatgtcttttgagatgtggctacagagaagtttgagaccagccttctttttattcttgcactggtcttcccacgtaaatgattacaggacttttatccttatctttgctgtgtaaatatgttgttagggtatgtctgctggttggttttttgaaatccactttgccttgaacagcgtaggacgtcccgtgtggcccagctctggaactttcctccccatcaacctttgtttattctttcttttctgttagagcttttctgctggtctcctcttcaggaacacccagtatccatgtcttggtttgctgttctgtcctcacgtttgcatttttcccatttcctttgcattctggggaaaaaacaattctcgtttgttctgtacataacgaattcactttgttttgcagtattgattccatgttttattgcaaccaatgtgcattttccttctgttacaacctttcaaacttccctataatttttatcatttcctgttccttttttatatcattttggtttttttttttcaaaccaacttgccttgttttgttctcttcttatgagtttttgttcttgtatcataatgtcatatcttcctgccctttgttgaggttgctagatacttttctgagatgtttcttctggatactatgtgagatcctgatgagaagtttgtgtttctcttgaggcttctaggcttctggatgttcttcctctatctattttctgcaataaaataaacaatacatattatcttgcctcccccttccccatttgtgcagctcttacaaaatacctgagaccagataatgtatgaggaacaggaatgtatttatttatttgagacagtatctcactctgtcggctggagtgcagtggcacaatcatagcttactgcagtctctaactcctgggcccaagcagtcctcccccctcagcctctcaagtacctggagctacagatgcgtaccaccatgcacagctaaatttaaaaaaaagaaatgttaaggccgggcgcagtggctcacgcctgtaatcccagcactttaggaggccaaggtgggtggatcatgaggtcaagagatcgagaccatcctggccaacgcggtgaaaccccgtctctactaaaaagcagaacaaaacaaaacaaaatacaaaaattagctgggtgtggtggtgcatgcctgtaatcccagctacttgggaggctgaggcaagagaattgtttaaacctgagaggcggaggttgtagtgagccgagatcgtgccactgcactccagcctggcgacagagtgagactccgtcaaaaaacaaaacaaacaaacaaaaaacctttatttttggagagatggaggggcggtggggtctcactatgttgtccaggctctccttgaactcctggcctcaagcaaacctcctgagtagctgggattataggcacaagccacgatgcctagctcaagaacaggacttcctcacagttctggagactgggaagttccaagatcaaggtgtcggcaggttctgttgtctggtgaggactgttgtctgcctccaagatggcaccatgttgctgtgtctgccagataaaggaatagcgtgtcctcacatggtggaaggcagaaggacaagctagtgaataccgcgtgaagctgctttgataagagcctcaatcccactgaaggaggcgccctcatgggctgatcacctcttaaaggtcccacctcttaatcctaccatgttgccaacgcctgagttttggaggggacacattcaaaccatagcagagtccattcaatagatccattaagagctgggatttgttcacagatggggcacacacactttctctaactcccactcccattccctgtctgcttatttggtaaaatagcctcctcaaatatttctgaagcctagttcctactataattctcagttttcattcactcattcattcattcattcattcattcattcattcattgttctgggcactgtgctgagattaaagctgtgaaaagagggatagggacatggccctgtcttcccgaatcttatagtctgtttctttgttgatatggcagctctcccaacctcctccttccaggccaagtctctgaatctctgacctttagaagaaaatgaagactctgccggggtccagcctgtctcctgcataactactgggtgaagactgcagtcctcaggatgtgttgtgacgttgccaggggtcccctactattttctgtgcactgaaatttctgagtatggctagaaaggctgctggagttggggagcgcaatactttcacctgtgagacaggaaatgcgcccagtattcttagagacagactctggggctggtgatgtcactgttgcatgatttgtgtcttaacccagagctggaggagagtatccttctcgggtagctgttcccagctctgtgtaggagtctgcccacctaaacaggtgtccaccaggaaggcatgacgtgggagtgaattgccagtctccagccctgctgggtcttgatcttcctggtgggctctggcagccccattagtaattggttgactccctgaggagtgcagagctggcagtggggccactcctggctgctgagtccaggactactccgggactcaaccttcccaggcgtgcccagccatgccctggctgcttctgggtgtccagctgcctccgtggttggggaagagagaacttgctggagagtcctttgtggaggagccttcaagcagtgccaatcacggcactgggctcattagcaagcattgccatagcaacgggtctgccagaaagtggctcgttaggctgacaacttcagagctgttatatatagatctgggtgtggggggagtgggggtgtggggccctgtggatatgcttttctttagagctcctattgcttctgggtttggggtgtgagaggatgcagagtgggagaccttaaaaccgtctgatctggctgctaaagcgagtgtctgacgaccacccattaacaccagcgagtagcgtttgctcacggctttaggataaggtaagagtcaggtgttctcagaaacctccggagggggagagagtcccggaggtggaggtggcatccgggttgaacttgagcttgaagcatggtgggagcggtagggagcggagtagcagggtctgtactgcctggaggctgcagagacaacctccaccgtctgttaaatagtttatttgaagggtttggggcaatggaacagaatctttttctttaataagtcactgtgcagcccaacactgtctttttacaaatcatgcttataaaaattctatgatctcagttttcatttcagaagtgatgttttttctcagttgctgcctctaatgctgcaacggagtggctttagagcacaggactcacccaggatcactgtgacaaatgcagcctcccaggctgctctggagattgagtcaggccccagagtgtgcacttgaactcacatcccaggtgactgctggggtggcccacggtgaccatactttgaaaaacactgctgtggggggatttgtttttgatctctgtaatctctgggtgactttgcttgcctgcttttttttttttttaaaggaggaatcagtagccaccattaaggggaaaattttgggggttgcgttgtttttttaaataaagagacaaggaagtcagcctacagctagggaacgtgacggcctggacgcgggcggtgatatttttgcacatcatatgctcacttggggactgggagacaggaggatcaggcttgagttgtcatcctccttgggaaggagctggggtgtcaggtggtctcagtgaggaaatggagctgagtaggtgtagctggggagagatgtggcccaactttaaggtaactggatagaagtctctagaacaaagctattattttaattaattaattaattaattttgtgtagagatggggtcttgctccattgcccaggctgcccttgaactcctggcctcaagcaatcctcctgcctcggcctcccaaaacactgggattacaggcatgagtcactgcatctcgccagctgatatttttaagcagtttgtttttaccattaaccgtgccacactgggcaagttattaaactctctgcgtctcagatgccttgttttaaagcggggataaatgccatctatgaggcaggcttgttgtgacgagtagctgattgtctaaagcacccagtccagtctggcatgcattatagatatttggtgactggtaaaaagtcattatcgatgggtacagatggacctgggctcagatatttctcgagtcctttctagagtagggttctgaagtagtgtagaaacctcctgatattacttatgaaatagcgtgtgtgtgtatgtgcacccattttaggggacagaagatccatagccttcctcagattcttaaaggatgctctttccatatatatcattgagcaggttgcctactgaacaaggaggcccaggtgagggtggatggagagggactgaagcctgtccttgcaatctggccaagggatggtcccttccagaggaagaggccgcgttttattattcccacaaagacaccctgtattaggtaaagaatttctgagttagaaagaacttccttcgttttcccccaccccaaatcctgctacctctgatcttgttccttccaggtggggtctgtccccagcccccgggcctgtgtcacctctgcttccagtacagttcccacgggaaagtgctgacagaattgaagggaaaaagccacaggactaaggaagagaagggaaggatttaacttggaaggaaactaattagaagaataagattgagagagaccttaattattgggtggttatgcacactgtgtcctctggatgcctgggggccggctgctcttgcccctctgtggccatgaagggtgaggtaatgctggtgctgttggcccttaagtgaagacttgaaggtaggaaggtctaacttctgccttcgcagaaggcagaaaaaagtttttttatttttttattttttctttatttttgaaacagagtctcactctgtcacccaggctggagtacaatggcgcagtcttggctcacggcaacctccgcctcccaggttcaagtgattttcctgcctcagcctcctgagtagctgggattacaggcacctgccaccatgcccagctaatttttgtatttttagtagatgcagggtttcaccaggttggccaggctggtctcgaactcctgacctcaggtaatccacccaccttggcctcccaaagtgctgggattacaggtgtgagccaccgtgcccagccaaaaaatttttttttaattgtggtacaatacacatgacaaaatatttaccatcagtgatatatttatgtattcatgatattgtgcaaccattaccacgatccagttccggaacagtgtcattaccccaaagggaaaacgtgtacccattctcccctccccaggcctctggaaaagacaaatctgtttctgtctctatggctctgcccattctgggcatttcatatgcatgaaatcatacaatatgtggtcttttgtgtctggctcctttcacttagcataatgtattcaaggtttatccatgttgtagcatgtatcacggctccatttttttttttaatttctgaataatattccattgtatggctgtactacactatccatccatctgttgatgggggatttgagttgtttctactttttggccattacgaatgatattgctgtgagcatccatgtaccaatttttgtctgactgcttgtttctaggtgtttgtgtctatacctggttgtctccatgtcttttgacttttaaagtcagccatcaggaggaactcctttctaagagaacagaaaggtgatgggactgtggctgcctcgggagatggaggcagagtgcggccctgcaggagggagatgtggagaccatctttgccacatcagccacattaggagatgggcctggtggccccagtgccctcctccccacctctttcagcatctcatggcccttcacggctcagtatcagggtgcctcccaccttctgtaaggtcctgaatttcctcgttgcgggagacctcgtggtcatcagtgccttgcggagaagggacggcatcattattgctctttcctgggtgggacactgaggttcacaggttgggtccactggctctccagctcctgtaaggagtggtctcctcactgcccagccctctcaccagaacgcactggccagctctcaggctgttaacctccccagcaggtgtttgccgttcaagtcgggtagtattggaaacagaaacctcagagaagtgactgttgatgctgacatttcagacagagggatggtgaggctagggtggaggtccgtatcgccgtagacggactgtgtgaagcccttccagtggaaaaccccattcattgcgcatccctcaggacaggcgctgccctaggtgctgagttacgtattgttaccctctccgtcgtcttccacaactgggctcatattatcacccttcgtttcacagattcgagaatagcctggtgagtcagtagcctgtggtcacatggctgtcaagcggtccaggcaggattggcactgaaggctgtttgagcctgagggctgttttcgctgtgcctgtgggttcctgtctcctgcaccccttttctgaccatgtcaatatttgatccttcctatttcctcccaagttatttggataagtaccaatatggctttcccatgtttgattgaaggagaaactagaatatttcactcaaggggaggacacctggcatcttgcccctctggttctagaatctctttcatcaaacactcatgcctgtagttgtatttttttgttctttgttttgagacagggtctcactctgtcacccaggctggagtgcagtggtgcgatcacagctcactgcaacaacctcctaggctcaggcaatccttccacctcagcctcctaagtagctgggaccacaggcgtatgccaccacacccggctaattttaaaaattatttgcagacggagtcttcctatgttgcccaggctggtctcaaactcctgggctcaagccattcttccacctcggcctcccaaagtgctaggattacaagcgtgagacattgcacctggccctaaccctcagttttaatcccctgaccccccacccatgccgactttatttctaatcctattggacagaatgttcatctcctgtgcatgggatacttctctttctctcaacatgcacgcgcgcatgcacacgcacacacacgcacacatgcacgttgttataatcctatttgtcttgcatatattttggctatcttccaatcctggagagtccaaagcagtgagagggcccaggtaaacctgcccagatgtgggcttgtgcttactggacatgctggtgagacagcaacctgcgaccctggtgggatgccacaccgtgttgatcctggctgctgtccacctcactgtctcctgctgtcttagaagacagtcttccatacggaatcaaacgggcactgcaggttagcaggtgtaggagatggagcgtccagggcataggggaaagcttttaattaagttgtgaaaatgcattgtgaaacttacaccgcagctacgcagagggcagaagggaggctgtgtttactcaaagtccccgagcagctcagatttactcgttccctccaatgacatgcagggcactacgggaagccacggcacgtggttttgcaaccttcacaaagcgtgagagtagcctgggagctgtgtgtctctgctgctctctttcattctgttatcttgttttcctaagcgggggtcaccagggaccaccactatgggcacagctgggggatactgaggacatttgggagccgattacctttactgtttgtgaacagtcccctggctttgctgagaaattcatggctactctcttcgtatggctacaattctgattttaatcaatttacttcaaaaggcacagcaatcttacgggctaatttggactctctgtcctaattttaaaatgttctttagctaacaacttttatttctgtgtttatgggagaaaatttagggggaacagatatgtagaaaggagagtataataattgcctgtaatcccagcacccagggatcgtggctgttttttgtttgtttgtttttatatttttgtttgtttgttttgagatggactctcactctgtcacccaggctggagtgcagtggtgcgatctctgctcactgcaacctccgcctcctaggttcaagcaattctcttgcctcagcctcccgagtagctaggactacaggcgcacaccaccacgcctagctaattttttgtatttttagtagaggtggggtttcaccgtgttgcccaggctggtcgcgaactcctgagcttaggcaatccgcccgcctcggcctcccaaagtgctgggattacagacgtgagccactgcgcccggccatggttgttttttttttagcatctgtctactagatatctagtttctttgtatgtcatatacatttttctctgatttgttttttaacgaaaagtaattctatacatggttaaaagaattaattgcacataaatgcatacaatgggaagtcagcgtctgctctgtctccgagtcctcgttctttttgccagagtgatctggacccttggcgagagaagctccatccagctcttcatggattctcagcattattatagaatgttttgcatctggctgtgggatgacttgcattaattacttctgctaggtttgcacagcaagcctggggccttgtctgctgctgtgcttcgtggtctgggaatttcaggcttcagatttcacaatgggaggtggtggagtgacagggcccccttgcaagctcagcaccccgtgagtgattttctagggggccgtggagaaagtctagctccattagctgaatggcattttcctctctgctcccagaggagctgtcctctgtgcaggggctctgaatgctcaggtgcttctcactgctcatgctcacgcaaccccggaggtcacgtgtgtgctgcctctgacctcaggggtttatgggccgcagacttcccaatgtcacgctactgtagggtgaattcatcagcctttgccttcctggtttaaaaactcttgcaaaaatgccaaatgggtgtgaccttttctttcttctccaacagaagcctggaatggtcccccctccgccgggagaagaaagccagacggtcatccttccacctggctggcagagctacctgtcgcctcagggccggcggtactatgtcaacacgaccaccaatggtgagtcccgctcgggggagaatcctgcaccaaccccctggcattctggctctctagaggggcacgttttttctcccttcttcgcctctctgtttgggggttttttcttcttaagtctatgctcaggggctacagtaaagtcttactcctcccactgtgctgggtggtaggggtgcaagtctgggtctgtagttctgggagtatcttggaaggaaggctgccctttatggtttgagtcttccttggaccctgacgtccaccctgggtatctgtgttaaacccaacctgttcgtctggggctgggttttctgaagggtgtctcaaaaggttctatggtcaacagctggcttgaataaaatgaacgaggcaaagtcactgcatgatgtcttggaattttgaaggttttaatgatcttgaagcttcaatacaggggttgcaaatgcgaggtttccctaatttcactacaacgtcatctttttccttaagtatctcactggctggcatttctccagatgttttttgggaaatgccgggggtgcttatgggttatttatcccatcaaatagtacaggttccatgtgcatctgagttgaataggaccacacctcaatgaccccaataattagggacctcccaggccttcaaatgaccccaggatccccagaagtttgctgtggatggtttataaaaggggatgcaccacgtggcaggttctgtaacaaggtgagcaaagggcactgttgcaggctgtggtcttgggcagggcaggacagggtaaaccagctgaacagagctgtgtcttgacctccgtgactccccagagaaattgccatgagagaactgagaggatttaaaccaaggaaagttagatttagtgggaatcacagacatgcgttccaaggcaaaagatgaaaatcgtacccaagtccactgctggctcagccttggcctctcactcctctgtgcctgcctgactacatgaccaccccttcccacctgggggtatcgttactacagctgatgtttataagcctgcaccaggagggggtcctagtgacaggggagccagctactgtttagcagagacacaaagaaggcagctggtttattcgtatcccctggcaacctgaccttccacaggctcaagaggggtgttctagcgcaagaggtaatgaagtttctaggaaaagggaagtaggactatttctgaccgttctaatcttacacttcctcaaaacaaacacatgaacagctttgcactgttaccggagacttgaaatttcagaggagagtgtgtctatgtatgcaacacccatctgccaaacacagaatttggaccgtaggatcatgagatcatcaattatttgggacaacattggatccaaattattggaaggtcaggttgctaggggatatgaataatttggatccgttattgtcccaaataagctactctattgcaaaggggcatggggggaaatggctttctgaatttcagcatctttatctttttttaagttagagactagtttgttttcacggtaaaaaattcagtaagtacaaaatgatttcaaataaaaaataatccccggtctcaccttttaaacatatgtatacttattcttttaaaataaattggaaaatattgtctatgttgtcctttaagttactttgacagtgtatgtggacatctttctatactttgtacatttcagtctaacccattcttttaaacagctgtgtagtaatccatcgcatgggtatgctattaatttcacctgcactctattaatttaagtcatattttatatcaatagacagtgtctggcagcttttttctgggactcagactttagcagatgccactggtgacagctttcttatgggtcctgagatattgtgatcccacagaggctccaggccaggggtcagtgaactttttctgtaaagggccaagtagtcagtatgtaggctttgagggtcacatggtctccatcccagccactcagctttactgtttcagcatgaaagcagccctggatgataggtaaacaaatgagtgtagctgtgttccaataagactttatctatggatccgaaaataggaatttcagatgacttgtgtgtgttataaaatatcatcgttctggccaggcatggtggctcatgcctgtaatcccagcactttgggaggccgaggcaggtggatcacttgaggtcaggagttccagacaagcctgaccaacatggtgaaaccccgtctctactaaaaatatcaaaattatccgggtgtggtggcgggcgcctgtagtcccagctacccgggaggctgaggcaggagaatcgcttgaacgcgtgaggtggaagttgcagtgagccgagatcacgccattgcactccagcctggtgacagagcaagactccgtctgtctcaaggaaaaaaaaaaaaaaaagtggaagatgattttcgttggcaagttcactgggccatatgatagttggtttgaccagttggtcccttggaccatagctgctggtccctgcttcaggctgtctgttggctccacaaggacttgtcctatttgcccttcctctctttatttatttatttatttatttatttatttatttatttatttatttttttagacagggtctcactctgttgcccaggctagagtacagtggcacaatcatggctcactgcagcctcaacctcctgggctcaaacactcctcccatctcagccccctgagtagctgggattgcaggcatgtgtcatcacgcccggctgatttctttatttttttatattttttatttatttgagacagggtctcactctgttgcccaggctagagtgcagtggcacgatcatggctcactgcagcgttaacttcctgggcttaagtgaccctcccacctcagcctcctgagtagctgggattacaggcatgtgccaccacacctggctttttgtattattattattattattattattattattattattattattattttttgtagagatgttttgccatgttacccaggctggtcttgaattcttggcctcaagtaatctactggccttgaccttccacagtgttgggattacactatgcctaaaaacagttttttttgttttgttttttttttttttttttttttggtagagacagggtttcagtatgttgcctaggctgatcccgaacttctggcttctacttctgcttcccaaagtgctgagattataggcatgagccaccgtgctcggctctctcctcttttatgctaaaaataattccagcacctaccttggtcttacattctagatatatgccagttttattcattacttgtttaactctttttttttttttttttttgagacggagtctcgctctttcacccaggctggactgcagtggcgcgatctcggctcactgcaagctccgcctcccgggttcatgccattctcctgcctcagcctcccaagtatctgggactacaggtgcctgccaccacacctggctaattttttgtatttttagtagagatggggtttcaccgtgttagccagggtggtctcgatctcctggccttgtgatccgcctgcctcggcctcccaaagtactggcattacaggcgtgagccaccgtgcccgaccttaacttattgtttatctgtttgattgaatcattccttcaacacatagtttgagcctcaaatatgtaccaggcagagtgagtcttgggatactggggatttaataagaacaaagtctctgccctgcaagtgtttatcttcttatagtgggaacagattttaagtgaaaacctatttgatcaatcaggaaagggttgtgaagcaggagtccagggtgttttaagagcatgtcacagagagaccctggggaatcaggggaggcttcctggagaaggaagctgcaggatgggaagggtaaggaagggctaggggatggggagtgtcttactgatggcaaagagtcagctgtgtttgtagggatcatgcagcccatgaacatcatattaataattttgctcggcagtctaagggagaaggaaagcagctatctttctgattctcctctggaatcgtttcttagacttgttttgtttggctgtagggatgttttaaatatattttaatctgcctgcctttctgcaggaaggcatctatgagaatagccactcatgtttttcttacctcctgactcctggaggcacctgagcttgtgcctcctcactgctgggccagctgcatctatctgcctttctgcctggccccttgcttaagcatctttgctctgtcgctctccaggtggcatttcatccacatgctagcccagtgcccagaaagtgcagtcccggttctaagcaggccattcttctcttcctctttgtctgtctacctttcttccagacgcttctagtctttctcccttaatccctaatctcttcttttccagagggtgcctggggataataggtgttctgtccccatttttacacctataaccagttgaaagtctaatttacatttgtattaccttgccttggctaatctgcttcttttcttttcttttcttttttttttgagacagagtctcgctctgtcgccagactggagtgcagtggtgcgatctcggctcactgaaacctccgcctccccggttcaagcgattctcttgcctcagcctcctgagtagctgggattacagacatgcgccaccacacccagctatttttttgtatttttagtagagacagggtttcaccatgttggccagcatggtcttgatttcctgacctcatgatccacccctcctcagcctcccaaagtgctgggattacaggcgtgagtcaccgcacctggctggctaatctgcttattttcacatccatttaggattttatggatgaggttgtcactgtgctagccactgagccgggctctggggatccaaaatcaaactagatgctgtctgtgatctcagaacctgcagttctaatagggccagagacacatataaacctataagtgttacaggtattcgtgtggaaatctgggggctcgaggaagggagtagtcagcttgatctgggtattaaccaagtctttgcagggggagggggcggccttgactcaggcattccaagccaaggttacagcatgagtaaagaccaggcaggagagaaaaacagcggatgtgtttggcattggttaaggaagaaagaggtgagagagagagtcaggggccttggggcattttgaggagtcaggtctttatcctgtaggcagcgggaatccatgggaaatttccaggcggtggcgtgacatgatcagaatattgtggcaaggctgcttgtgcggcagagcgaaggctttaaggccggtaagcgtggaggccgacagactaaatgagaggagaaataatgaggtcaaacaccaattctacagcagtggctggagaggaggaggtagaatctgtcagacaggatgtggctgtggcaggtcagggattggaagtgcctggattcctccgggttttctgccttgtgtgatgggaccatacagtgagtatagggtattcaagggaggaacaggttaggaagaaagaaaaatgagtccatgctgagtgtgtggttccctggggtgcgttctgggagagatggctggcatttggatggctacggtgtgacttagaggacttctgagctagagatgggaacttggtgagccatgtgggtacatggcctggccactgttgcgcagtgaccaacctgcccagccacagagggtggcccaggatttgtgtttcatcagcagagaggtgaagtgatgaggatgtagaagatcacccggggccttgcagcacaggtgtaaggcagcagccaaggagaccttgaaggaattgtcagagatacaaggaatccaggagaaggtaatgtcatcaaaggcaagggagaatagatagggaggggtagtcagggacagactgaaatatagatcaggtttatgataagagtgttgttttaaatcactggggaaagcatggattatttagtaaacggcgttgggccagatggctaacaggaagtttcagtggttaatgcagtaatgccgttgctttcatataaacttgccaatgccatcagagcatgctccgtggactttgggaagtccccatctttcttgtggctctctggaaatttcatcatgcagagtggccttcagttcagccccaggaactcccagggttttggtatcaggaaattgcttgtcttgtgctgtccagggaagctctccattcccaccaaaagttgcctgtgttgctaacggtttgggatagtgagctattatcaatagcctaccccatccagggacctcagctagtgttaaggagactgtcttagtctgtgcaggctgcactaacaaaaagccatagactggatgacttataaacaatggaaatttatttatcacagttcaggaggatgggaagtccaggatcaaggtgctggcagatttggtgtcgggtgtgggcctgctttctggttcataagaacagctgcattctgacgtggtggaaaggacaaacaagatcctctgggtttctctttttttaatttttttttttttttttttgagacagagtctcggtctgtcacccaggctggagtgcagtggcacgatctcggctcactgcaacctccatctcctggattcaagcgattctcctgcctcggcctcccgagtagctggaactataagtgcccgccaccacgcccggctaattttttgtattttttagtagagacggggtttcacagtgttagccaggatggtctcgatctcctgatctcgtgattcacctgcctcggcctcccaaggtgctgggattacaggcgtgagccaccgcgccctgcctgggtttctcttttaatggcactaaccccatgatggtggagcctgcatgacttagtcacctcctaaaagtgccgccgcttcatactggcacatggggaattaggtttcaacacgtgaatttggaggggacacaaacattcagaccacgacagggacctcttatttatacaacaaataattatatttcaagagatatagcacaacattttttgctccatttatgattgaaaggtcggctgggtgtggtggctctcacctgtaatccagcactttgggaagccgaggtgggcagatcacttgagcccaggagctcaagaccagcctggggaccatggtgaaaccccgtctctattaaaaatacaaaaattagccgggtgtggtggcgcacacctgtagtcccagctacttgggaggctgaggtggaaggatcacttgagcccaggaggcagaggttgcaatgaaccgaaatcacaccattgctctccagcctgggtgacagagcaagccactgtctcaaataaataaataaaataaaaatataactggaaggccaggcatgcatgcttcttcacttaatatagtcataggtattcaggccctctttttggagagatgctgaccttttagatatgtttaggatacattttaccatttggacattagggatatttgaagccagtatagatagatggccaagattagtttagtttaatgtattagtcaagattttacttcttatttattaatctttttatactctaaatccagtagttttatctgtgccattctttttttttaaacaaagagtaccatttgagatggtatcttttgttttttttttttttgagatggagtttcactcttgttgcccaagctggagtgcaatggtgcaatctcggcccacacaacctccacctcccaggttcaagcgattctcctgcctcagcctccctagtagctgggaccacaggcatgtgccaccacgcctggctaattttgtatttttagtagagacggggtttctccatgttggtcaggctggtctcgaacttccgacctcaggtgatccacccgcctcggcctcccaaagtgctgggattacaggcatgagccaccgcacccggccttgagatggtatcttaaccctttctcccccactataaagcagagcctgatgcaaggattgagtgttaacaccttatttaggaggtatcagtacaaagtggtgagggtaggtatgcaagggaaggaaagccaaagaacaatgccaagtgatgctggctggtgtttgacagtgaaatgcagagtcccagccggtcacttagtggatatgttcacttctggaagggctgcaaggaggagccgtagcctggagtagtctgcaggaaagcagagatgttttatctactcacctctgtcttgtctcctatttcacactggccaagcccctccccttgcacagctatttccctacacatttggtttgtaccatctgactcctaccaagctctcagaaagccagattccaccatgcagagtgatgcttcatccaagcccaaggcagtggtcagcagagcatgagtgaggtaccaagcaaaacagaaggtggctgttgatggaactatgaagagtccagtgcctgtgtccctaggcagagactctcctagaactgagtgctgtggtgaacatctgtttccaccctcagaccttgataacttgatctttcataaaagtgggttgcagaggctagtgattttgcttcataatcatcctaggaggaaacttctaaatcctctaactcaggggttggcaaactgtggcctatgggccaaattcaactcacagctgtttttgtaaatgaagctttctttattggaacacagccatgcccttttgtttacatattgtctatggctggttttgcacggagattgtagagctgagtacaagctgtctccaacttaaaatggttggacttaacgatctgacttggtgtaaaagtgatactcattcactagaaactgtactttagttcagtattcaataaattacaagagatgtataacacttcactacaaaataggctttatgatagatgattttgcccaactgtaggctaacggaagtgttctgggcacgtctaaggtaggtgaggcgaagctatagtattcagtagtttaggtgtaatacatgcatttttgacatacaatatttgcaagttacaatgggtttctcagtatatagccctgtcataagttgagggtatctgtagttgcagcagagaccacgtggctcacaaagtgaaaatatttactctctgacccttaacagaaaaagtttgacaatacctggtttaagaaatagaatcaggctgggcgcggtggctcatgcctgtaaacccagcactttgggaggctgaggcgggcggatcaccaggtcaggagatcaagaccatcctggctaacacggtgaaaccctgtctctactaaaaaaacacaaaaatttagcccggcgtggtggcgggtgcctgtaagtcccagctactcgggaggctgaggcaggagaatggcgtgaacccaggaggtggagcttgcagtgagccaagatcacgccactgcactccagcctgggcaacagagggagacgcccccccaaaaaagaaagaaaaaaaaaaagaaatagaacctgtttgttttacatatatagaaatgaagtccctgcatggtaaagggacttgatccaagctatctggtcatttataagccaagctgtgaccagactgcccagtcttctaatcttttcttttttgcctcagtatttggaggaatgggcatgggtggcagtgacttaagttggaatgagaataactgagtttgtggattagtagataaagaaaaataatctgaaataacaattttttaagggaaacctatgcatctttttaaagcatgaacccaagtccaggagagttgaaaattgtttttaagcttttttattttattttatttttttagttgacttcctgggctcaagtaatccttccaccttagccttccaagtagctgggaccatgggcatatgtcaccacaccaggctactggaaaaaaaaaagtgttttattttttgtttggttttttttttttttttttgagaaggggtcttgctatattgcccaggctggtcttgaactccgggctcaagcaatcctcctatcttggcctcccaaaatgttgggattacaggcatgagtaccacactcaggcttttaagctctatagatttatagatctatatctataaatgtgttatgtttgtgagcgaagcttggaggactaaaccaggatgtgagcttttggattcctttgccaaatagtaattttcttgatttcttgctttaatttttctttaaatgagtggattcccatttaactttattatgccaggaactaatgtgagtttctggataagttttccagtagaacacttttttttttttttttttgacggagtctcgctctgtcgcccagactggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccccagtagaacacttttaacttttctttgttacaaataattggatccttttctaactccccaaatagaatgaatggccctgataattccgtgttaataaaagttcctctgagaaggttctgtacccaaaaacatacatctatttttttctgtccatctgtgttgagcaaatgtgagactaaaaagatgtgcatgtggtacatttggttgattaaattagggttgcgtgcgtgtgcgtgtgtgcgtgtgtgtgtgagagagagagagagagagcgccagcctaatttatataaagcctaattttggctttattatttttctttaatggattcttagtggaaggctgttagagcttaaagcttcctattaatccgctttggtgtgggttttgttttctcttccaggatatccgttctaacatgtaatgtttaggtaatacttacgtgcataacacacccctcatttttcaccagtgtttaaggccaataatctcccatttgtggcaaatgccaagtggcttaaagtcagtcacactgctagtatgaagttgaagacccacacaagtaaaaagacaaaagagacagattttgttgtttgctctattctaggaagttgagttactttgcaagactgtttactggtaaacagtgtgagagcgttcctcactgtctgttagctggagtcagtgattagcagcatgtggttcagatatggaagtggaacaaaaacaaatgtgtagaataggatccagaaatcttctagaatattcagtgacccagaatattccactcctagctgtatacccaagaaaattagaaacacacgtccacacaaaaagtgtgcatgcatgctcagttcagaggagcattatttattatggccagcagcaaccaaaatgcccatcaactgatgaatggataaacaaaatgtggttttagccatacaatggtatattattcagccataaaaaggaatgaaggtgctggctgatacatgctacaacgtggatgaaccttgaaaacatcacagtaagtcaaagaagctagacacaaaaagccgtgtgccatatgattctgtttatatgaaacgcctagaatagagaaatccacagaaaaccaccctggtggttgcgggggggagctggaattaatggcgagtgactgctgatgggtacagggtttctttttgagacaataaaaatgttttaaaattaggtagtggtgcaggttatacaactctgcaactacaccaaaaaccattatattatatgcttttagagggagaatataatgatatgtgaattatattgcaataaaagtgtcattaaaaacaggcttgtgtgggcatggtgggcgtttatgactttcttggcatcctttagaaactgttctttttttttttttttttttttttttgagacagaatcttgctgtgtctcccaggctggagtgcagtggtgcgatctcagctcactgcaacctctgcctcccgggttctaagggatttctcctgcctcagcctcccgagtagctgggattacaggtgcccaccaccacgcctggctaattttgtatttttagtagagatgggatttcaccatgttggccagactggtctcaaactcctgacctcaggtgatccaccagcctcaccctctcaaagtgctgggaatacaggcatgagccaccgtgcccggcctagaaaccattctttagacgtcttggttagggagtctttctgtctgattgccaaactttggtgggtgtcagaaatacctcggaaattgagtttgtttaaaaaacaaaacaatacgcagattctatcacagaccttcagaatctatttggaaagagaaaaaatgtcaactttatatttttcaaagttttctaacagtcaccacctatttttatttgcaaggacactgtgtaataataaaatggtggaggcatagtcaaatatgattaagttgaagaacaaatttaaatccaatttcctcttatagaaatttaatgagaaaacacaacttctttaaataggtaaacatgtatcgtagccccaaggttaaaggttatataatcataaacaattgtagaatctcatggtggagctattgaagacaaacaactcaattttatggtgacaagacttagaatgagtataaaactgccaagaaaggcccttcacctggccagtgtttatattcttaagtgtcatcagcgtggctgacttgtgtatattttccagcctttattcctgtctgtataagaggatgtaatggcaggtcttataatttcaaagctttaaggtcaatagctcaaaaattgtttggatctcagcatttttgctattaaaaaaaaatacgcatgcactctgctttcaacttagctgaggctaagtcaaagaatttggggcggccgggcacggtggctcgcgcctgtaatcccagcactttgggaggccgaggcaggtggatcacgaggtcaggagatcgagaccatgccggctaacatggtgaaaccccatctctactaaaaatacaaaaaattagccgggcatggtggcaggcgcctgtagtcccagctactcgggaggctgaggcaggagaatggcatggacccaggaggtggagcttgcagtgagccgagatcgcgccactgcactccagcctgggcaacagagtgagactctgtctcaaaaaaaaaaaaaaaaaaaaaaaaaaaaaaagaatctggggcttgtactgttttcatttgtacattctgcttagcaccctggcatccggacaagatgaacagcattcctgccttcaaggaacctagagtctcgtgtgcagcagttcaggccttggaggtttggaggagttgtaaagtttcttctttcatttttctcttctatggagatctttagactggggcatcctaatttgcctctactttggttaggatgagtgtgctggcctgtagtcacttgtctctttaccattcattacatggcagagcccagtggcttagtggagtccaggcactaatcccatagcaggatctctaccagtcattagatcaaccagtactcgttaattacaggccaaaggaagtacaggtccactgtgcattgtgtacctatcaggaatgacttttgcttgatttgaactctttttgaaaagtgctggtctgtgattactggactcctagggaaatggcattataatgttttggggatggcagggaggtggcaggcaggcaaggtcaggacctctggaatccaggagagctgtcttgcaaagacacagggagggtagatgtcacttgctggattgtcattagactagagactgtcaacagaagcttccattctgtgaacacagtgcttaaaaatgttgttagttttcaacattgaaaaattgggagtttttttcgtaaacatctggatatctatcttctttcagaaaatcgtgaggtgtggccccaccagccccaccttcctgcatgaacacagctggttggggctgagaaggttaccactacctgccattttttttaatactcaactgggcttcatgcatgtgttttccgtgtttagttctgtgggtgtctgagtttgggcccgatgaaaagagggtgcctggtgattttacatcaagtattgcgggtgagggtggcatcagacacaaagtcaggaagatatatatatatatgtgtgtgtgtgtgtgtgtatatatatatgtgtgtgtatatatgtgtatatacatgtatgcatgtatatacatatacatacatgtatgtgtgcacacacatgcatgcgcgcacatacacatacatgcacacgcgcacatgcacacacatgcatgcgtgcacatacacatacatgcatgcgtgcgcacacacatgcatgcatgcgtgcgcgcacacatgctggtatgcgtgcacacgcacacacatgcatgtatgcgtgcacacacgcatgtatgcgtgcatacacacatatatgtgtatatatatgtatgtatatatagagagagagagcgagagagagagatgaagtcctgctctgtcgccgaggctggagtgcaatggcgcgatctcagctcactgcaacctctgcctcccgggttcaagcgattctcctgcctcagcctcctgagtagttgggattacaggcatgcgccaccacacctggctaatttttgtattttttgtagagacaggatttcaccatgttggtcaggctggtcttgaactcctgacctcgtgatctgccctccttggcctcccaaaatgctgggattagaggcacgagccaccgtgcccagcctaggaagacattttatgaatgaagttggaaatgagagattatgaaggggaccaagcaagagaataaaaaatctagggcgagcagacttattagtcaacaggtatgaagcaccagtttcgagagggatcttaaaacccatcctactctgcctttttttctggggcttttatgtgtgtccaacattagcgcaggaagctctgccattctggggcttgtgtggagcctgtggggtggggtgtgggaatgggaacctgtggtgcggcgggaagttttgggctacagggaggatctgtctggatggacataaccagagtgagcttttaaagggttaggtcccagcgagtcagtgaaactcctagtatgcattgaaatgatctgtaggttatattctaataagtgagtgggcaaggaccatgtgaattgattatcaagtaacaagtatttgctaaataccttccctgtgctgggctctaattaaccacttggatggcttcttgcgggggtggtgtgggcgaacacaatgcgaatggcttcttgtttgcaaagacagaatgcttcctgaagtggatatgagattgttaaaatgagactttcctttgggttggagttcatttcctttcctgcctgagtattgtgctgaaagtcctttccacctctaaacaccctacgaggctgtgagttgccactcctacgagctcatcacccaccagtgtttgagacggtgcctccctatgcaaagctggcatgaggtcccatcgatgagattgttattgttggaggaagaccttggagtggggtaatagcttttttgttacttcattctgagttggattccaaagtaggtagcactcatccaagaggtgtaggaggaggaaaatggggtgagaagttagtcatgcaggatgctgttgtttactacctgcccactccctgtgagcactgtgcccagtggcgcagaaggggagcagaaggggcactgagatggcatgagggtcttgtcatccttggacagatgatgcgccgtgctgtgcaggtagcaggcaccctggatatttctgtggcatgaagcttctgccctcttgccagctgtggttaatgcctatctgcgtgcccaaagataccctcagccccaaaagagtcgcttctgtgaggtcagtcgaaagccaagccatttattgagtggtctgccagagggatgaactattggagtaatatgttgggatagggtcctgctcccactctgaaagcttggccagattgtggggaccccatggggggccttggtggctggtgacatatggagtgggaaggtcggagcaaaagcagttttccaactggtacagacaatgtcactgttttcataatcaatattactgtactcatgggctttgggtgaacacctgcatggacttgtgctgtggttggagtatggctatcctgtgctttctttactgcccctctgggccatgccagacacctgcggtctctgctgcggaacccccaggctcctctgtttctcatttgtccagactttctcatccccagatcaacttccaggtgttaggtggacctctatccaagcctcctatcacccccagccagccccagccttctgcttcatgttacgggttgagttgtgtcccacaaaagatgtccaagttctaattcgccagtgcctgggaatgtgatcttatttggaaataagatctttgcaaatgatcaagttaagatgtggtcttccagtgtggcaattcctcaaggatctagaactagaaataccatttgacccagccatcctattgctgggtatatacccaaagaattatgaatcatgctgctataaagacacatgcacacgtatgtttattgtggcgctattcacaatagcaaagacttggaaccaagccaaatgtctaacaatgatagactggattaagaaaatgtggcacatatacaccatggaatactatgcagccataaaaaaggatgaggtcatgtcctttgtagggacatggatgaagctggaaaccatcattctcagcaaactatcgcaaggacagaaaaccaaacactgcatgttctcactcataggtgggaattgaacaatgagaacacttggacacagggaggggaacatcacacacccgggcctgttgtgggatggggggacgggggagggatagcattaggagatatacctaatgtaaacgatgagttaatgggtgcagcacaccaacatggcacatgtatacatatgtaacaaacctgcatgttgtgcacatgtaccctagaacttaaagtataattaaaaaaataaaaagatgtggtcttcctggagtatagtggacctatatccaatatgttggggtcctcatcacaaggaggaaatgtggactcagagacagacactcatggagggaagacgctgcgaaggcacagggagaaagccatctacgagccaaggaatgcccaaggccaccacaagctaggagagaggcctgggacagattcttggaaggagccaaccctgccagtatcttgatttcagatttctggcttccagaactgtaacaatacgtttctgttctttaagccacccagtaatgtggcattttgttatagcagccccctggaaactgacacacttcccccgccccacactagtggttatctttgagcactgatagctaagcagtggtatcgtgtccgctaggatgctgtaaacaggttgcaatctgtcccctacatttcaatacccggcatgaggttcaggtggcatgagcagcaggaagggtggcttgttttcccattgccttgccaggccatcggtgaatgtggggtgcaggctcttgcttagaagagctgtcttggtggcagttccaagagagatggatttttttaaaattatgtgtttttgttttttggtacaagctgcagaaaagagggacttaaaaaacaattaatttccaaatacttttgatccttctcttggctgctctgaaccataccagagaggacttggctgaaggtcttgcctgcagctgtgctgtttcctggttatgttaagctcttccttgcatttccagaatcctgaaattgcaattcccccatctctaaaagagagagttgggctagtttttaaaacctttcaggctctgtatttcccctgagagacaaccctgatggccgctgcaggggagcgctcagctcctgcctccacttcccttttttccccgattcctgctggctgggtgtctcccggcagtgagacgacacctcatcaagttggggagaaggtgcttgttcacagtgcttctttccaaggcatgggattagggagggttttatttcctctttttacttttctgttttccagtgtttcttccctggacctgtattacgtttataagtaggataaaaataatttctctgaaatagaggagagggctggagcttagcaccaagactttcttttgcttcccattccctagcataaccctcttgctcctctgtttctcttgatctttctcagatttctgtttttattcgtgtcctcttccctctttcctgctcgaatcttctagttgtattttggggtgttgctacgttaaacaagtggtcttatgttctggccatcaggggtttgttccagggccaagctgtgtgaacgtgaacctgagcctgaaaaggcccagggctttgtttgtttgtttgtttttatatgatacaaggagcatccaacaatgcccagcccgtgtgctctctgccactggagaaggagtgtgccaggctggaaggcaaggagatgatgactccttgtctcagaccaagacttcgcttgctttctgctcctggtatatacaaatggtatgtgctgattgggtagatgggtgccactgcagaaaggtacggagaagacagagcagacgcaaagccttgggaagcggaagaacagaaagggccaggggcacatggtgatttttgaatgctgcgatcccacctagctggctccactctttcgtatgaagagtagattcttataacaaggtgtgcaaacgcagaactttcttcactagcagaatttagagacagagatgaaaatctcaaggaactttcatgacgacctgagtatctgggaacctggctgatttcatgactctcagtgaatctgccctgttgcgttcactcttcttttcctagatctctctgaccaacctgatgtcatttctgtagttttcatcattaccacccgtttggaggaaatggtgcaggcagagggtgctttcaagtcaagagtaattggtgggttgttttgattcttatgcctttcttttaaagggtcctacctccaacacctggataaaggtagcacctggtgcagagaaaaccctgccctttgttgccttctagaccagtgtttctcgaagtgtggtccccagaccagcagcatcagcgttacctgggaacttgttagatgtgcaatttctcaggccctaccccagacctactaaatcagaaactctaggggtgagacccagaaatttgcattttaatgctgcctccagaggactgtgatgcttatatcacacagcatcataggactggcttgaaactgaccatctcagtatgaaacagaccaagtctatgaaacagaccaagtcttagtcagtgcctaacagctgcaatctgttttaaccagtccttcaagtgattctgatgcgctctgacgtttgagaagcgctcctttaaggctgcccctgttcctagcatcttaccattcctctgcatggatgaagttttcagtcctctttgcagggaggtttttaaacctcctgcaatttcccaaggaatcttatttccttatttccttcaactataagatgctgcctagttctgcttcattttgtgtgatcttctctatcctgaatgccatttttgacgtttgagaatagctttttttgcccagaatttctatacatgttttacagtgctggttcatgataaggactttttctgtgtgcctgaaggagccgtggggctaaatggccatcctcttccttgggaatccagcaagtttacaagtggctttgtggccacacctgagagattattgctgatttctattttccagaatagcctcacctctttctatttcccccaagtcctgtgaaaagcaatactcagtgattttgagcataatttttttttttttgaggcaaagtcttaccctgtcacttagggtagagtgcagtggcacaatctcggctcactgcaacctctgcctccccagttcaagcaattctcctgcctcagcctcccaagtaagtgggattacaggcatgcaccaccacacccagctaatttttgtatttttagtagagacggggtttcaccatgttggccaggctggtgtcgaactcctgacctcaagtgttccacctgcctcggcctcccaaagtgctgggatcacaagcatgagccaccgtacctggcctttagcataatttatacacataaagtcacaccttttactggaaagtcttctatatacagattagttatgcgagcaattgaagttaataaaggccgagtttctcagaaaacagcaacaaaaagttgatgcataagcggaaaaatgccatttatgggagaagtttcgaagcagttgtgtggtatgattttccatggagagattatggaagcactgcttggagcctgttaaaaagctacagttcaacatggtcaccgaagaattttccagatgtcagtctaatggcctctgggcctgtgtttgccatttacagggcagtgtgctttgatggatgtccttgggcagggagtgtcttgttataggactagaaacccgctcatactaacttatgaaaaaagggcatttattagagggatatgggggcatctcacaggaatgcaggcgtaaggatgggaaaatcaggtgccaagattgattgtcctaactgtgggacctggtgatgtctgatgctacttcttttccttcccttcccttcccttttccttttccttttccttttctgtctttctgtctttgtctgtccttctttctgtctttctgcctttttttctttctgtcttttccactttttaaaatagagacaggggtctcactatattgcccaggctggtctcgagctcctgggctcaagacacctaccttggcctcccaaagttctaggatcacgggcgcgatctttctctgggttctcttcatgcatctttctctccgcagtcttgccttttcttcttcagcagccatttggcagaagtggccactcatcgtggaagaggaccaccccaagtcctgttctatacaactcttggcaggtccagtagcagtagccaagtagtcacgcccatagcatgtgtatccaaactgggatttgggcagttcttagagaagagtcttgaacatgtgtagttggatattgtgaaatatatatttggtcttccatccagctccctggcataaaccttggaatctccagaatgttagtctcttgtttgctaatgagatgatgggtgtctgggatcccctaggcagcttcaggatggcagctggtcacaggaaagaccaaggcatgcttagaaggttggaacttcagcgcctaccccacaaacctctggggagaggaaagaggctgattatcaattcccagtgatgacatcaatcgtgtctatgtactgaagcccccgtaagaacctagaaaaacagggtgtagagagcttctggtcaactgaccacatggagcctggggagtggtgccaggagagggcatggaagccctgtgccccttcccccatccctggccctgtgcatctcttccatctgcctcttcatctgtatcctttgtcatagcctgtgtaataagtgggtaaaggttagtaaagcgtttccgtgagttcagtgagctgcttttgcaaaggaatcgaacccgtggagggagttacagaatccctgatttatagcctatctgtcagatgtgtaggtgacaacctgctgcttgtgattggtgtctgaagtggggagtagtcttgtgggaatgagccttcagcctgtgggatctgatgctatctccaggtagatagtatcagaatcgatttaagttgtaggacactctgcttgtgtccgctggagacttgctggctagtatggcggggaaaactcccatatacctgatgtcagaagtgttgagtgatgttgggtagagagtaggagaaacagtttagtttttcctatgttatcagatgtagcaaatggttgtcattttttatgttttattattctgactgtgatttttaaaactccacttaatagataaatatgccaatcttttccttttgtgatttctgccctttgaggccacactttaaaaggtctttaccaataaaagatggtaatattttcttctagcagtcttatggactgtttccaccgcccccgcccccacccgcccggcccctttaaaatattaagccatatggaatttaatttctgaaaatgaatgagaaagggacctacctcaatatttttcaagtagttctcccatcgttcaaatagcattgactgattcagcctttcaccattgccttgagaagcacctctttaccatacgctaaactagtctggctgagtctgtttctggtctttttccccttggtctgtctctctgttcctacaccaagttttgtctgttttctatcatggaaatttctcatagattcaaatgggatatactataaaaatatagtcttctggcctggcgcggtggctcatgcctgtaatcccagcactttgggaggccgaggtgggcagatcacctgagatcaggagttcgagaccagcctggccaacatggagaaactctgtctctaataaaaatataaaaatgaacctgggtgtggtggcgcatgtctgtaatcccagctactcaggaggctgaggcaggagaatcgcttgaacctgggaggcggaggttgcagtgagccaagatcacgccactgtacttcagcctgggcgacagagcgagcctctgtctcaaaaaataaaaaataataaaaaatatatatatatgtgtgtatatatacacacacacacacacatatatatatagtcttttttttttttttaaattatactttaagttttagggtacatgtgcacaggttagttacatatgtatacatgtgccatgttggtgtgctgcacccattaaatcgtcatttaacattaggcatatctcctaatggtatccctgccccctccccccaccccacaacaggcccgggtgtgtgatgttccccttcctgtgtccctgtgttctcattgttcaattcccacctatgagtgagaacatgtggtgtttggttttctgtccttgcaatagtttgctgagaatgatggtttccagcttcatccatgtccctacaaaggacatgaactcatccttttttatggctgcatagtattccatggtgtatatgtgccacattttcttaatccagtctatcattggacatttgacttggttccaagtctttgctattgtgaatagtgccacaataaacgtacgtgtgcatgtgtctttatagcagcatggttatagtcttcttactttggtttcatttttaagaaagaaccagcatcaaatgcttcatgtgtattctttcggcacatttgccttgcatatacaagcacagacattttatttatgcccttttgttaaagtgagaaccttttgtacacgtagtgtgttttggagcctttcactccagcactcatgcacttcagcagctccacaggatgccaccctgtcgatacatcattgtcccctgttggtgaacatttaggtcacttcccaagagtcttttccctctaatgaaaagtgctccacaaaataccttcatacttacattattgcacacctaaagctattgttaggtcaaaagacacgtgcatttgggcttttgatggatatctccaaattacctttcacagacaggcattctcacctgtttttgcagatcctggttagataggggttatcagtcacaaaggaggttattttccccatgggtgaaaacatagtatcttacagtcttaacttgtatttctccaattttgaatgagaatgagtatcttttttttttttttttgttattgatcatttgcaattgttttttctgtaaatcacctgtatatgttctttgctctttttaaactgggctgctcactgataggtagttcataccacacaaagggaatagaggctttatctgtctccctggcccccttcttggtctttccctcgtctctttatctttctttttatctacatgcatatacacatgtatctttaaaaatcagccatcagccatgttactgaacataattctaatagttgatttgagctgagtcttccttcatttatcaattactgagtgtccttggtgcccaggagacaggtccacatttattcaatacagtcacaaccctcagaatacatctggtgggagggataggtatgaaagcaggggatgtagctgaggcagaaagagattcttcttccagccagcctgttagctccctagggcagagacgatactgtgagcccccctgctgctccccagtgctcagaaagtctgaatgaattgacaaggagcacagggactggactgttaggccacctggactcttccgttgccacgtcacggtgagaatagctggctgcctcactttccctgtcagctccaaacacctgggaacaggattgcttgaaacttgtctttcctgccctctaactcaggacttggccctcaggggcttaagataagactttgggaaggggttgtttgttttttttcttgtaaatttgtttgagttcattgtagattctggatattagccctttgtcaggtgagtaggttgtgaaaattttctcccattttgtaggttgcctgttcactctgatggtagtcttttgctgtgcagaagctctttagtttaattagatcccatttgtcaattttggcttttgttgccattgcttttggtgttttagacctgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccaatgcttgtttttctcaggtttgtcaaagatcaggtagttgtagatatgcggcgttatttctgagggctctgttctgttccattgatctatatctctgttttggtaccagtaccatgctgttttggttactgtagccttatagtatagtttgaagtcaggtagcgtgatgcctccagctttgttcttttggcttaggattgacttggcgatgtgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgagtgggagttcattcataatttggctctctgtttgtctgttattggtgtataagaatgcttgtgatttttgtacattgattttgtatcctgagactttgctgaagttgcttatcagcctaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagcatgatattggctgtgggtttgtcatagatagctcttattattttgaaatacgtcccatcaatacctaatttattgagggtttctagcatgaagggttgttgaattttgtcaaaggccttttctgcatccatcaaaaagtgggcaaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcaatcattagaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacagatgcacatgtatgtttattgcggcattattcacaatagcaaagacttggaaccaacccaaatgtccaacaatgatagattggattaagaaaatgtggcacatatacaccatggaatactatgcagccataaaaaatgatgagttcatgtcctttgtagggacatggatgaaactggaaatcatcattctcagtaaactatcgcaaggacaaaaaaccaaacaccgcatattctcactcataggtgggaattgaacaatgagaacacagggacacaggaaggggaacatcacactctggggactgttgtggggttgggggaggggggagggatagcattgggagatatacctaatgctagatgatgagttggtgggtgcagtgcaccagcatggcacatgtatacatatgtaactaacctgcacattgtgcacatgtaccctaaaacttaaagtataataataataaattaattaattaaaaaaaataaataaaattacaataaaaaaaaaaagactttgggaaggaggccaggccctgctagaaacacctccccgactcctgctgcctgtgcccacacactggaaccttctccccggaaccttttccctccgggcttccctcactgcagcactcactgcttttgtgccttctcctttctcctcatcttcacctattctagaaagactctgaggactcagtcatgctcatgggtttgtggcaatctcttctaattcatatagcacccctgggaactcaagtaggtagcaaagacccatgtcaaagccgcggctcttagaaggttggggtaacatctggggggttccttaaattactctacattgctaccatgtaccttgcctgatcctaagtctaacccactccctggggcttttgtctgggcccaggtacctcctgatccttggctgggttccgtgaccgtcctgctatggactatactagttttcccgacatgtggttagtcactgagatcgcttgataaaaatgatgagttgagttcctcccagcctactcaaccagaagctccaggtgtgaggtctgggcaccagtatttctaacaagtggctccagtagttctggtgagtaactggattgggaaatgagaccagagctttgccaaacacctgtgcttaggttctggatctggagcatccaggctttggattcgataaggtgtcttctcagtttctcaaccataagatgggagtcatatgcgtgagctggcagtgggttaccagcacctgttgtctcggtgacaagacatatttctccaacattgcagtcaaccttccttgcccttcaacccaagtttgggtcagtgatcgtcttttaaatgctcacagattcccggtgtgtttgcacgggtctacgctctgtaaggaggctggtagatcagggatcctaatggggattgagagacaggcttggacagctccaggcagcaccccctactccctgcgacccttcgaattccttggctattcctggattcctggccctgctctttcacaggccctctgtgcaggctggagccagaccagagcttggttctggcaaatatcaaagggccaggacactgacggggcctctgcttcatcccatcagtaacacagtttctgtatcatctgtgaaatgggcacaggagcccctgctccccaccaagattgtagggctgccctaagaattttgtaagcagctgtgagtgggaagttggggaccactcatagtgatgtttccctggttaactaagggatagcctgacactgcagcaatgctaaagaaggcattctagccccccttcacccctagcacccctcttttgggagatgtgctccttgtaggcatcaaaaggaggggtgaggcagggatccagcttctggggtagaagttgggaagcaaagaagaggaaggaaggaatggaggtggttttagttttttgttttgtcttattgttgttcttagtgtctgtgagtgcttactctgtgtcagaaactgtgctaagagctgtatgtacctcactgagtcctgtcctcaacaccaggaagctgggacccctatactgctatcccgtactttacaacagggaaaccgaggccaaataacatggtccttgttaaaaggaatagatctgggatttttgaacatctgtctgtaagatgccagcgccagagctcttaataacggattctcagaccttagagtataccacaatcacccagagggcacccagcaggttccagataatgctgatgttgctggtccgggaaccatactttgagaactactgccctggatgatccaatctggcccccattacctctgaactcatcttctattttcccttccccacaattcctcttcagccacactatcctccttgctgctctctatgatgaaggacatgcttctgcctcagaacatttttattttatgttcccttcatttgggattctcttccctcagatatgtgtgtggcttgctccttccctctgtgataggagccttccaagatggcccccaacacactcacctcctgatacactcctgtgtcatccctttctaccttccctcctgggtggtccctgagactaatagattgtggcagtcatgatggagtgtcacttttgagactaggttgtaacagacattgtaccctttgccttgctttcccctggctcgctcgctctgggcgaagtcagcagccatattgtgcagagcccgtggcaaggaactttggctcctgccagcatccgtagggcgagctttcttcttttttcttttttttttgagatggagtctcgctctgtcgcccaggctgaagtgcagcggtgcgatctcggctcactgcaagctctgcctcccgggttcatgccattctcctgcctcagcctccccaggagctgggactacaggtgcctgccaccacgcccggctaattttttgtatttttagtagagatggggtttcaccgtgttagccaggatggtcttgatctcctgacctcatgatccgtccacctctgcctcccaaagtgctgggattacaggcgtgagccaccatgcccggccagggtgagctttcttacaagtagctcctccagccccagtcaagccttcaaatgaggcagcacccactgacttcctgaccccaagctcatgggggaacctgaggcacaattgcccagctaagccactctctgattcctgatgtgctaaaacaatatgaaataatgaatgtttgatgtttccaactgttaaattgggggtaatttgcgatgtaacaatagatacataatacatttctctcagatcttcattctgtgttcctttcttggtgaggccttccctggccattcttaaattacagcttcgttctcataacactttctatcccccttccttgctttattctccttagtgtgtaccaagagctaacctgatatgttttgcttattttttgtctcctggcacaactccctcccccaatcccattagaaaatttttaagttttcacttatggaaaattttatacacatacacattttatacacatgtgcatgtgtctaaaattaactaaagatggaatggcataatgaccactagaatttaagctgaaggaggaggagtttaaccacttatatttcctgcaatataaccccgtgtccagcacagtgcctgacacagaataggccctcaaatatgtgttgaatgaataataataatattcatattgaggatgattctcaaataaagggttgtttatagattaaaatacactgttttgctgcagctcccagagtcccagcctagagctcagacacggtgagtgtggccagaaaatggtggtctttgttgtcagactgagttccagagatgccacttctcactgaggcctcagttccttccattaaaagtggaaatgggccgggcgcgtagtcccagcactttgggaggctgagacagacggatcatgaggtcaggagatcgagaccatcctggctaacacggtgaaaccctgtctctactaaaaatacaaaaaaattagccgggcgtggtggcaggctcctgtagtcccagctcttcaggaggctgaggcaggagaatggcgggaacctgggaggcggagcttgcagtgagctgatatcgcgccactgtactccggtctgggcaacagagcgagactccgtctcaaaaaaaaaaaaaaaaaggaaatgacagcacctatctcataggtgttttgtgaccgctgaaggggatgccagatgtggaggggcttggcgtgaccaggcgtaaatggttcttcagagagtagtttctttcctgcagagaaactgtggttgtgatttaaatatcatttaattttttttttcgagatggagtcttgctctgtcacccaggctggagtgcaacgacgcgatctctgctcaccacaacctccgcctcctggcttcaagcaattctcctgcctcagccatttacttttaagagggaatttcaaatgtcttgtagcaatggctgtactggaaggcattgaaaaaccagagatggaggaaactctggtgcgcaggagggaaccaggtctctgtgaactgctgcttttgtattggccaagggagataagcaggggcctccaggagaatgtggcctgattgcaaattctgcatctgcctggaccaaggcaatggggctcgcttggaggacagggcagcatagcctgggggcaagccagcttctgggtaggaagggagaagggctgagaaacggagtggcagggctgccatctgactagaaaaacctggccatagctaggcagaccctccttgtgaggactacagggcaaggagagaagccatgggtagagagaccgccaaaccagggcaaggaagaaagaaaatttggtggtgggggaggaggagatagagcaagtagcacagaagggtgagtataaagagaggcaaagaggagaagactgcaggaatctcagatcaaagtcaagaccccagagtccatttccttctgctctggtatctgtggttattttacctgataaccacagggggcagcagagagccggcacaagccaagaaaagtggacgagccccagcaggaggccactgggggccagaggcttgtaggtgggcccatggccagtcaccataaccagtggcttaggtccaggggctccttgtggctttcccactggagcccaatattgctaatgcaggcaggatgcagccttaacaaggggaaatgaagcccggaagtgactatttaaaattaataacttccgcctagctcactgtttttaaaatttattattattattttgaagaaggggcatctgtgctttgaaactcagatttacatagtcttcaagctttcaactggtctctcactttacaaattattcattcactcactcatccattcatttattcatttatagagatagggtcttgctgtgttgtccaggctggacttgaactcctggatcctattgcatcagcctcccaagtagctgggactacaggcgtgtgccactgtgcccagctgtctttataagttttattctatgtggggtagacactggcattcgctgaggagaagattaacatctttggctcttagcattaatgctaaaatagtacctcccttagactggtttcatccatggccagtatatggctctctgggtctcagcggaagaggtctgaatggagttctagttaccactaggaaaatatgtgttttgtgtgaattaggtggggtgggaagaggctccccggggcacatctcacttcttccactctgaccgcactgttcctcctagaacctctggggcctgtgtggccatggctctgttagtagagtgtgggcagtcatccgggatgacctaagaccacagggatggacgtccagagaatgcagaagggtctcaatccagcatctcttgaggcctggagctgccgcttcagtcttactgtgacttggtcaaggagccagatgtgttgtaagcagattagggaatcttgtattggaaaagacctggacacggcttcctccctgtgggtagtatggtcctctggggtgacttgtcctgctgctggtgaggtcacccagccagagccccagtggctctctccagatgtctgcctggcctggcctggcctggctcagcaccatccctgccccaggctcacagtgtctttgtgttatgggttggtcagatctcgccaagacaaggagatggactgggctgaatccttcaggcagctgcatcgtccctgatggggcccatttggaggttagaggggagggatatggtacttacggagactctagcttgtggggggtctgggagttgaccaggccagtgagggcagggaaaggggcctcccatcgggtccccacatggacagcagcattcagactgcaggccagcgtccacctagggtttcagagcctcctgcagcccccggagctgctggctgctgttctgattgcctctgtactggtagttcccttcatggagggctcaaggatgggggatggggagaggaacggggaccagcagcttctctgttcaatagtccagatgttattttgggtccgcagtggttggtgatggctcgcaggtagtaggcaaacagtgatggatgaatgggtgcaaggatggaaggagtagtcagtgcatgaattgtgaccctctgccccaaccagaagatcaaaggtggtgtctgcacatcagctggtgggacttccttttaaaataaggtcaatggtgtcagccaccaaaggggtggtggcagcagcacaaagggaaagttttctgggaccttttccctgctgtttattcctggagagcacatcaggtgggaatctctcttgtgctgtcacaatgtccgtctttctgttggcccatctgtccttgcatccttcaggccaggtgccgtatttgagagggcgaaccagccgtggcttcgaccctcaaggagataaggtgtcaaggttaggatctgagctgtctgagggatggacaaagtgctgatttcctagaaaaaagctggatggaatgtgtgtgttgcaggacttaggtcaggttctcaagaagacttgaggcagatttacatgcaggagtttcagtagggtgtgtgctcctgggagcaacccccggggaaggaaggaagcagcattgcaatgcggccaccaaggaggcctcggcagcgccgtggggagctctgagctgggaggggccttcagaattgtttgatttgagacaaggggattggtgggccgttgatcccctctcaccccagtcattagatgtgcaccctgcacccctactctaggcatagccttgggcacggcagctctctttggctaagggcggttccctgagagggactcagctatgagcctctgcagctagagagatttgggtggtgcactacagcacccactctagagagtctggggaagaactctttgcagggaagaagagcaatcttgataggctgcatggtggaagagacattttagttgagacttgatgagtgaacaaggttgtgatatccagggatgggggagcaggaggcggcaggtatgggtgaacaatacgggaaaggcgtatttagagatcggcgaggcaagttaactgggcctgaagtgaagccagtgggatgtcagtctggatgcagtcagggttgggatcctggagcactttgccaggaggccagtggacttcggaattgattccgtgtgccatgttggaaaggagctagccagggattttcgctgtgaagtgacctccggcgaaagctgggctctagggtgagtggtccactagctgtgagtggacggatttcaaaaggcagggagactggctctggagtgacatggagaagacaagaggaacgtgatggaggggcatctccaggccctgggaaccaattagatatgagggatgggacatagggtggagctggtgatggtgagtgagccctgtccctggttgtccaggggccagggaacccaggagactcggaggagagggtggagaggggagcccggtcttgactctgtggatgtgaaggcaacagtgcggcctccaggcagggctgattcaacgggcaggagagaagagaagcctgcctaggaaggagcctgaggctggatggtgcatctgctcctggggatgcccacctcgctgcttttgctcatcgaagctccaccgggcttgtctgtctgttttatttagtgctgagaaagcacataccatgtgcccgatgttatcctaagtgctttgtacaggtgaacccaattaatgctctttcccagcctacttaggtaccattttcatccccattttatagttgagaaaaacagaatatagagttcagatgattccagaggtcactcagcgtatgaatggcttatgacgtgggccctaagcagggcagtggtctttgaagtaagttctccaaggcttcctgctcttgccagccagtgggtcccttggagaagctcctaagcctgctggcagcctctctccttgtcactcctcataaaagaccctactactgtctggtttatgttcacaccgtctctgctttccagatcaccctcaattctgttttctctcccttaagacatgaagggaccatattacccctgttatgcctgcccctggagtccaggttcacccttcctgaaacccaaaccatgggccttgagaccaccaatcacacctagagagcgggagtattggggcctacgagaccaagtagccgaacctctttattttggatgaagcatcagaggaccagaagggtggtgcgatttgcctagggctgcacggtagtttaggagcaaagttgagtcaagaacccagttttgtttttattgtttgaaacaattgaattttcagtaatggaatttttaactaaataatgttatatcctcatatcagactaactttaaaaatgacttagcgctagaggcatgtatgtgggcctttggtattggtacagtatctcccttgggtggacaccttattgaactcattttacataggaggaaagggagtcacagagaataagtagcttggccaaggatagtggtggtgagaggcagagctggattccaacccaggcagtctgggtctagaatcaccacactaaacagagcctaactactttgctataccgcccccttcagtgattttggaaagtttttaaaatttatttttattttatttgtttatttatttttgagatggagtctcactctgtcacccaggctggagtgcagtggcatggtctcagctcactgcaacctccacctcccaggaccaagcgattctcgtgcttcagcctcctgagtagctggattacaggcacacaccatcgcgcccagctaatttttgttatttttagtggagatcgggtttcaccatgttggtcagggtggtctcgaacccctgacctcaagtgatccacccgcctcggcctcccaaattgctgggattacagacatgagccaccgcgcccggcctattttcattttttgagacagggtcttgctctgtcacccaggctggagtgtagtggcgccatcatggctcactgcagcctcgacttcccaggctccagtaatcctcccagctcagcctcctgagtagctgggaccacaggcacgtgctaccacacctggctaatttttgtatttttggtggagatggggtttcaccatcttgcccaggctggtctcaaactcctgagtttaagcaattcacccacctcagcctcccaaaagtattgagataagacgcatgaaccactgtgcctggacagattttggaaaggtattcacaaaaatttatacataaaaagaatctatagtttgattttgtctcattttaaagagaaacatatgcttagaaaacaaatcaacatatggataccaaaatgttgatggtgatgacctctgaatggtgggatgatgggtgatatttatttttgtgtgttttcctgcattatcaaattgtatgtagtgagaaagtattatttttatcactagataacttcataagaagtctctgctcatggcagtgaaatgggtaaagtagtgtttgggggacaatactatagcttgcagtattagttttctctctttctttgctttctttgctttctttctttctttctttctttctttctttctttctttctttcctttctttcctttctttcctttctttcctttctttctttctttttttttgaggcagagtctcattctgtctcccaggctggagtgcagtggcacaatctcggctcactgcaacctctgcctcccaggttcaagggttctcctgcctcagcctcctgagtagctgggatcacaggcacgtgccaccacgcctggctaatttttgtgtttttagtagagacagggtttcaccatgttggccaggccggtctcgaactcctgacctcaagtgatctgcccacctaggcctcccaaagtgctgggattacagttgtgagccactgtgcccggccagttttatttctgattagagcctgtagcagggcattggaagagagagaggtgaccaggcaaattcagcagttacagctcaaatgagacttagaactgcgaaatcaggaagaaacttggaagtcaccaccaggtggcagagggcccctgtctctttacaggctcctgcacctctgtgctttggagtttcaggtaacagtggacatttggggagaaatacctggttggcaacttcagggttccaggagaagagtccagagccccgagacaaagtaggggtgaatgaagaggcaggttggggcagaggatattttagaggatcttgacatctcaacaggaagtccatctccttctggccccagcctcatcaagaagggcccccagcaaaaacaagctctgtggtcatgggatggtggaagggggcaggggccaggaagggagatggatggatatgggagcagaaagcagggtcctgtctggccagggttggggaggagggcgattggctgtctctctttttctccagctctgagcatctccttctgctctgtgaaactcaggttctgccctgtgacattctcaaagtgattttctttgctcttctttcaccagagaccacctgggaacgtcccagcagttctcctgggattccagccagccctggctctcacaggagctctctgcctccaacaggtaatgtccgctgtctgctttggggcaactgggagggccctgatgccacattcagtggagaggctgagatgatgggtcctgggtcttaaacctggctgatgtagcaaacccagggaggggttgggcctgggagagggtcccttaggcctgctgccaagcaggttggtgtctccctggcagtgccagcagcagctctggtggcctcctgcacactcctcctcaggcgcttagtgggaggagatggctgggggaggtgaggtgtcagagctctttcctgtctgtcaggggcaggaagacctgaagtgtggacagaaccaccctatgtggctcttgtggacatcacggagtagaagctaaaaggaggtagatgtttacaaggcagctttcaaataaaacacctgaaacagtgtgagggagaccttttgagggtgtgagttccccatctgcaaaggtaatcaagcagaggcagttgagatggacgttcttttttgtttgtttgtttgtttctcttttgagacagggtctcattctgtcacccaggctggagtgcagtggtgcagtctcggctcactgcaacctccccttctgggttcaatggattcttgttccccagcctcccgagtagctgcgattgcaggtgcgcaccaccacacccggctaatttgtgtatttttagtagagacgggatttcgccatgttggccaggctggtcttgagctcctggtctcaagtgatccacctgttttggcctctcaaagtgctgggattaaaggtgtgagccaccgcgcctggctgaaatggacattcctataataggtgggaggtttgttcaggggcctcttgggagacatctaggtctgagattctggaaggcaggttatgggacccatcagcagggagaacaacatctcctttcatgtggctttttaaaaatgtcacctcctccaagaagccttccctgaccactcaattttgagccctcatgcagtcactttagatctcagccgcatgctattttaatgtccccatcatcctgttcctagttgaccttcactctcccatgctagactgtaagctccctgagggtggggactttgtctgtttcttttgtgatatcctcagtccgcagagcctggcttccgtgttgaactaattcaccaatgtctccaccatcctatggtgtgtggagcacacttgttggttttcgacttcaggagtcaatctggcagcaaagcatgaaagtcaaagttgtggttggggctgggaatttaatcttccaatgccttgagcgtgacatcctcagcttctgtggaagggaggtgagagcctgtgtaaagttttcagaagaaaaagtaatccctggtctaaatagtttacctgaagcagcacagggaaccacaggaaggaccaaaggtaatcacaggactctggaatactggatcggaagagggaggtgggacgcaaagcgagtggccagatcctcacctttcagagcagggagtctttggatattgtctagcattgagacctgaagacatgaaagtgcacattcaaagcatattgcttaggcatatgacagttgccagcagaagagctcaaaactggaaaagatgggaaaatattacctctagaaaatcagctgaggcgtgggagaggtgataggaaggtgggtgttttctatcaaaaattattttaggttttcaaaagcactttatttatatttatattattaaatttttaaaaaaataagaaaggaaccccctgtgtgggagggacatggggcagctgtgacggatttcctagggagacagtgagtgctgccatctcagaccaagtccccagaaatgggcccgttcgtactgtagctgccgtgtgacagcaggcagttctgagcccactggcttctctttcaatgttgttcttgtgtttttttttttttttaaaacaatcaaaatgccagtgcgaatgacgcaaggtgtgtcctttttcctggctggctccaggccagccagacactaaaaaggtaacccagctgtcttttccagccagagtggtcggtgaaggaggacaggacagggaggccggcagagggaggctcggatgtgtagagacagcacgtgtgactcgcagcctgccccgttggtgaggctggtcgagacttgccctttgagtcatggggtcacttctccaaagcctgctctcctgggaccctccacaggcagcatcttgtcctctctgctgttgatgggggctgtcctgcagaagggatgctcacaggagctgcctccggtccctggcttagaggcctgggtttaacaggctcccttctttaccctacaggtgcatcaagagcctctctctgtccagcgctgcactgtgtgctgggcccctaaagggggctgagaaaggtggggagatgggtggagaaggtcagatatagagatgagaattgcccgcatggccaaggctagactgagtgtgttgacaactcctgtccccctctgcccccatccccagggtgctggggtagtatttcctaaggtggaatccttgggatcccagatgtatccgtgctccatgaaggaggatgaagaaggacaggcacattagcattctgaagactgcaggaaggcctgaaatgaagaaacctatttaactcagttcgtttgtgctttgtttctttgtttgaaacataccacatatgtgttaagctttcctccctcttttgggtggttttgcctaccaggggacattcggcaatgtctggagatatttttgactgccagcaccggggggaggggctacaggcatttagtgggtagaggccagggctgctgctgaacatcccacaatgcacaggcaagtcttcacaacaaagaatcacctggccctaaatgtttactagtgccgaggtggggaagctcagttctagagtgacccagagcctcagttcagcgctgctcaagggttcccagaccatggcccattgaagcaagaagcagcagctccctacgtcagcatgaagagtcctgtgtcattgattctgagacatacattttcccctgacatattaatatcttggaagtcagatgcatcttacaatcaatagtatatactagtttattagagacatggtcttgctctgttactcaggctggaatacagtgtcatgatcatagctcactgcagcctcctcctccagggctcaagcagtcctcctgcctcagcctctcaagtagctggaactacaggcgtgtgccaccacaccccgctaattttcttattttattttcttcttcttattattatttttttctgtagaaacagtgttttgccatattgctcagactggttttgaactcctggtctcaagtgatcctcccaaaattacccaaattacagacatgagccactgctggcctcaatcactggcatcctagatttgtgaaattacaaatgttaaactggggccttgggcatgtttctccttgccaggcctcattttccccattcataaacttgagggcctggagagagataaaacgaggccctgcccatccatgcatgcttttggattattttgtttgtttgaggtggggtcttgctctgttgcccaggctggagtgcagtggtgtgatcatggctcactgcagccttgacctcctgggctcgagggattctctcacctcagcctcccgattaattgggactataggcacatgccaccttgcccagctaatttttaaagaatttttcatagagacaagatcccactatattgcccaggctggtttcaaactcagaatccagtgatcctccagcctcagcctcccaaagtgctggggttacaggcatgagccgccatgcccagccagctttacttttgtgttgtagctttgttaacttctagagagagtttgaagggccacccacagagctggttcattcttattagtgcaggtttgttggatactggtaagcagaggcagccaggttgccaactgggaagagagttctagaaacatgcctagagtcctcccccaaccccccccttccccacccccgcacaaactagactccagtctttgaatgttgggtgctacttaggatcagacctgggctggggactttgcctgcattccatcctttaatatcaccagagttatggaagctgtgtttattcagtagctttactagaggtgtttaatgccaggctttctgggtgagacccgcatgagtaagaaataaactttaaaccaaaacagaacacctaagacgccattcagtaactgctgcaaatattgaaagtcctctttgggctgggcttaacgtgcagtgtggaaatactgatttgtagagagaaatagtaacaggcaaagagaaagaaaatgagtgaaaagggagatgctgggagtttcatgtatgagtcattgggtagaatgaagacagtacagggcagtgttgtccagtagaaccctctgtgacagtataagcattctttctctgtgccttccaatatggtagccactagccatgtgtggctcttgagtacttgaatggggctggtatgtccaaggagctgaatttttcattaatttaataccttgttaaaatttggggaacaatttttaatttacagaaaagctataaagacagtaacttcctgtgccttctgtactcagttctcccggttgacatcttacataaccacggtacatttgtcaaaaccatgaaattgacatcgtgcattacgagtaactgaatgttagactttattcagatgtcatgagtttttccattcatgtcctttttctgttcttggatccagtcctggaaatcatattgcatttagattttatttaaatttgatttgtttaaattcaaataggcatctgtggcttttgtgtcaacagtgcaaatgtggaaagtgaatacctttctgagcctctgggcctgggatatgcattgaacttacgtgtttttcttaaggataaaagaaatctattattttttgaggttgtcctggtgggcggttgtgggagtgtttcaggaaacatgggttcaggatctggctttgctcagccttggggcttcagcccactgagggatcatccttaggcctccagtagcctcagggaacctagattaaaggggagagagtgaatgcctttgcagaggctgaagggcaaggaggaccttcctttgagcctgaggagccggccagggatatggttagggaggcagctgtgcttcctctgagcaggggctctctggggagggggctcctgaacccagagcctcaccctcgcccacaccttcttctccagatcaggaagcctgggacagctctcctctcccctgcaggagcaaaggaagaccctcgcttcttgcgaaattagccagtctcaggttcaaagcagcttccccagcactctgacttagacctcacccctgactccagggaaggccctgacaccttctgctggaagaagtgcatgttcccctagaaccagtgttcttgctggctgaggctcctgggaccttacaaaggcctgtttaacctctgatgtcctggaaagcagccacaggtgtttcactattcacaaccatgtgggaaaatcttttatcagtctgtctttgggaacgcagttcacatcttagacaactaggagagacagtgaggaccaggtggccagagagaaatttctggaacagaaaggtatttatgtaaaactgctcccctaaatgggccatggtggacagtggatcctcctgagaaggtgagcatggtgaccaaggaacctgcgaggccttccaggatgtggtgggaggaaggaggctgtaattgtgccctatgtcatcagaccggatgagcacggaactgccccacttcaaaccttgcattctgtggccatgactgtgtgtcccaaagtggatttcacggtagccctgctgtatttccctcaacgggttctgcgtctgtgtgcgcggaaggatgctgcatgctgttgccttgtttgagatttcaagcgcatgtcagcatattctaaaaggcctactgtaaataaactcaatctgaataatggggtgtttgtcctaaattctttggaccgtaacactgaccctttactatcactgcataacacttacaatacacatctggcagaattgctatcctgtttaacacacctggggaaacattaggctgtactatgtttaatatgtgatagatgaggaaggagaacgggtggaaggaaggaaaaaggggggggtgagaaagaaggagggaaggaggatgggtagaaggaagggaggaaggaaaaagaagcccgaagggaagggagggagggaagaagagaggggaagaggaaaagagggaagcgaggatttcaagaaccagggcttcagcactccggggttcctcaactttgttttttttggtttgttttggagacagtttcgcacttgttgcccaggctggagtgcaatgccaggatcttggctcactgcagcctccacctcccgggttcaagcaattctcctgccacagcctcccaagcagctgggattacaggcgtgcgccaccatccctggctaattttttgtattttagtagagatggggtttcaccatgttaggcaggctggtcacgagctcctgacctcaagtgatccgccctcctcagcctcccaaagtgctgggatttcaggcgtgagccaccgctcccagtcaccaggtttcctaactttgaggagtgaaattactatgtttattccagagagaggagaaattaggccagacctacaggaggtataataagagagtgttcatggctgattttcttatgttcttttgggttcctcagggaacaggaacctggagagtagggctctgaggatgcgactttttccctcagggatcggtactgagatatggaagccgagctgtgggtgggggtgagccctgggtggcggagctgctggcgcttctttgttgcttggcctttctcgataacttttcatattcgcctttcttttctgtttctgttgacttctccctacccagacctccctcctcttttctacccaaatatctgtcccctcctctcattagacacctcctaagccctctcaagttgcttaactgcctataagggaaatgaagtgtgtgggtgcctgtgtgtattatttatatttgaagctgctaaggttactaactagatagagcttttagttccctttttaaaaatcttaaaaacagatgagtgtgacatttgctttttttttttccttgtatctccagactgaattatgttccctttatgagcgatccttgaccaatttcatttttcttcccccagaggctggaggccccagaagcacccacttctcgcctcatttgttttgtggctgaccctgggtgagccgggagcccccaggacagggaatagcaatgaggaatgccgtgggtgagggttgccaggatcttgtgggctataactgtctagatctccactgagacgtattctgaatgtgcccgggagacttcaagtgataacgcagccagacagggtgtccgaggagagctgctacgtggggagaaagggtcgaatggaaaactgtgttttctttcctcgtaattgttttgacatgagcagtaattagccatcagctgacagaccagaactgaagtgggaacaagggattggattaggggcaaaatgtctcctctttagacagttcctggcggctgcaagtgtggggaaagactggggcagaggagaggcaggacctgggcatgcatttggagggtctggggagggagggagtcagggtctcctcaggagctgggacaaccttggttcatggggactcagcattatcaaagatagagatttattacctactcagataaaaacttgtgcatttcattttcgaaagcagactaaacatggttcccttgtgtattgtttgattttaagaccagggtcatgttgactttgtaaaatagacctggaagcctgccacatgtttctatgcatggatgtgtctttctggagtgtgtgaatgaatttgcccatcaaaccatctgggtgcagtgccttttgcggggaggtcatttttcaaaggtttcacttctttttggcatctcttgaaacccttttgataatttgaatctcatggaaggtttggtgttgaagatacagaattataagtcatatgttcttgcatttaaaaagtttctactataagtacagcacggtggctcatgccggtaatcccagcactttgggaggctgaggctggcggatcacttgaggtcaggagtttgagaccagcctggtcaacatagtgaaaccccgtctccactaaaaatacacaaattagctgggcatggtggcgggcgcctgtaatcccagctactcgggaggctgaggcaggagaatcacttgaacccgggaggcggaggtcgcagtgagccgagatcgcccactgcactccagcctgggtgatgaagcaagactccgtctcaaaaaaaaaaaaaaaagtttctactatatttgttgtgccattgttttctttctaatccctaattctgagcatttgtgttctctttccctctcaaattaccctggcttatctgctgtttttattgttgtgatgcacacacacagaaccagccatggtttgctaatggtctcccgtttcctgactcgttaatttctgttaccacttttctattccgttctcctgttttcttttggcgtatgttattggcctttaaaattttttccccagatcttaagttgaatgtttagtccatttatttttgttcctttgggtttggtaatgaaataattaaggctgtggattttcctccaggtatacttcagactttatcccatttgttttgatatattcttctttattattttctaaatattgtgtaattacagttttaaattcctttttgatctggcattatttaagagggcagtttcttacatttctaagtgtttaggagttggggggatggggatcttgtatatttattctttcattattaatatctacttttattgctttcctggtcaaagaatgtggcctgtgttttttataccttttgccatttattgatagtttatttgtggcttaaatgtgaccaagtttttacatgttccagggcttcctggcagaagatgttatctttgtttgtaggatatgatgtttactacatctatttcaatcagccttttaaattaaattattcgggtcttctttatcctccttgtttttgtctgttaatcagtcctaaactgaaagcagtgtcctgaggttttcttctgttgtctttaggtttttcagcatctgtgttttattcagatagttctatgctatttgataaaatttctccactctcatgccctcgttgtagggtgtatttatcatcaggctcatgtctttcctggcatagcttgatgccagtcagagtggattctccttggccccctcagcattttccctgatgctgttggaatcctgtccttgcctcttaagctgccttcatagcgggtggatggtatctgcacttggccagctgcctgagggatgtgggtgtggcccaggcttgtagctggccctgcagggtggatttgttgtttcttgttgcttccctcaagcttctactgtactaggggcctgctgtggatcagcttgctatttccttgggatgtgtgcaaccaccttattctggaacggggggtaaaccctgtagctgggggagaagcccagctgcgcacaggcactcagctgcatgtggccctgcttggccctggagtgttcactgcaagtggtggagaacggggcaccacctgagcaggagacgggttctccgtggaacgggcttcatcatcccattgcccaacgcttgcctccagtcctcgtcgctccaaatgagtaggtgttggtggtaactttcagccatattctcctgtgcttcctgccacgctatagagttttctctagaagaatcatgagttggacatcagtgtgtagatcttcctccagtctgacctgcattgtatatatttattggcaattacttgaagcctgggtcacgggatggcgcatcgtcctggtctcctgagatcacgcaggcttgtggttcctggggactcaattcaggaacaaaagcaaagaccttccccttctggatgcctctgctcccccacttttttgatacagggtgtcacactctgaagtgtgggctggagtgtagtggtacaatcacagttcactgcagcctccacctgccaggctcaagctatcctcccacctcagcctcccgagttactggaactacagacatgagccaccacacccagctaatttaaaaatatatatattttgtagagatgaggtctcacggtgttgtccgggctgatcttaaactcctaggctcaagcagtcctccctctgcctcccaaagtgctgggataacaggcatgagccactgccccctggccattcctccctttttaattttttttaaattttttctatttttaaaaatagagatggggtctcactatgttgcccaggctggtctggaactcctggactcaagcgatcctcccacctccacctcacgaagtactgggattataggcgtgagctaccgcaccctgcctttcatccttcccttttttaaatgaagtgctttatgactacttataacttttgctattatcgctttgttggattctcacaccaacaaagtaggtcaggagaatacgtagaattatccccattttacaggtacagaagctgagggtcactgaggcgaagctgctcgtctaagcttatgtagttatatttctacaagagcggtaccacctgggaaccgagatcacgtgggtcccagtgtgaattcgtgatgtcaggagcgtgcgtgtagcggcgttggggcttgaaaccgtccatgctgggagtgtctttggcacagaaatcgacagatactacatatcagggctccccctgttccttggagagcaggtttatcagcaagtgttgggagcatgagtgagtgtcccccaagagacataaagttataagggtagaattttagagcctcagataatgtgttttttttgttttgttttgttttgttttttgatggagttttgctcttgttgcccaggctggagtgcagtggtgcaatctcagctcactgcaacctctgcctcctgggttcaagcgatcctcctgcctcagcctcccgagtagctgggattacaggtgcctgccaccacgcctggctaatttttttgtatttttagtagagacagggtttcaccatgttggctaggctggtctcaaactcctgacctcacatgatccgcccacctcggcctcacaaagttctgggattacagacatgagccccagctccaagccagattatgtatttttaattctaggagaacggtgactcaagaatgaagtgcatatgatcacctgactattaattgacagagcctaatttcacggtgaccagtcaatccagtcctctttctagtatattcacactccgctgctctgagtttgagggtggagaagttactaagaaagctgagggaaattgttggaaggtggtggagagccccccgccccgactctacggagggagattggacccgtgactggcatttgtaactacaactgatgtggtatttgtagcaaaggcagctggaccatagtgacctcccctcctgttaggcacattccttttgctctcgggttaaaaaagaaactcagtcccctaagaattcagtaatttgggtgctgaggattagagagatgccttcaacccatttccagctctgcagatacagataagatcagatcctgagggatggtcttcgccacgcaagacctctcagagccaaggaaggaggtgggaaaaggggctgcagtggacgaaaggcgggggtgcccatctgtggcccacacagcatctgagccgtgtctctgtccctgcagtgaatggataccacgcatcagggaccccagcgcaccctccagagactgcccacatgagtgtccgaaaatccaccggtgattcccaggtaaggggtcctgttgagggaggtatagcggtcactgcttctgcaggcctaggaaactgcattacaaagtccatcatgggagtccaggtggctgcagcccagttctgcccccaggtagaaagtggttgctgtgtctgggttgtttcagtgttccctgatggggagagggttggatgattgtggtctgttggttttctagaagtcgagggtggtttggaggaggggttgacggtgatggggttgaaaccattaggacagagagttccattctctggtctggattcctgatacctgaagcctgtgtttctcaccactttaagagtatggatgtgccagacaattttccttttctctaccctacccctcccacggacagattacccagaatggaatttagtaaaatttgatcatctcatttgataaagtagcatagagagagctatgagatggaaggaaatgggagtatgttgtacgatttccaaactgttttctcagtctccatcctacttgatgtttatgcaaacatgtgagttaggcgtcagtaacaactcaaggtatgcatgaggtcaccgaggctccaactggttttgtgacctgtgcaggctcacaggattactcagtggttagactggaccttgatgtcagtgcttacggcttttctagttgcgtgaagctgtgcctaaaaaactgaggactagccttatttagtctacccataaattatcaagaagatgttcttaatgaagcttccaaactccagcagccttttccaggaattaaaatgccagaatcctggaggtgataatgaaaatgatgacaataatgatcattgatgatgatcatgatgataatattgatgatgttgatgatgacagtagctgcgtgtgcagtggattctatgtaccagtcactggaagaaggaaatctatacttaacataaggaaaaaatgactggaagaaaaataaaccggaggattgattatggttctgtctgcatctgagaccgtggttcttaatcaagggacatttggcaacatctggagacccattggctgttagtataatcagctgaaatgtgacactcagctttatcatggacaagagtgttaatttgggggaacgttattaagtcgttctgttaggatgctgagtgttgggcttcgattcagttcagttaactctggaaaagaatttgaacctcagtgtatgtcaggacttcttatgttttgatggacttagagtgagctgggcctcttgttaaaatgcagattctaatccaggagatctagggtgggggctgaggttctgggtttccagccagctccgaggtgacgctgatgctgtaggtctgaggaccactcctgagcagtggactagcagtcagtagcacacagctggcctatcggtctccttctctcctctgctcatgtcacccatcatgaatcaaccgtggctttgtatgtttcctgctgagctcccagcttgccttctcaacacagattctgttatcctgtttgaagtgaaacttacttttgtctcctgatttgagactgttttggaagacatcagcctaaattctgatgtggttcagcaacgatgacagaaatctggtgttaccctgggcatcatcaggaagaatatgagaaacagctccccatcctcaaaatcattctttcttccctgataaaacataatcccttctgaaatactgtgaagttgttactcatctattttaaagaatggacactggtataactgatatctcagaagctgatttaacactgtgcattataagccatcgacacagggatgtcttgtctagtgtctgttcttggggtatcttgaggggttctgatttatgtgcaaggctattcactcacacattatttacagcaccataacactagacccagcctaactgtcctgcaacaggggatgggtaaaagggatgatggcgctggaggttagccagtgatactatgcagccattagcaagcatgcttctgaagaaaatgcaataatttgggaaagtactcacaacataaaatagagtaaaaaaaaagtaggacacacattgcatatatagtcagtcttatttggcagaaggaaatctatacttatctatacttaggaagaaggactagaaggaaaactggaaaacgtacggtggctctgtctgcgtctgagatcatggctatcaattgggacttttgacaatgtctggagacgtttggattgtcacgcctggggagggggggtgctactggcaactagtaggtgacaccagggatgacgctgagtatctcgcaaggcatgggacaccacagcaaagaagtgctcaacttgaaaacatgaatcgtgctgaagttgagaacctttggtctaagatcatgggtcattttattttctttacacttgttgttatttttcaaatttcctaaaatgaacacattttacttttatagaaggcagatacaattttttacttaaaaaaaaaaaaaaaagctacaaagtaggtaccagtatggggaattcaggagaggcgagctctggagatgcaggcccgggtagatagtggctgcctaaagacaggcggattgagtcagactctttttggatggtaaccttgggagctgaggtgtcatcagggtaacaaaaataaatcatgtagtatatggagagggcgaacgtgcgttgttcaccagtcccaggatcaggaggtagaatgttattcttttaggctttgaaagggtaacatttgtatataaaagctactacttttttaagttaaaaataattaggaaacagggtgtccctgtgttgcccttgctggaatgcactggctgttcatggaggtgatcgtagatcactgtgacctcagcttggaactgctgggctcaaacaatcctcccgcctcagcctctggagtagctgggactgcaggcgccggccaccacgcccagctagctactactttttgtcctggtttgtgagcctgcaggctggttatccaaaaaggtgccaagagttaaacatacaaataggttaagaaggtttggtgtttacagagagctctaccaacaaagggtccccaggtatagaccccactccagcatgcagacgagtagattcaccatccctgctgtcagttatcactcatgataactacacttaaacatcaataaatgaataaatgagcaaaggaacacttgagatgcggcatgtggggtggataaagtggcatgttcagggttacagtgacgaaacctagactggaaagccccagatctcaaaacccggttgtgatctctttccgccccctgcttagctgcccctccttgagcaagctgatcaggaagattagaattttggggggagggggcggtcgtggtggctcaagcctgtaatcccagcactttgggaggccgaggcaggcagatcaggaggtcaggagatcgagaccatcctggctaacactgtgagaccctgtctctactaaaaatacaaaaaattagccgggcgtggtggcgggcacctgtagtcccagctactcgggaggctgaggcaggagaatggcatgaaccagggaggcggagcttgcagtgagccgagattgcaccactgcactccagcctgggcgacagagcgagactccatctccaaaaaaaaaaaaaaaaaagaattttggggggtgggtgtcgggggatggggaaagggactttccacggacaccagtaacgtgtccccaccatactatgtcatggggaggactgatagtgggtgccccacagttcctgagggtgcctgccccgctccttcactcagcccttggagacctggatgggtgggcacaggaggtggtgatctggtgccacccagtggagggtttcaattctgcagccctggggcagtcggcccaggtactgggtaaatgcagcccacctgattcgggggcagaggcgagggatcaaaggcgaatcatctttttttattttttattttactttaagttctgggatacatgtggagaacgtgcaggtttgttacataggtacacatgtgccatggtggtttgttgcacctatcaacctgtcatctagattttaagccctgcgtgcagtaggtatttgtcctaatgctctccctcctcttatcccccacgccccgataggtcctggtgtgtgatgttcccccaccggtgtccatatggtcccattgttcatctcccacttatgagtgagaacatgcggtgtttagttttctgttcctgtgtttgctgagaatgatggcctccagcttcatccatgtccctacaaaggacatgaactcattcttttttatggctgcatactattccattatgtatatatgccacattttctttagtctatcattgatgggcatttgggttggttccaagtctttgctgttgtaaatagtgtagcaataaacacgtgtgcatgtgtctttatagtagaatgacttatattcctttgggtatactcagtaataggattgctgggtcaaatggtatttccggttctagatcaaaggctaatagtcttgctgcctttgcagaatcgcgtcctagtgggtcccttcccttcctgcccaccagtgcctgggcctttttgtgatccacctttcaattgttctggcttctcacgaacttcccaggaagaccctctagacacaggagagaggaaagagaatgggacgaagggcttggaaacttgagggacccattggagcatggagttcaaagtggagaaagaggtgagatgtttaatctccaccacctcctacctacctcaataattcaataacacatgttcttattgagcaatttcggtctttgtcaggcactgagacacaggtgatatctatagccctgcgttgatggagttttatggctggtgtgggagaaacagtagataaataatggtgcaatttcagcagtgacaaaggctggaggaagtggatgctgtgagaacctagcctggtgctggaaatgtcaggaattaaggtaccttaagaaaagatacctattctaagactggaatgatgagcaagggtttcacttggcaaagaggtggggaaagaatagctttccaggggagggaatagcatcgtggatgcctggaggcagcaagggggaaccgtgtttacgcatagagacccagtgtggctgtggcttactaaatcagcaggaatagggagggtgggaaatgaggctggggtagtctgcgcaggcctgccacgaggagctcaggggttatcctaactgcactgggaagccattgaggggttttgtacaggatcccacctgctgaagggatgggacccagattatttgcagggggggaggaaatgggctgagaagacatttggagtcgggggcctgctgaatcacttgtgaatgacccactccagtttaccaagcacttcctgtgtggtatcaccccctgccaggcctcagggtgatgcagagatgcccaggtggggtgtcctgacccctgggcaggcctttacaaaataaatggaagggaagagttctctggaatcacaggcaaaggaaatttaaaacaaatactcttattataggcatttgcaaacctttgcaaaagtagagggaatatataataaggtaccacaaatctgttaagcccaacgattacctgcctttgtccaatcttgttttatttgtgctcccatcccctcccccaatccccttgccctccaccccctagattattttaaaccacatttctgacttactgttttaaatgcaaatatttcagaatgtatcttccaggaagaagacataatgataataccattatcatatttaagaaaacattaattcaataatgccgcctaatatatacactccagattcctcaattgtctcaaaaaatgcctttttttaagaaagaaaaaagagagagatggggtcttgttctgtacctcaggctacagtacagtgacaccattatagctcgtgaattctagaactcctgggctcaagcgatccttccacctcaacctctcaaagcctagggttacaggtgtgcgccaccatacctggcccccaaatcccttttatggctgcttttctccccagtccaggatcccttcaggttcacacacagatacactggttgctgtgtctctgttgtttctctctctctctctcttcccccaccaaaaaactgctttattgagctgtaattcacatacccatacaattcacccatttaaagtgtatacaattcagtgttttttactatatttacaaagttttacaaccatcatcaaatctattttagaacattttcatcaacccaagcagaatcacctgaagacttaggcagcccctaatctttctgtctctatgggtttgcctcttctggacatttcatataaatggtatcatactatctgtggtcttttgtgtctggcctctttcacctggaattccaaggttcattcacatcgcggcatggatgaacactccattcctttttatgacagaagaatattctgtcgtatggatagaacgtttcatccaagttgttgcctgtctcgttgcctctacactcaatcccttacacctttttttcttttttttttttttcatcaccttgacgatttatttttgaggagtccaggtcaggtgtcttatagaataacctgcgttcttggtctgactgttctcttatgcgtaggttcaggttctggagtttgggcaagaatagctggacagggcatgtggggttctttttactgcatttgggggcacaaccacccaggttggcaccctactcatgaggctcagtttgcactctcggttaaggtgctgactgccagatttctcctttgcaggggtacattttccctttctaatttgtcagtcatctgtgaggtgccagtgtaagaccctgtgagtatcctgtgccctggcagtctttccatcccctgctttcagcatccttgaggatcatggcctgagtcccctttgaggctggggtttgcaaatggtggtcatccaatttcttgtacattttttattggcattcttctgaaataaatgttctctcccttcccctttggagttagttagttagttgcagtcattcattcatatttgtgctcaaattgtcgcagatttggcctgtggtagccctttaagttgtttatgttcttttgttatctctccattattctctgaatactttcttacctcttggtacaataggatattccaaatacctgcctttgaaattagtaccaaggagcttccggtaatatttggaaaccaatttctagccagtagatgttgtcactgtgatgagatgtcattccttctgggccctttcaatggagaattatgatagtgtgtgtgtcacgtgtgtgtgtgtgtgtgtgtgtgtgtgtataaaatgcacgtgatatgtatatgaagttggagcagtaggcacaggttatcagcagcacaggcagagcctgagattgcctgtgatctaccttggccctcagtggttgaagtaaaacactgctaatagaacagagaccagggaaggtgctgacacctaacacgtggaacacccaacctcaatgccattacttgtattcctatcctagccaagttataaggaggaggtgcgacctctgcgtcaagccttattctacagagatttatacacagtggtcccaaaatatatgtttgtggttgatggaaatcttttttgccttcctgcaaagacacatggaaaacaaaatattgtctcaggtctcaaagtggagagatggcggaagatagaggaaagagttatgcaggcttggattctaatttccactcctctgtttactatagccttgtgaccctggacagttttacttctgcaagccccaatttcatgatctgcaaaatggagttgatgccatttaacttgctggggttgtaaggatgaaatgagattaaatatgtcagatggctaacctggagcctgccgtaataagcaagcactcagtagacagtcgctcttgcactgcttctccccttagccccctcatcaccaacatcatcagcatccataggcagactcgaaggctgttgccaaggctgctggagtgctggttcccctctctggggggctgcagtgggaacgcggtggtgatggtggtaatgtgtccatgacaggaagacagactcctgcagactgcagaatccatcccataggctactctttccccttcctgccatgtatttgcttggctagagtctgtacgtgaatgaacctatggagagagagacttctatccctgtctcttctccttggtgactggtacctcctgccatgtagcctccgtctgcctttctccctgtgcagttttgtcaagtgggaaggtatagggtgggccagctggatgagatgatgcactaaaaatgtctatggaagctgtagttggccataaagttgacgttggccaggagcccgttggggtcactagaggagttgccataagtagaggtacctcagtgaaaccacagtgtagatcagatccatgtatctctgagtgaggtccacagattctgcaaatcagaggtgctggcaccacctgggacctgctggatcaggcccagcagctgagagtgcagctgggactctattttggacactttttcctcagttgattctgatgcacctcaaagcttgaggaccagtgataaccatccatttgacagatggagaaattgaggctcaaagaagtcagattctctggccagggtctcaaggctagtaatcattttcttgtctgtgaaattaatgctctgtaaggttcatttttgctagacaccttaaggatatcagttttcctgagttgactttaattagcaacccaagtaagactgtatgggagtaagggtatgcgaccttagcaggggcatagtcaagctccctggtttgcctaatttgctgacgggtttctgaggcaaaggctcgccctcacctgcagatggtcatttggccaggtgtccagggtcgtgctggcctgaggggcggggtgccccccactccaagccggtggttccttcttgttgaagcccctccatcctttttctggcctttatctataaagtgacagccacttccttacattctaccaaggaagagtaaggccagactggccgcagtggctcatgcctataatcccagcactttgggaggccgagacaggtggatcgcctgaggtcaaaagttcgagaccagcctggccaacatggtgaaaccctgtctctactaaaaatacaaaaattagctgggcgtgctggcgggcacctgtaatcccagctactcaggaggctgaggcaggagaattgcttgaacctgggaggcagaggttgctgtgagccatgatcacgccactgcactccaacctgggtgacagaatgacactccatcttaaaaaaaaaaaaaaagaataaggtcatgcacaagtcctggggcacaagtgtgatggccacctgcggtgccttaggggtaagcctgcttcccaggttgctgtgtggctcaggataggagacatcccaggtcctgcttggggatctctggtattgagcccccaacataattgctaatagaacaacagagacccagaatcaaacattctttggagtcgtaggctcttaggacacgtgtagcattttgcactggcagtccttaattttctctgccagaacgatcccaggactttggcaaactgctgaggaccccaggctcagaggtacttgggactctggttttcttactggcggtggaagacatcaaaaggcaatataaagactgagtggaagctggaagtcggtttggctgagaaatccctcctggctcacggggttgggggagcggggagtcagggaggtgaccgagcagcgccccagtgcacattgtgtgtatttaggtttgacgttttggacccggggggtttcagaataaaatgtcgtgtgctgattcctcagtgccaggaggtggtggccttaactctcttctccccagtggattccgcggcttcaggcagcaagcggcacgcggaacgttcaccagcagagggcagcggaggggttaactccccaaatcacagactgagagaagaggaggggagacctggtttggagcagttctctcagagcctgtgcaggaggcttccttaattcgccttcagcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacagtaagtggctcccgaggggcgccctcagggtgggctgcgagctggggcatttggctgggctgttgccatggcgatgtggaccgccaagcagaagtgatgcccaacctggaaacggggaagttccaaagctcggatttcactcaagttccccatccacatgcccctcccacctccccttctcctgtcaatttcacatttcacttctctcctggtgaacaagtggaaggaggatggctgggatgatgcagaagccgttttttcagggcaggaggggaaggtatgcgtgcgggagtgggttgaagggggtggactgtgctcagcgcaagtgatgtgacgtgtaaattacagccacggcagggttgcttttgtgcggggtaacttctggaagatgtcaaagtaaaaagcaagagaaagcgtcctaagaatagagttcctaggagtccctgaggggagcaggcagcttctgcctagagtggccagcctgcctcccagggcgcttcgagatgcccaaccccatgtggagatgagggggagcccaccccacccacccccatgcagagatgaaggggagccccacactccacctctgctcctcagccctgtgtttggggcagctggggctggacatcattgccccctgaggggcacaggcctgagaagtgtggtcgcaggtttgctattttggcacaagggcaggagagcagggaacggggtattgctctcttaggctccaactcacacagctctgagccattccgaccacccctgtggagacaaaaccaagagtgggtgcatttccctgcttcgtccaggctgcacatcctgctttgggagaaaaagtgtaggtaaacaattaacaataacaattgctgcaacttttgtgtgcacttattatgcacatgtagtgatccaagtggctcatttaattgtccattagctatatgaagtgtcagtcgtggaatcaatatagtataacgatgatgaacgtggactctgaggccagagtgtcggttatattaatgacagtgcaacagcctggggcaagtttcttgacttcttcccgtctcagtcaataactgtcaagtggggaaatggggggtagtgggtggtctctgccttagggatggtgtagggactaaatgggtccatccatggaaagcacttagaacagagcctgcatatagtaagtgctctgtgcacactcatcaccctgtttacagatgaggaaactgaggcacagagccgcaccttgctcacggtcacccagctgggaagtatcaggatttgaaatctatgtccttaccacagtgccccttctggagctggcttgggttccttgtgtcatgagctcctttggagtgccctgtgctgatggacggtgtctccaagggctgggcagaacgactcagcctgcttggactgtggggtagcagcagcctccctgttaccggtggagttgatggagctggtgggtagggggtgtgggcaggctcaggtgcagagttccagagggtacagtccccatcttcaaattgtcacaaaatgccccagaatgctggggcacagcaggagctctccagagtcttctgaaatacataaaaaggagggggaggagaaagggggggaggtcggagtgggagacatatttgaattctagaagaaaaacaaaaatgcaaagtgaaaagcagagtgttatgtcgtggagggttgccttaaaggcgcttagtgatggtgcccaggccacagggtggggcacctgctggagtccatcttacagccagggcttcgggtgtggccggagggggctgatggcggcccttgttgggcccctgatgggcagcacacctcgcccatccctgccttccctgtcgcttcctgctgagccatatcattgcttctcatgagggagtctgcaaattgtattctcaagcctccaagaccttttttaaaatgcagattcctggatggcaccccagaccttcagttgttttctctggggccagactggaaaatctgcatttgagccagtgttccccagaggttttaagtaaacactcatgccttggagaatttttttgccagagaaactgagcaaaggagcgactggccagaggtcacaaaacaagtgaggagcagagcccaggacttgaacccaggtctcctggctgctggcccaggacacttcccggtgtaccacctggccttggcccacaggtctccaggccttggtgccttttcccttccacacaacaccgctctcccatgcccagcctcttcctctgggttctgatcctccagagttcatggtttcccaagaaggagatgctcagggcgaaagggatggctcaggtctcaggaggctggggcgtgaacttccttttctgtggtgtgtagggatgaggtgagccgcttcccgtgctgtctgatcccgcagagcagaaatttccaggcctgggcagcaaagggtggtggatccagagaaagaatggagctggattctgacgctcctttttccccaggctatgggttttcaggggacagacacatgggccccctgacagcaacgggcaggggctggcagccttgctgggtcttgtttccgctgtccctggtgtggggctggcaggtggagtgtgctgtttgattgggagtgacgggtgctcatggcagctcacagcccttggcaggagcatgaacgcgtctgaatctagagggtttcagaaaagatgacagcaaagccacccggccacactctcacctggaaagaggaatttggggacacctgtggtcctcagcttcagggcttcccagcgtagccacagaacccggggtaggggctggaggtgaacccttggggtcctgtctactcttcttctctgttccacagagctccggggctggcttgttcctctcccataccctcccagatcagctttcctctgggagaaaattcagagcctgttggacttgaaccctcagttgtcaaaccattttcccttctctgctgcaggcaaggtggtcaaacaggccgtgcaagaagcctgtggcctctgttccccacaggctcctgctgggccaggacttaggggaggggcatgccttggggcctccgtatgtcagcccccttggtcacacgtgtgttcagtggctctcacacctcagccaggtggttttctggctgctgtgtcccactgcgtacccctcagagagcttctgggaggcagcccatgtgcttctggctgctcctgtgcggaaaagccctgcaggaaccccagctgcacagtggaccccagcagctggggagcgatgggggtgtcactccatttacctgagggttggagaaaacagagttggtgcaagagcgaagacgcggctttgttgaggacactggtctcgggggaagtgagggtgggactgcctgctggaacttgccctgagcagtacacacggggaggcgtgcccctctctggctccctcttgagcacccttcctttttgagcccctgcctttggtggggacctggcacatttatacctcagtgtgttggaaaggtagtgtgacagaggctaagagcctagactgaagccggcttgcgtgggttcagagcctgggtccacctattccatgcacaaactgtgtgatcttgcataagtgacttagcctctctgtgcctcagtttccttatctgtaaaatggggataataatagcacctgccttgcagggctgttgtgaggattcaatgagctaatacgtgtaaaacgctgagaactgtggctggcacattatttgcttttgttgaacaaacagaaagtggatctttaggatggcagtgaagctcctgctatgcctgggaggccttgggaggaggatgaggtctttccagaggtgtagctggaccctggtattaaccatcaggaaaatgtaaccggggggaggacaggaatccacatgcggaaagtcctgtcccaccttctcttccctccttgggctttggagcaccgcagggtggagctgtgtggccctctcagcccttctgatccagggacctaggagccttgactttgaggtctggatgtcacagaaggacacagcaaggataaaagtggtggcccaggaattaggaagctggttctggaccctgctctgccacttatagtgaactagaattaaacattctgtgtctcagtttcctcatctgtgcatgaggttgcactagaccattgcaaataaacatcgaggctccagttgcttccaggacatctgcgcgcacacacctctcaccatgcccctctgctgccactgcctccctctctccgaagggactgttcttccatcttccatcccaatggatggaaacatgcttcctctccacccaggtcagtcaactcagggtttctcagcctcagcaccattgatcttttgggttggatagcactttgttgtggggagctgtcccgtgcattgtagatatgtatcaccttccctggcccctaccaaccagaggctaatagcatccaccctcgaccccacacagctgtgacaaccaaaaatgtctccacgttgctagatgtttctggggtgggggaaaaattgtccctggatgggcatcactgaattgacttcatggtgctgtcaagggctacctgtagagtatcccaggcttcttctaatcccctcttgactatgctgctcccagctgctatcatgaccccccaccccccaccccccatcccccatcactgcagactgccctgatggccacagtcacgttctccctccagtgcatcctctatgctgtagtgggggtgctcaccccagacaacagcctgattaattgttactctcctgcagggtgcttctgtggcccccgctgtcctgctgccttcaggacagaccttggcacccctgcaagaccccctctcagctcagtcttgtctactccctgactcaggagcagccagaagcacaagggctgcctcccagaagctctctgaggggtacgcagtgggacacagctcagccaaaccgagcaacgcggtccccacctgtagggcatatcctctcatcctgagtcctttcccttcctgcagtacccttctcaccttcccacccctctgtctgcctgggccctactattattacctaaatctaagattcctcccctggaccctcagtccttccagtaacctcagcacctcaggcttactccactggcaggtttatcccaaagaattacagtgacttatttacggaactgttgagagcagagatgatgccttacattcctagcctccggccactgcaccaagaaacatctcctgagcacccactatgtacccaacactgcaccagtcaggagggaaatggcagggaaaagatggtccccatccccttgtagaacaggctgtctggcaaggaggagaaacattaaataaaccatcacgagaaatatcattacaaatgtatgcatgcagcttgctgggaagagctagcgtagcacgtggcactgagcagcctttcaacagatgttcgaatggaaagtgaacgagcaaatagcccatcacatagcttcgtggtcgaggctggagctctgcagtcagctggatctggattcggatacctcgcttctgtgatcctcagtttcctcatatacgatgaggctgttcttcctcccctgtggagttgctgggaagatgaaatgagaatacatgcaaagccctaaagagggtgcctgagtcagggctcccctgcaggagtgaggatttggagaaatcccagtgggcttcctgggagggagaaatcccaaaatgagagaggacagagacagtggcaggcacctcggggctccatctgaggactggtatcctcaaggagtggcagaagcagcagggtgatgagtccttaatgagtcctcacattctactgcctttactcttctgccccaacctgttttctgttcctgcattcgtttgctaaggataatggcttccagctccatccatgtccctgcaaaggacatgatcttattctttgttacagctgcatagtatttcatgttgtatatgtaccacgtttcctttatctagtatatcgttgatgggcatttaagttgattccatgtttttgctattgtgaatagtgctgcaatgaacatatgcgtccatgtgtctttatgtggaaagatttatattcctttgggtatatacccagtaatgggattgctgggtcgaatgatagttctgtttttagttctttgaggaatcaccacattgctttccacatggttgaactaatttatgctccctccaactgtgtataagtgttcccttttctctgcaaccttgccagcacctgttattttttgacctttttaattatagccattctgattggcatgccatgatatctcattgtggttttgatttgcctttctttaatgattagcggtgatgagcatttttgcatatgcttgttggctgcacatatgtcttcttttgaaaagtgtctgggccgggcgcggtgactcacgcctgtaatcccaacactttgggaggccaaggtgggtggatcacctgaaggtcaggagttcgagaccagcctgaccaacatggtgaaaccctgtctctactaaaaatacaaaaattagccgggcatggtggcaggcacctgtaatcccagctactcgcgaggctgaagcaggagaatcgcttgaacccgggaggtggaggttgcagtgagctgagatcatgccattgcactccaaccttggtgacaagagcaaaactttatctcaaaaaaaaaaagaaaaagtgtctgttcatgtcctttgcccacttgccatgtaggatcttaagagcagggctctgtggcttgtttatctgtgtgtcttccattgtggtgggcacaaggtctcccccaggggctgtccctgtccctgctaaatggatcacgaatgctggttctcaaagtgtggtccctggaccttcagcatcacttgagagctcagaccccatccagagctcctgaatcagacagtggggggtgggacccagcaacccatgtcctctaggtgactctgaggcatgttcatcctcgactctgggacaagaaggggactgagtggtacttaggtgggtctcagtcctcctcaggacttccatggccttttaggtggttggcttggagccagccaggatgcatcattgaaggggctgtccttggtaccgtctcctcttccggctagcagtctgtctgcacaggcctgctggggtgcacggtggcatcctcactctgagggtaagtcaactcaggaagattctggggggaacaagactggccaagacccatttctcctcctgcctgccccacgttttggccaagcctcttcctgacatgggaaagtcctttcttcttgttttttttttttttttttttttttttgagacagagttttgctcttgttgcccaggctggaatgatgcaatggcgcaatcttggctcaccgcaaccgccacctcccaggttcaagcgattctcctgcctcagccttcccaagtagctgggattataggcatgcgccaccaagcctggctaattttgtatttttagtagagatggggtttctccatgtgggtcaggctggtctccaactcccgacctcaggtgatccacccatctcggcctcccaaagtgctgggattacaggcatgagccaccgcacctggccaggaaagtcctttctttgtagggaagtgtttccccgacaagagggcaaggccaagagcagtttgagtgaggaaagacgatggaaaggggagagatgcccgcagggcaggccactccagaagcattcagacccgcctctgagtacccacaactctactcgttccatcattcttaatgctcaatttactttaatgtcatagttaatttatcattaaatttgattgaaattttcatggactgcattattcagtaacataaagatggactgtgatgactgtgatttgttgaaataagaataattggaatacaaaataaggaatctgtgcacttttgaaacccgtcccttgttttcatgattgcctgcttggcagtgggttgtggaggcacaggaaggaaggagacttgtctctggacacaccttggggactcggcccgaaaccaaggcttggggctttctgctgctggcctcaagaactggccctcccttctctcactgaggctgctgaggcctgggagaaaactccccagcctcagctgatcttcatctagcctttgtttttttaatccatcacagtgctaattttttagagttcaggaagctgtgcaccttttttttttttgagacacagtctcgccctgtcacccaggctggagtgcaatggcgcgatctcggctcactgcaacctccacctcccgggttcaaacaattctcctgcctcagcctctcgagtagctgggattacaggcgcccaccaccatgcccggctaatttttgtattttcagtagagacagggtttcactatgttggccaggctggtctccaacttctgaccttgtgatccgcacacctgggcctcccagattgctaggattacaggcgtgagccaccacacgctgccacaaggtgccttttaaaaaactatcttgattttccccacttatcattagattcagattaaatatttttgacaggatttttttttaacttaggctaaagtgcagtgatataatcatagctcactgcagcctcaacctcccaggctcaagagatcctcctgcttcagcctcccaagtagctgggactacaagtgtgtgccaccatacctggctagttttgttttttattttttgtagagacaaggttgtgctatgttgcccaggctggtcttgaactcctgagctcaagtgatctgcccgccttggcttcccaaagtcttgggattacagatgtgagccaccatgccctggccaggaatcttacatagataatgttgtattcttagaagttacacattttgaaaaggagaaagaggcccagcacagtggctcatgcctgtaatcccagcactttgggaggccgaggagggtggatcacttggggtcaggagtttgagaccagcctggccaacgtggtgaaatcctgtctctgctaaaaatacaaaaactagccaggtgtggtgacatgcacctgtaatcccagctacccgggagaggctgaggcaggagaatcacttgagccagtgaagcagaggttgcagtgagccgagatcgtgccactgcactccagcctggtgacagagcaagattctgtctaaaaaagaaagggagggagggagggagggcaggagggaaggagggaggggaagagggaaagagggagggaaggagggaggggaggagaggaggagaggaagggaggaggggaggaagggaaggagaaagagaagaagggattatccttggcagaatttggtgcagccctgtcatctccagggtcgtccacgtcattcctgcctctgatccttctgctgagttgtgtttccctctagggtggtggggacctcagccctcaccttaaccacatgtaaggatctgggaggaggaggctccttcttttgttggggacttctccccagactgcgactgaggtctgtgccctggcagctggggagggggtgtgcgctagatttacttctagccacccaggagcttcctgaaccagaggtcacaacgggaggtccatgggcctgactttgctgacagaagagtttgttgggcctacatggtgttattgtgtttattattattgtttttaaccttgaattaattgccaacacttaaaaatggagacactttgcataaaagtccccattttcagcttccctcgagtcatcacataatccgtcagcactggactcctcagaagggcttgacgacacttggcaagagctgagcaggatctgccccttggacgcatctctgcagcctctggcccctgcccaaagagctgagcaggatctgccccttggacgcatctctgcagcctctgacccctgcccaaagcagatgctgtccgccctcctatcccagctgcagtttctgtgacgctgtccgccctcctgtcccagctgcagtttctgtgacgcctgggtacctcactggcttgcacaccccgcctagcattggagtttgtgtcctgggcccaaaacctcagggctgcatcattttttaatgtgtgacattttccacttcagcaggtgcttgggctgcaagaaggggttaaagacttataaggctcaggccttgctcccacagaggaagcaaattagcccgcgtcctaggagaggtgggaatctggggcctgaagccacctccacacaatggggaaaagccaggcagtattgcagatgtgctcgggcagaaaaggctgagatgacctgaaaatttctgtacttcacgctccttagctagggccagccttacacgtgcaacccagatttttttttttttttgagggggagtctcactctgtcacccaggctggagtgcaatggcacaatctcggctcactgcaacctctgcttcttgggttgaagcgattctcctgcctcagcctcctgagtagctgggattacaggcacatgccaccacgcctggctaatttttgtgtttttagtagagaaggggtttcaccatattggtcaggctggtctcgaactcctgacctcatgatccacctgcctcggcctcccaaagtgctgggattacaggcgtgaactgccgtgcccggccccccagattataattttaaggtgtatttgttcgtatgatacacatcgtgacataaaatttgcaaggtaatctctcacccctgaccctcacccacacagttcctttccttggaagcaaacaatgttatcagtttccaggaatattctatatgcaaataaccagatgtgtattatacaggtgacccttgaacaacatgggagctaggggtgccccctcctcacccatagtccaaaattgacatataactttgaactccccagaacttaactactaatagcctcttgttgagtagaagccttactgacatgaacacatattttgcatgtttatgtgtattatacactgtattcttacagtaaagtaagctagagaaaataaaatgttaagacaattataaacaagaaaaatataattactattctttaagtggaagtgggtcatcctcaaggtcttcatcctcaacatcttcacattgaatgggcgaagcaggaggaggaagaggaggggctggtcttgtcttcctttttgaaaaggaactataatactctgcttgctttttttttttttttgtttttaaccttcacctaaccatatatcctggcacattttccttgttaaattttcttttttttttttttgagacatagtttcgttcgtacaatggcatgatctcagctcactgcaaggctggagagcaatggtgccatctcggctcactgcaacctctgcctcccgggtccaagtggttctcctccctcagcctcccgactagctgggattacacgcatgcgccactacgcccagctaattttgtatttttagtagagacggggtttctccctgttggtcaggctggtctcgaactctcaacctcaggtggtccgcctgcctcggcctcccaaagtgctgggattacaggcgtgagccaccgcgcccggccgctttcctaattaaatttaagaacttcatcaccatgtcctttctgatttccatagatgtctatctcatactttgtttaaccattcccccactgatggacattggagttgttttccagcctttaacggccataaatagcgctgtcgtgaaaaagcgtgtgtggatgtcactgcccccatgcaactgtatctgtatgatagactcttgtgcaattgctgggtcaaaggcacctgaagtttgcaattttgatcctagtaaactgccatctagagaggtggtactggttcacagcccatttggggtgggggtgagcacctgttgccgctcatgtgaaatgctggcccctggagcacgggaagatccctgtgcgtgttctgtcaatagggaggctgctccagtgccgtgtcccccaggagccgaagccttcctcgctattccagtctccagcggggtcattctttcttgttctgtgccctacagataaactgtgtgacgttccctcacccagacacgatgccggaacagcagctgctgaaaccaaccgagtggagctactgcgactacttctgggtaagcagcgcctcagtttcccccacagcgtgaccccggtgaccgggagtggacacccaggatgggtaggagggacctggatctcaaagtggaggggcctttctcgttggagcgtgaagggctggtgttagagtttgcatctgtgacaggaacttaggaccctcttggggtccagctcattccatgaatctcaggggttcagcaggacttttgttcacattacagacacttcaaccagaatgtaggtaagcggggggccattttctccgatgctcagtgaaggcaggagactagaatctgcctcaataaatgaacgtgggctccatacctgcttgtcacttacgtgagtgacgttggacaagtgcttcacctccttgggcctcagtgttctcatcagaattgtgaggcagttgggcacaggatcttcagagagctccagcttgggtaatcctgtagttttaaaacgtttgcagatcacttagcgaacacagagttttagttttgcaagattaaagacaattttgcaggtggatggtggtgatggtcgcacaaccatgtgaatgtacttcatgccactgaactgcattcttaaaaatggctaaaatggtccgttgtgtgctagatgtatttttttcaccattcaaataaataaatttgtagaaatgcagagtcctgtacctcagaatatcctgggaatggtcctgggccatttgcatgttaaagtcatagtgactttcagaattagatcacccctttctggaatcagatagtggggatggtcacaaaccctgtgaatgtattgaaaaccactaaattgtacatttcaaaaaaacaagtgtccaaagactccaaggaacaataaataagtaaaaactttgttttcaccactttgcaagaatggattttttgagacagagtctcactctgtctcacccaggctggagtgcagtggtgtgatcttggctcactccagcctccacctcccaggttcaagcgactctcctgtctcagcctcctgagcagctgggactacagatgtgtgccaccacacccaactaattttttgtattttattttatttttttaatagagacaggatttcatcatgttggccaggctggtctcaatctcctgacctcaggtgatccacccaccttggcctcccaaagtgctgggattacaggcatgagccatcgtgcccagccggattatctacacttttttagatttgctaaccgaatactagataaaagtgcttttctctttctacaaaatcgcttgtaccttagaagatatacaaagatccctgttgcctacacctctcaccaaggcacaatttctgtagctccagctgtgctgtgtccagggtagagatctgtgcattggttgaggaaacagtataaaggggcttatctttggcatcagacagacctgggcaggtgagctcagagggcggggtaagcaagcatcggggtaagcaagcatcagagtgcgtaagactttctaggccccagtaagtgagttttattctgcttgtggaaggagggtgttagaaggtcttaagcagcaatatgatgtgatctgattcataggcattgtgcaggtgggggtgggaagttgacgggtgagtggaagagaccaggaaagatggtggtggcggcagagagggagagatgtacctgggtttggaaacatcatctctcaagaggggtgcagtaaatggagggttcaaggagagagtggtttgagccctggaaatgggtatcctagttgctggaggtcagcgtgtggggtctcaagccttggaaagctggtaggaatgtctgatgccgcctgcatccagcagcatccggagggcgacacttgtgagttcttatcttaattcgagctctctggggactctgatacttaatctgcaatccacttatccccctgaccatcaaggccttttccattaatagaaatttctctctcctgacacagtcattaaagcctgtttcttctggctggttttccccagagtgcatagctcagcatatccatcctagaagggaggcagatttgagctcagtatttggataattttccttctgctttttcatcaagatgtagcattcgtagagtgaagcacagagatcttcagtggacattgcttttaaactgcaagaacagcccgactgtgaccccgtaggatggtgatctccctgtcatcagggatgttagcagcgtggccggaggcctttgagttatggcacccgagggaggggtcccacaccgggggaactgggaaggtgtccataaaatccttcatctacttgatgatggtaaatggggttccctgcaggcatcagcaaccccttttctttcccctctcctaaaatgtctgatctggatgggatctgagagatgcaacccacccctatttcaagggggtggtccggggagatactacctaggattggacaccctgcagctgagcagagacaagaacctgggtcctaccagatgctgggacactgttctcaccaatgcacctctctctctgggatatcaaaaacctgttctgaacaccttccattaagtatcaaagtgtttgaccctgggttcctgatagggaaaagctgtaaggaggaggacacttttagacatgcctgggatggccctgggagctggtgctccagcagccacggccgtgcgggcagatgtgtgggtgaatctcaggcaggggaatggcagggaaggggcatttggtatgcttgaagaaatgcaggtaaaataaaataaatcatttaattttgaaattttaagaatatttgtttgcaaaattaattggctgctaagtacttatttcattgacttgcccatcctccccaagtttggacttttatttaaaagtaactaataacagatgccatttattgggtacatagtatgtgctcagcaatgtgctcagatatatacataggtcatttaccctgaaatgaccacatgaaggtggggctgttatttcgtcagttttgcagatgaaaaagcttaggcctggagtgagtgaagaacttggccaaggtcacccagctagtatttcagggcagcctgtcctgttctctcctccggcctcccttcaacccactttctctctatgatttacttttctctcctgtgatcttgtatgaatgtgtggttagagggtgtcactgccctaccagtgtaagaagttggtagaagacaggatggcttaaggctgggggtacctgctcctgagctcacacatagtccagcttggagtcaggatgccaagattcgccgagggccaagccagatctgcagccacctggttggaagtcgtaggccgttaggcatcacagccggtgctcttggacacttgcccttcttcctctcagttcccaggttgggagagttaaggggcttggatgtggggatgcagcaactgtaagagcctgagcatcagaaagcgctgttgggagtgggggcaccaggagagagatccgagttagggcagcagagacagctgctcccgcgtcttgtgctggactgggattgccaggcacatctaggagccgtcctccctctacgccattctccctggctccagactcagacgtgccctaaactcttgtgcttctgcttcctttgtaggctgataagaaggacccccaaggcaacggcaccgtggctgggtttgaactactgctccagaaacagctgaagggcaaacaaatgcagaaggaaatgtcagaattcatccgggaaaggtgaagcctgggcccctcccagccctggggcctggcaccagtgttccccggggccccgtggccggggcggggcgacagcacaggactcagtactgcacactcagcattgggctggttagcgccaggcggcaaactcatggcgcctgggatggatctggtcagcagttgtgtacctttggccgatatagtgtttttaaatattgaaagcaacacttaaaaaaatgggtagatttcatattaaaatctggatatttagcacaccttgaaagagcagaagcattggcaggattgcctccacatccctcacgcgacacttggctggagctgagtagcagctactcttgtagagggggtgtgtgttcccattttgccagtctccaccattccgtactgtcttcccccgcagactccttcactcctttacttatgtacctggccatcatttgaagcacagccctttaccgtaaccagtgggggggatgttacagttcaattcatcgttagccaaaacctgtgtcccagggcaggagatgttgaaccctcctcctaccccatccctgcctcaaggattataacagtgttttgtctaaagagcttgggaacacagatgaagaaacaataaattcagcccaatggaaatggagaaatcgacaaagagaaagagaagttccttctctatctccttcctcctctctctctgtctccaagttctgaggctctgttcagcacacactcacatacccacagctgcacatacccacctatcacccatgtgcacacacacacaaacacacaactttccacctggagttggaaatatagcaaattgcaatatctttttaaaatatttcttttttttttttcttttagacagagtctcgctctgtcatccaggctggagtgtagttgcgcagtcttggctcactgcaacctccatctccggggttcaagcgattctcctgtctcagcctctggagtagctgggattacaggcatgtaccaccacgcccagctaatgttttgtatttttagtagaggtggggtttcaccatgttggccaggctggtctcgaactcctgacctcaggtaatctgcccgcctcagcctctcagagtgctgggattagaggcatgagccactgtgccagaccaaaaatatttcctttttaattataacagcaataatcaagtaataatgcttcggcgttttgaagcacccctttcccttagagggcctattttcatatgagatcggatgtgttcagggtggtatgggcatagacagagggcctattttcaatttgtgtaatcaaatccttattttatgacccattaaactggtgggaaacggagaggttgcacagctcgggtttgagaaaacaatggtataaaataggcaaataggaaaattgctgtaaaagccaaagcttgaacacgcttatggtttatatttccatgacaacgtcttgttagcaaataattggaaactgccatttcaggacattccgggcttcctagagaaaacgcatacaccatccaccttgggatctcatagggaaggccctttagtgccaggagaggtgagagctgaggctcagaattgggagctcgcctggcttgaggacaggtgctggctggtttgctgggatcttggtttagagaagtggggcagaggtagaggtgacgcacgctgtcgtcctggaggtgagacacaggaggcagacagcgtatgcacctcgtgtgtctggtgcatgctgtcggcattgaggagccgggagcgtggcatggatagatctactttctagatatctctcttgaccacagtctggaggtgaaggtagggggatggagaggaagtgacagaggcagatcagttggaatgagactcaggaggacctagagaccagttgaaggtggaggtgaggggaaagcagtgcaagaaggaacgagattgtgagtctcctgatgccaagtcatgcaattattattactcggaatgctgccgccagactttgtcagccgccctctctccatcatcgcaccctttgggtgccagctgcttgagcagctgggaagcaaacgctgtggtcccagcatctctggagcttctctgttcaccgtgtggtggaccaggggctctccgaagcctgggctctggccagctctggttggcataagcatagctcttctgtctcccactgtggcccagaggaccacttaggtggtgaacaatacctctgacaacatgcttaacatggacgtgccagataatacaggacactccctggggagttgccttgcaaatgtgtcaaaggcctgcctgccggaagctacatccaaggcaactttcctctccagggaaatagaatctacctgcagccctgggcactgctaggtttccgtggaagtacttgtacccagcaggcttgacaatcagaggcattgggggtgtgagacagtagggagatgttctgttctgctgctgagggtccgaggccacctgggagttctggggctggaagggagaggggacagcactggggattgctggtagtccatcacgagttgcaaacgttcatttcttccttcattcatttattggttcaggggtcttatgtttcccgttctgtgctaggaactgtgtaaacgacagctctcgtcttcacagctctaggagaccggagaaaatgtcctactttgcagatgaggagatggaggtccagacagttttgttcattcatttatccaacaagtatttattaagcacctactgcatgtcaggtagacagacaagagccatgtggtctcagagcttatggtctagtgggttcctttccacggctgaggtgtgcagggcagcagggcagacccacgatctggcactggagagctgatgtgtgttgggttttctctctttgcaggataaagattgaagaagactatgcgaagaacttagctaagctctctcagaactccttggcttcacaggaggaagggtgagtgggtaggagagaggtgggagtggggaggatggggggtcactgaggaagggaaatcagccactatcactgatcactggcatggccccactttggatggggagctctccataggcctggctcaaggtgggcactcatggctcaggtaggtgctcatgacttgggtgggcacccatgactcaaggtgtgggcatccacactcaaaagggcacttccagccgggcgggtggctcacacccattatcccagcactttgggaggccgaggcgggtggatcacaaggtcaggagttcgagaccagcctggcccacatagtgaaaccccatctctactaaaaatacaagaattagccgggcatggtgatgagtgcctgtagtcccagctacttgggaggctgaggcaggagaatggcgtgaacccaggaggtggagcttgcagtgagctgcgatcgggccactgcactccagcctgggcgacagagcgagactccgtctcaaaaaaaaaaaaaggcacttccacattgtcttctctttagtgaccaagagccacgttccagatgttgaagtatgtcagaatcccctctggtctgacccctggtagctgggcagcagcctctagatgcccactccagcctccctttgtctaggggcaggctgggaggaagctgcgtatgagagggtattgtacctggccgctttgtctggagctctctcctgtgggcttgaggcataggctcccttcccgctaatgctgtgactgtccagacctccttgagtgggacctgggctgggagaagcttaacccaaccctcccagccacagaaggactcctagtgggtaaaaaagtctcagcccttatgcacccctgggggaaatggaatatggtacagccgctgtggaaaacaatctggttgttcctcaaaaagctaaacatagaattaccatgtgacccagcaattccattcctaggcttatacccaaaaaaactgagtacaggcactcaaactaatacatgtatacacatgtacacagcagcaatattcataatagccaaaaggtggaaacaacccacattccacccagggatgactggataaacaaatggtggtgtatgcacaatggatacccatggatagacaatggaatattactcagccatgaaaaggaatggaacactaatacatgctactgtgtggatgagcctcgaaaacattctgctaagttacagaagccaggcacaaaaggtctcatagtgtatgattccatttatgtaaaatgcccagaacaggcaaacccatggaaacagaaagtggattgtcatttgccaggggctgggggaggaggggaatgggttgtgactgcttaaaagttaccgggtttccttttggggtgtgtattcatctgcttgggctgccacaagatgtcccagactgggtggctgaaactacagacatttattttctcgtggctctggaggctgggaagtccaagatcaaggtgccagcagggttggtgcctggtaaggactctcccattgggttgcagatggccgccttctgattgtgtgttcatgcagcctttccttggtgtgtgctcagagagagagagagagggagctctgtgatgtctatttttttttttttttttttttttgagacagagtctcgctctgtcgcccagactggagtggcctgatctcagctcactgcaacctccacctcccaagtagctgggactacaggcatgtgccaccatacctggctaattttttgtatttttagtagagacggggtttcaccatgttggtcaggctggtctagaacccctgaactcaagcagtccaccctccttggcctcccaaagtgctggaattgtaggcgtgatccatcgcgcctggccaatgtctatttttataaggacactaatcctatcagatcagggctgcacccttatgacctcatttaaccttaattacttccttaaaggccccattgccaaatgcagccacattgtgggttagggttttaacctaagaattttggcaggacataaacctttagtccatactagcatgacgaaaatgttttggaactagatagaggtggtagttgcactcacaaaacaggcgtttgatttggtctcgtcctaaatgcgcctggatcgatcacttttcaacggttaattttatgttatatgaatttcacctctgtaaaaaaaaacagaaagactctcaggaggttagagttgaaaaggtccccagaggtcctctccgttctgacctccctctggtgctggtctgtttgaattccttctccaagggggagtgaacccccgaggaaggaagacgttctgttgtgggatggttgtggtcgtcagcgagccatgatgttaaaccagtccaaatctgccttcgtggcttgaaatccttcaggagactgagattttgccaacccaaatgtggctttgattaagccctccacatgggttggctgtgcagccaggcggcctcctttgaatggttctcaccctccctgccagccacagaccgcagggcggcccagcaagaccagcgtcccttccacagatgtaaatgaggttagttcattcctggcctccttctgctccatgcacggggcctgagataggggcaggaagggggcacatagaggagcagctcttgctgcctggcaaggggctttcctaagtatccccgtgccctgcaaccactgtgccactccggagtcttccggcttccatctctccagcctgggctgctgccaaggacactgtgtcctggccaacatgcacagcatatgctcctcacccgagcagtccagctccataagtcaggcccacactaccatactgtacacacatgcccggacaaacacagagacaaacacaacgcaagctcacatacatgcatcagggccactgcctcgtaggtgtacacattactctgtgtgtgcatgcacgcacagcagccccatgcacacactcctgcagcaggcactggaacatgaacacatgagccccctacgtacaacgtgcaaagacactgatttacatttacacacagctttggacatttaaccctatctccttgaagactttcaaagcaaagcaggagtctagaaatttggagcagttgaggaagatgctgctcagggaggctggagaggcttttgcaattcaacttctgtgtccaaattagatttcacaggacatgtgcacattggtaaataaacagaattcggttgtttattctgcctttagtttttctctcctatgtggaaaggaaatgcgattttggttttcctagttggcagtcatgaaaacaacatgcattttgatttggcgtacctgaaactgtatgttggaacagagatgcacctcaggttttgttttgtttttcattaaccgtttatcagatgaaaaatctcttttcaaatgagagaatttgtaagtagctttttaataaatggtgatgtgactccaaagagcctggaatattggagagcagggaggcattcaccaaggatgcactggctcagaggggcccctctgaatgtctggagacatgtcttcccacttagcagtgtctggcctggaggtagagctgaggacgttgtgttgggtgggggaaaaccatggttcttcctttcatcccagttgcccagagatgacattctcaggccaccacgactgtccctgggccatttacctgccatgtgctctgctgacagtagactgacagctctgtggaaagatgcatgtgctcatacaaagtctgggcaccgcctggggcctttttggctctgtgactcttgttcatacctcccacaggctgctgtgtgtggctcagctgcaggggcaaacccctctcacttccctttaatccagttcccattcctcccaggacaaccttggtatgcttcaaatagtgttggctttcaccctagagctaggaggcatcttgagataatttgtgtgtatggtgtgaggtagggccgagattccttttcctcctgtggatgtacggttgtctctgcaccatttgttaaaaagatcatctgtttcccccatggaaacaccctaacctctttgctgcagtcaatcggccctagctgggtgactttgtgttctgttccgctgatctgtgtaactgccaggactactcctgccacccctggacctcctacccacctgttgaatcaggtggggcacccaagccacccagagggggtggagtgccccagtacagcttcctggatctcaggcccttcaggcagagacaattgtcaacagcttggattgccccgtttcatactccagtgcttctctggtggcttcccctgccaggatcactgaggggacctttctttgctgctagactcctagataaaatcaggcagtcatttcccataaacacccacctcggcctgagcctgcgccaccaccacacagggctggccagccatcagagggatctgctgtgcactgttgggcaattcttcgctgctggctgctctgctccagacccagaagcctcaccacatgctgtcttttattcagcttttgccactcgactttaatgaattctctgggggaagtggcttttggatgatattaagtcaacagaacattcagcctggatttactggctgtgttgaagaggctgggagcaagaaagcgggggtatcacttggaagggtcatgcggttaaagagctccaaatcatagagaatgtagcctggggcctgcattggcaagtcttagggacttcaggagatttcttctacgtgaagcctctccttggagtggagaagtgatgctgctaagaggacttggcccttctctagtaagctgtgggcagcatcagggctcacagctagagaagcagtgctagaggagaccgtgcttcctaggatggccgtgggagccttctctgccctgtggctgcatctaggtcactagacccacacagtccatcttccccactcctggaagccaaggagctgggtttttcctataagcagcgctgtgtgatacctgctgtttgaaaagagcttctccggctgggcatggtggcttatgcctgtaatcccagtactttgggaggccgaggtaacccctccctgcagctgctctcagttggtcaggagttcgagaccggcctggccaacatggcaaaaccccgtctctactaaaaatataaaaattagccggatgtggtggcacacgcctgtaatcccagctactcgggaggctgagacaggagaatcgcttgaacccaggaggcagaggttgccatgagccaagatcgcgccattgtactccagcctaggcgacagagcaagactgtctcaaggaacaaactaataaacaaatgaaaagagcttctccctggaatagaacctgttttccttccttgatttattagcagatgcttgcacccctcatcagcaaaccagggaggggtgatgtgaaagctctggggacagtgacggcccaggggtcaaggccctcactgcagctgaggctttggaatgtccccacacctgcttccggcaccttcctgggtcctttcgagcctctggatttctaggaatccccaccccccccacctcttggctgtgcgccacagtctgtttccttagctccagaggtaaggtgagctcacttggaccttggtggctcatctgactctgtgagttgaaacgtgatgctcatgtctggtttctgcctgacttctgcctcatccgcgtccacattctcagctgtcatatacctccccgagacctggggtggagccccaccatcctgcctcaggaagggctttggcttgtgacctgagtctcatggtctttgtgttgcagctccttgggagaggcgtgggcccaggtgaagaagagcctggcggacgaagcagaagttcacctcaagttctctgccaaggtaacccctccctgcagccaccctcagttggtcttacacactggggtactaaaaaatagttaacaactgtctctccagtttgccgtttgccattttccctggtgtaaacttcaggctatcaacatgaagtcacggaatacggagttgggaagagatatctgcccagtggctcaccatgaggtggtgcatttttgtatagacacagtagcacaaataaccatcaatatccaccaagagcatggaaaatagtaaagtgtagttaggaggtggtaagtgctaggtatttattgcctttgttttttatgttttgttatttttaaaaagacaaggtctcactgtgttgcccaggctggagtgcagtgacatgatcatagctcactgcagcctcagcctcctgggctcaaacgattctcccacctcagcctcccaagtagctgggacaacaggtgtatgcaaccatgcctgggtaatttttttatttatttgtagagatggggtctcgctattttccccaggctggtcttgaacctcctggcttcaagcagtcttcctgcctctacctcccaaaatgctgggatcacagacatgagccactatacctggcctattaccttcgtttttaatataatttttattcaattataagttcatatcatttcctttttgataatggccgtgtttaacaaccagcaaacagaattcctgaaaatttaacattcagctcttgggagccactgggagcaggccttagcacacctgcccagtttctcagggcagcccctgagtgacgaagccctgctttctttttgcctggctttcaaagggatggagtaggatgtcctgtctcttcctagtgtcagggaacattaggttatgccaaagggagaattttttttaaatttgtggttgttgcaaaatttcagaacaagtaaagggtccttctttatttatttattcatttatttattgattgatttattgatttattgattttgagacagagtcttgctttgtcgcccaggctggagtgcagtggtgcgatctcagctcactgcaagctccgcctcccgggttcaagtgattctcctgcctcagcctcccgagtagctgggactacaggcgcctgccaccacacccagctaattttttgtatttttagtagagatggggtttcaccgtgttggccaggctggtgttgaactcctcacctcatgatccaccctcctccgcctcccaaagtgctaggattataggcgtgagccaccactcccgaccataaagcatccctctttcatttaattctgaagatactagtgccaggactcgagggcagggtgtttctgtcctattcccatcctcagggctcaggatggtgtcttgcatgtagtagatgcttaataaatattttcttattgagtcatgaatgaacagagccctctgactatctccaccccacccccagtcttttcaggtctgctttctctcaagatttctccatgtttccaagtgactctcccttccccactccctggcacatacctccaggttttctctccgactctcagctaatttttagatgaaaaataaactaaatctctcagtgaagtaatccactctaaagtgtacatgattggtggggctacccattaacaggcttgccttttaaagaaaggggccaggcgtggtggctcacgcctgtaatcccagcactttgagaggctgaggtgggtggatcatgagatcatgagatcgagaccatcctggccaacatggtgaaaccccatctctactaaaaatacaaaaattagctgggcttggtggcgcatgcctgtagtcccagctactcgggaggctgaagcaggagaatctcttgaaccctggaggcagaagttgcagtgagccgagttcacgccactgcactccagcctggcaacagagtgagactctgtctcaaaaaaaaaaaaaaaaaaagcgggggggacctttcagagtgcaccatcccagtgaccctggcctcctcgctcttccctctgtcctcccaccatcactagtcagacacagcagggtaaagtgcctaaacgctgagtctcccttctttaaacacgtgcttgatcatttgaaggtagcatccctcagagatggtcgctccttcctgggacttccacgttcagcactcactggtcctgtctctttcctagtgtcgttcctactgcaattgcaagtccctgctttgggatcccatacgatgtaccccgtggtggtactcggcacacagaaggcagaatgaatgactcagatgactgagacacgtgaaaggactttctaaagagctgggttggaagagggaacagagctgctacagctccccatggcttagtgtgccccaagattgagttgacacccagatgtgagtgagaattcccagccagtgaaggcatgctaactaacctcattacaccaagcgcttcagtagaaaattgctactcaagtcctggcagagaagggaactccgtgaatggatctttttcctgcattgcatccaaaacagcaagttatttttcagctgcagatcatgagtagctttcccctcaaggcctcccttcccctgtcggggcccccagcagctccattctctgctgtggtagaaacttccattgactgggaagatcctgggcgggctgccattgtgatggggtggggctgggagccagagttgcgagctttggaaaggtcacctgctgggtccccgggaatcttggtggcatttactccccatcagcaggacccctgattcttgattgtttagagtgctcaacaggtggcaaaactctctccgacgtggtagtggtgacataagtggtgtggatggctgtgtgcaggatataactcattgccgtcaaccaccacgcgagatagcatacacatttcacagtgagaagaggtggggtgagatcacagcccatggtcacacagccaggtgggttcagtcacagaggaagcaaaggaaaggactgagcgaatgggagacttggtccccagagcttttcttccagcagctcccctgctttggcagaccaatggcattgaaaacacagcctcttcttgagcctgtgcctttccaggggttgccaatgggctactgcagactggccctggacaaccacatgctcagaacattttaagttagtgttcaggacacagggtggacctcaccattcagttgacaggaagctcatgaagacccgtcatgcaaaacagactttgctacgagaggctctcggctgcttccagcctgtcggtcagtgttggtggcctcaagcggtcatcgcagcagcctagtggttttatggcgattccttgagaagaaagtggctccaaggatgtatttgactgccatgaataatatagctccatatgccaaaaaccgtttttaatgtctgctccaaaagacttattgaaattctgctctgaatgctctgtgtcaggggtaaaagctctttaagaaatgcaattttgttgcagcaatttttgtggtttttctggtccattagctcaagccattgctaatagcaacagattgctaaagaaatgagagagccgtatacaaagaaagttatacctggctcctgctgaagaagggagaagagcagaattccttctgctgatagaaaatctcatgcggtagaggctctgcgttccatcagaagatttaggggacaggagtgaggagacatgagttgtatctcagtattgtcactaacaagctctgtgaccttgagcaagtcacttagctcccctggggtttcatttcttcacatatgaaatgaagaattcagaccagatcagtctctttacacttatctgacagtgacttacaatgatgcattttatgtgagcattcagaacctgtctgtaggtatccactccgatatctgcacacagacattcacacacatctgtagctgaaacaaacgtttcataaaacagtatttatcctcctacttaaaatgtactctggtattttctgttcaagtctggtctgttctcaccaaaaagctggtcctggcccattaaatcgatttcacaactctcggccgcacaccgtctgaaaaatatcagactagacagtgtctgaaattcctaccaacttggaacttctcttattctcttctgatgtgtgagatgaaaaggaagcaaagagagcgagagttttggaaagaaaaactgatgggccatgacaggccggcctgagtctgtgaggacactttgaggaaggacttctgattcctggttcaacagagatgcttaaaagttaagaatgggtactaaagataccagcctaaccattttaaaggaaaaaaaaaactgtcttttaaaagtacttaatatcgtcgggcacagtggctcacacctgtaatcccagcactttgggaggccgaggcgggcggatcatgaggtcaggagatcaagaccatcctggctaacatggtgaaaccccgtctctactaaaaatacaaaaaaaaattagccaggtttggtggcgggtgcctgtaatcccagctacttgggaggctgaggcaggagaacggcttgaacctgggaggtggagcttgcagtgagccaagattgcgccattgcactccagcctgggagacagagtgagactccgtctcaaaaaaataaataaataaataaaatacttgatgtctgtagcgagatggagatgccaggcatcctcatctgtggaatcaaatcacttgtgatagttagcagcgtcacgcttccagaatgtcatttgaatttggggaaagcttcctggcatattggcaggttcatgggcttttccccagaccacagaacctggggctggggtccaggaaaccttaatgttgaaaactcttcaggtcattcctgggcgtattaaagcctgaaagtcacttgctttccatgtccttagagaccccggagtttctgagtcagcaggctgagctaactctcccagattcccggagtcgtacagctgctcctactcagcaaatgccaaacctatatacgtgggaaaggggtttatttattctcgtaagctctcaagatttttgtagcatcctgcaaactgccgccaggtggggatgttttcctatacagggaaggttccaggggctcaaaaaaaatagtaggacatatttacaactaacacgaggaggagagaggggtgtttggatggccagttctctgttagtctgtgacggtcatccagcgacaaagctgtcttcttgtcacccaggggattgagctctgaagagtttgtcattctctctacaaacacagaaggggcacccacccagccccagcccaggtcagacactgggcacagcagtgctcaacccagatggggcccctgcccgcttggagctcccagccccgtgtaagtcagttgcttagaatagggacacctaagtcctggttgtatccagagaaaaagatattgtacagcaaaaacctgagggagaggagagaagtcacagaaccctcgttgggatatcatctgtccagggaagttgagctgtgctccctagagacacctctaagaccggtggaggcagatttgcggtggtggggtggtcataggttgaagagagttgcctgattccaggcagtggggtgggaggggtgcacagggctagggtgccacctggctttgaccacagcaggtcccgttgatctgttttcttataaatgttatgggctgggcacggtggctcacgcctgtaatcccagcactttgggaggccgaggcgggcggatcacgaggtcaggagatcgagaccatcctgactaacacggtgaaaccccatctctactaaaaatacaaaaaaaaaaaaaaaattagccgggcgtggtggcaggtgcctgtagtcccagctactcgggaggctgagacaggagaatggcgtgaacctggaaggcgaggcttgcagtgagccgagatcgcgtcgctgcactccagcctgggcgacagagcgagactctgtctcaaaaaaataaataaataaataaaaaataaataaatgttatgctcacaaacaaaaggaacaaattttaaggaaaagttcttttaaaggggggtgggatgggaaagagggaaggaataaaagagaagaaaaaagcttaaaaccctgatgccacccagctcttctgacagcataaacccttttctctggcccctgggatacagggcggttccctttgcctgtgctccaggcagcccagcaagctgagaatgtctttatgagcgcaatgcgggacagttgcccttgtgagtttccagcaggtctccaacagttcccaccatcagttcctcgaggtttggaccctgtctagctcacctttgtattctcagcacctgccatggagtagatgttcgataaataggactgacctgagaccttctaattgaatggcattcattcgactgttctttactgaagccgcgtaccccagtcactgtgctgagtgcttggagacacagacgctgatgtggtttctgtccccagaaagctctcagttcggaaaataagggagagagacataagaacaaagccgtgcaagaagctgtgggataaaataagtgtgtgaggtcattgattattattgttttttgtttgtttgttttgttttttttttttgagaccaagtctcactctgtcacccaggctgaagtgcagtggcacaatctcggctcactgcaacctcccaggttcaagtgatttcctgcctcagcctcctgagtagctgggattacaggcacctgccaccactcccagctaatttgtgtgtgtgtgtgtgtgtgtgtgtgtgtgtgtgtgtgtgtgtgtatgtagtagagatggggtttcaccatgttggccaggctggtctcgaactcctgacctcaggtgatcaacctgccttggcctcccaaagtgctgggattacaggcatgagccaccgtgcccagcccattgattattaacttgatttagccattccacaatatatacatatttcaaaacagcatattataaaccataaatagtaaaaaattctaaaaatttaaaagctgcagaagctcagaaaaaaagtagttaacagatggggaaatcagaaggctctagttgctaaccacttatcctgtagacgtgtgtgggggcctcctgagctaaggtgacctgcctaagctgagacctgataggcagccacgtgtcagggggtgtctctcaccttcctgccaggtcgctaccccagactcatcctcacttgcctggggaagtgggggtgcccctcccatccctcctccctgcactggcttacagctgatgccctgggtcctgagtgtgcgtctctactctcccaacagcttcacagcgaggtggagaagcccctgatgaacttccgtgagaacttcaagaaagacatgaagaagtgcgaccaccacattgccgaccttcgcaagcagctcgccagccgctatgcctcggtggagaaggtgagaggcccaggacgctgggccagggcaggtgcatgggggactgcctggaagaagggggactgggaagccagcagtggctccatacgccaaggctgagtctttgtccccaggtaggggaatagggggatgtccaagcctcgtgcctacgccagagcaccccacccatccaagggcagataggagctgcctccctgtggtgctggaatgaccacccagagggccaggggtgcgaggagaggctgcagctgcagtgggcagtcgagtggctgttggcgaccagttaaaccccgagcctagcagtgctgctgctggttcacgtggggccccgtgtttaagcctcacctggctgagtcgtcctgactcagtcaccgcctccctgctctccttcctgctcagggatgaggctgagtcctgggtggtctcacctccagggaactgatgttcagccttagagggaagagagtgtgccccagggactgattcccagtccccagtgccttagagaggagaagggggctcaaactgctgggacaccctgggcccagccaactgccgccacccaaggaccacagagatgccagtggtggcctggaggaaaggcagtacagtgaggggaacaagagggccgaggcttgtccagctccagaacgggagggctgttgctacatcctattaagtgctgcagggaggtgacacagatggcctttgtggtcccttccaagcagaggggctgtgactttaggactgcctaggtccccagtctttgtacaggctccatcgggaaaaaaacgtggtttgagagattgaggtaggctgagtccagatgtcactggaagaggcaaggacgaaaagagttgggttgtagcctctacctagctgggtggtgccactctggctgctgggcctctctggaccactgtggcatcatccacacaaacaaggggcgaaaggactccaaagggaagctgggctgcgtggcccaggaggcccactggctccgagctgtatgagcagcttctccgtgtccttggaccccaggcccggaaagccctcacagagcggcagagagacctggagatgaagacccagcagctggagatcaagctgagcaacaagacagaggaggacatcaagaaggcgcggagaaagtccacacaggctggtaagtgctgggcacccgcctggcctggtcagtgcacacagaaggagagggcacggggctaggagatgaggtgactggcgagggtgcatctctcctttgcaagactgcagcgaggaaattacttcccttgtttgccaggaggtaccccctcttcccttctctctgacccacacccagagatctcaaagaaagagactttgggggtcagaggaaggacacaggccgggctagttctggggcatggtagaggctggactccttactctctccctggtcgtggctttttttgttttccgcccaagccccagatctctgaccaggaggtggacaaactccttcatgcactgagagctcagggccctgtccctgttcagagcccacagaagcacacagctcacccaagctgcccacttccccaggaagcaatgctctctctgaaggttcacctatggggatgggctcctgccctgggaacagaggctgacactttgtttaaagaaataaccagatttcagtctcttgggaatagtctcccaatgagttggtttctgcttccacctagtggtcaaagttagctaatacacaaagaggaagagaaggcctggtagaaccagtgaaaacctcggtaactagatctaagggaagccacgtttcactgcacgagaggacacgcatgttgcctctggaattagaatgtgtgccgtagtattagagtttggtctgtaggtccctttcacctcaatttctggtgaacctgttacaattccttcattatagaagaaagcagccaccttacatttcaaaataaggtaagatagaaataagtcaataaaaaataatgtaatagaaggataacgtttattatacaaatcttataatgcacaataataaattacaggatcaagaagtagagggcacagtatatttattggtagagagaagggggggcacagaaggggaagagatctgtttaaattattaagttattaaaaaaataacttataggccaggtgcagtggctaacacctgtaatccggcagtctgagaggctgaggcaggaggatcagttgagcccaggagttcgagaccagcctgggcaacatagtacctcatctctacaaaaaaatttgaaaaaattagctaggcatggtggtgcatgcctgtagaatcagctactcaggaggctaaggtggaggatggcttgaacccaggaggttaaggctgcggtgaactatgatcacaccattgcattccagcctgggtgacagagagagactctacctcaaaaaacaattatattgcaaaaacagtattggtacatggcaaaatattttaatcagcagacaagaatataaaatgctattcacagaaataatcaccatctcttcctagtgttttgatttttaaatatttaaatttatatacatttgatcatacaatctatcttctgaacttatttaatatatcttggaaatacctctttttcatttctgtaaatctttttgcccatccattcatgcatatcaaactttttaatggctggccagtgtccagttgtatgattgtacccaaatttgtttcatcattcccttaactgaggtttaggactcttagattgtttcagagtgcttgccagccagtgaagctgtgttattgtacctgcatctttgtgtgtgcctaagaccagatctgcatatagagagaatatagttgctgagtcaaagggtattattcgtcttgatggatatttccaaattgctttccagagagagcacctatcaacagcatctatgaataatgcctgttctctaaatgcttatcaacattgtgtgttatcaagatttgaaattggtagtgagtggggaaaaatgatattttgtttttaatttgcttttctccataacccaggttgagtatgtaaaatatacatataaatcattgttgtactttctgtgaactgattaactcatatcctttccccactgaccatagattctttatctatcagggagatgaatcgtttttcattttaattgcagatatttttcctagattgtcatttgtcttttagttttgttctttgtaattttttttttttgcttgtttgtctattttttcttgctgtttttctgtacagtgatatttcccataagaagcctagatttcggagctgatttagatctttttttttaatcacctagagggttttttcttactttttttttttgtttcaggtgtttatttttgtttttgtttttaaaatagtgaaggccggccgtggtggctcacgcctgtaatcccagcactttgggaggcccaggcgggcagatcacgaggtcaggagttcaagaccagcctggccaacatagtgaaacctcgtctctactaaaaatacaaaacttagctgggtgtggtggtgtgtgcctgtaatccaagctacttgggaggccaaagcaggagaatcgcttgaacccagaaggcagaggttgcagtgagctgagatcgcagcactgcactccagcctgggcaagagagtgagactctgtctcaaaaaacaaaacaaacaaacaaacaaaaaaagacagtgaaatatgtaacccaccagacatttatttttccttacactggtggtctaaccatattccacaggttcttatttgtggtggttttatttctgctattttcattatgttttgctatttgggttttcatttgatcttcgaaccaagaattgtttcaaagaaaatctttatatgtttacaagcaagggctttgttgttgttttctaatcttgctatttttttttacatagttttattgcattgtcatcagataatacggtctctcattcctgtagtttggaattattttgtgacgaaagtgacagtccttagacctaactctgaaaaataccgcctcttctgagcactcgctgtggccagcctccatgctttagagcattgtctcttttgatcagcacagtccccctgcagggaggtatttttataccctttacaaatgagaagactgatggcagagaaaatgagaaccttccatgaggtccacagtggtggagcggcgaagccacaattcagtctcctctcattccagagactctgcttgtcgccattttgctggacagcctgttgctcaggaaatgccacctgttctttccttctgttcctttcctccctcttcctcatcttttccaaggctactagaaggaaagacatcagatcctcagggatcatcatcatcatcatcatcatcatcatcatcttcatcaccaccatagcccatattaatatttggctctctacgcccatctctattctaagtgctttacatattttgacatatttattcctcataacaacttggtaaaggtacaatcgttatctccattttacagatgaagacacggaggcaagcgcaggataaccgacttgtctacgattacatagctaataagtagttgagctgggatgacaacaaaggcttttttttttttttttttgagatggagtcttgctctgtcgcccaggctggagtgcagtggtgcgatctctgctcactgcaagctccgcctccctggttcatgccattctcctgcctcagcctcccgagtagctgggactacaggcgcctgccaccacgcctggctaattttttatatttttagtagagacggggtttcaccgtgttagccaggatggtctcgatgtcctgacctcgtgatccacccgcctcggcctcccaaagtgctgggattacaggcgtgaggcaccgcgcctggccaacaaaggcattcttgtcccacaatccatggtcttaaccaatactgttctaaaaagttccaatttcaagctcttgggctgccatagagagaaggtacagcccccttcacctactctgtttcccaatgctgtggaagttcctgaagcaatttctcaaaatcagcattgacacacagggctcagggagtttcacagtgtacagagcagcacgccgccctcctcctcggccaggcaggagctcttgctagaaatgcatttgcatttcggaggctgaggcgggcggatcacaaggtcaggagttcgagactagcctggccgatatggtgaaaccccatctctactaaaaatacaaaaactagccaggggtggtggcgcatgcctgtggtaccagctactcgggaggctgaggcagaagaatcacttgaacccgggaggtggaggttgcagtgagccgagattgcgccactgcactccagcctgggtgacagagccagactccgtctcaaaaaaaaaaaaaaaaagaaaaaaatgcattttacggtgcagcatccactttcttctctccggttcagtgcctcttgggatcaagggtccagtcattggccttggaccaagaacaaaatgaataaatgccttggtgtgggctctgttattcaaggcacactcgcgtctggtgtgtggcatagctaggggtatggttcgcagctaggcctggggcctggagacataaccttccctgttctctttgactttcctatcagagtacctatgagccacaatgatgatactataggagtcactttgactctactcgaattactaaattctactctagcattctgcttctagaattactagagaaaattacttcactttggggttcactcatgagctttttccatcgtgagcaaacaccatgatgccttcctcttgctggagccctgtgaggatgaggaagctacgctgagacaaagccgtgcatgagagctgtgctgctctgcctgccacgtgcacacacattaccagagcgtctcataaacatgcagtctctgattcagtaggtctcggatctgtcctgggtttctgaatttctagccgaccccagggcatacaagtgccactggcccacagactgtgatttgtgtagcaaggttccaaggtgctggtacgcttagtaatgtttgcaattacttcgcagtgtgttttctttctaattacaaaatgttctaaacatacatatgataacaaagtaatagagtagtcctaaagattgaatagttatgtttgcctcggatctttctgtgatgacataaaatgcaatagaaggagctgattcctgcccactcaccctttctctgtttcccaaggtagccactctcctgaagctggggtgtgctcctccagtgcatgttttagactgtgactacagatgcgttcttttgtgtttcagaaggacatcttgcagtgtgttcatgcacacacacacacacacacacttacatgatctgcaaatttatcttccttaattattcttagcaccaaattgtgtgtgacatgttttaaccaatctggactccccagtgtaaaataaaactgccatctttagagagggaagcatttcttgggctcatgataggattgggggtcctaggaataccctagacacacacacacacacacacacacacacacacacacacacacacacaaaatgagaaccaccatcctgaatccttggtatctggggtcaggcttcagggggacacctgagctgggttctcatggggctgggttgcccccttccttccctggctctgctttcttcttcttcctactgccatcccttttccagctttccagcggccaccatgaccccagggggaggagaaggcttggctgtggggctcagggtggggcacagagtcatggtgaggataggatgcttcatgatggtgactgtggtctttttccaggagacgacctcatgcgctgtgtggatctctacaaccaggcccagtccaaatggtttgaagagatggtgaccaccacattggtaagcgggcagggatgtgtggacatggcagtacagaggctgacacagagcagcccctggtggttgttggtgggcgcggggatgatggggtggagtgaccctggagatggtcatcaaatctacttcagtgttggggtcgaaacctcaatgtgagccagcttatgtggattcagatctctgctccagcgcttcctagctgtgtggatgtgggcagggttgggttggatatggctacatccttcttgggctgtcccctgagaggtcagggtcaactgaggactctcctcaactaagtggacaagggcctctttaggaaaaatagccaagctataggaagagaggaccgccccacacatgcacacacacgagttgcaggtccttggtaggagatccttgcaaagtggatggatgggtgaggatggagctaggcagtggggtgggggaggcctctcaccaagggtgaacaacaggcggcagggccgatgatgctcttgagtatttcttgtaaaggggcagcatctccttatcagtcagcacctgcctgagtggacagtgaagtgtggctggtacttgggccagatgggacaggaggcatcatgccaggtgctcatcggatcagcccactgcctaaagccacccctgtccatccagcacaggactaaccagctgccttccccaggtgtcagcccaccagagcagattagaggcctccaccagggacagtgacctagttttcctcctggttaatctcctaattaagccccctgctttacccccctttctgattaatcacctgggcagtgacctagttgtatgcagagtaacagccggatcccctagattccaaagacacaaaaccatctagaaaccagaggacaaaccctttccacgctcccctttgacaaaagctgtgccacgtgcagcccagtctgcctccctggcccggtctctattgcggccacagcactaggcataggcagaggaagggaggctgctcagcagaggcccagggacaaggtcccaggaatgtgtggcatggagctcccacatgtgcccccttgttataccccatcagggcaccagggccagggctgcatgggtgcattgccatgagtaacagcctgatggactctggtttaaatcctgttcctcccataattccgtgtcgctttgggtgagctgtgttgttgcctctctaggtgttagttccccagttcccttgcttggagaatggggataataacagaaacgatctcttaaaattgtaacgaggacagttaaggaacgcacgtaaagccctcagcactgtgcgtggcggagcaggatttcaggaagtaaaacagccgctgctgctgtcatcagcttcaccttcaccttagatatggggcacgctcttcatcagaccccagagagtcagatgggacagaatgtccacagccagtgacttgcgttttgtggtcttggtggggggacccccaagtggaggggacgtgctcagagttctctggcctttgctttctcggcaggagctagagcggctggaggtggagagggtagagatgatccggcagcacctgtgccagtacacgcagctgcggcatgaaacagacatgttcaaccaaagcgtgagtttccagcccagcggggctcccgggcgacacggggcctggggagagccgcctggcgctaggccgtggcaggttaagtggctgctgcaagtgaatctgccctaaaggcgggcagtgggcaggtgctctggcctgggggtggcctcgtggactgggcctctcaggattgtcctggacgtctgtgtgattccgaccctggcacatgaagtggacacacacgtgagctgttaccctgaggagaaagaagctcgtaacagttacagtagctgaagacattattaaatttcttaaaaaacaaaaccaaaaaaaacaacttctagaaatattcacaatacctaaagctcaagttttatttgtcctgttcactggtggtaaatgtggggtggaagggatagagacaggttttaaggccctcctggcctctcatccaggcctggggtctgcagggtgagaagcagggtcgggatgcatactgggttccccgttcacagccctcttcatgtgctgtccctcagatgggcctccccctggggccccggagccctctagagaggctgctctcagagacactaaggtgaggacagcatgtctcagaggagacctccctggcttggccgccgtctctaacagtgtcgcattttctctgtctcttgcagacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 36110 - DNA, 67815 bp, Homo sapiens
taggcggtgcatcccgttcgcgcctggggctgtggtcttcccgcgcctgaggcggcggcggcaggagctgaggggagttgtagggaactgaggggagctgctgtgtcccccgcctcctcctccccatttccgcgctcccgggaccatgtccgcgctggcgggtaaggaagggctgctccgccctgtcccgctgttatctccgaagtccggttccatggcgcctgagggaaaccggctgtctctcgggggtttcgggctggttgggtcctcgtgggtccgagctcctcagaaaagctgggaggcggggtgggcacagcgctccccaggcatttggagggtgggactccgggaatggggaggcagggcatcctggagacagagggctccgaggggcaggcgggttgggaggcttcccgcgagttgaggtcccggggaggaagagattctgggtctgccaggaatccagctttttggagggacctggcggccgcagacccccaaattaaccctttttaaggaagttgaaaagcatggggttctcttatagtggaagctctgtggaatttgaggagtacaggatcctctagggttcaggacaattaggagagttaccccgggttctgggttttctgagggaaatggaggatgtgacttccctgccaagacccaaggcttctcgcgggcatcttggtgtctgggagtcccccggggctgggagctctttgcagaaaataagggagtatggagccccttgaggtttaggacaggactaagggtaaggagagatcggaccattctttttggggcccaaagatctctgctacaggtggcgaaagtaggccacctggggttctgagtcctcctgtggaagctcccttggcctctctagactaaagactagagggattcggccaaacacctcctggaaggaagagttgtctaagggtgaagggtagcttcagagttgggttagttgcacctgcagtcacctccccgccacctcacacaccaccctgcagcttcctgccttccccatcttttcccccagcagtaggaaccttctgtctcctatgtttcccagccacctgtgtgggtggcccacctctgggtccaccagggtcagcgtccagaagctttggagaggcggcaagagggtattgaggtggaggggggctggctatctgccccctgcttcctggctttccgtctgtggacagtcacttccttcatcttgaatgcaaggactgggctaccagtgggtcacttcctcagcaagggagcatgggattttctcttcactggtgataacagacttctggagagagctaggggtggaaatgcctaaaacaaatttttttaggctgggcgtggtggctcatgcctgtaatcccagcactttgggagggcagggcaggaggatcgcttgagtccaggagtttgagaccagcttgggcaatatagcgagacttcatctcttaaaaacaaaaccttgtctcttaaaaaagattttttttaagcttacagagtccttcaactcgaatgatttccagtaacttttttttttttttcttagatggagtcttgctctgtcgcccaggctggggtgcagtggcacaatcttggctcattgcaacctctgcctcccgggttcaagcgattctcctacctcagcctcccgagtagctgggacaacaggggcccgccaccacgcccggctaatttttttggtatatttagtagagatggggtttcaccatattggccaggctggtcttgaactcctgaccttgtgatccgcccgcttcggcctcccaaagtgctgggattacaggcgtgagccaccgcacccggccgatttccagtaactttttctaacagctgtgtaatataggttgcctgtcttgaaccctgtttcttagaaaattgtgaaaggtttcacagtacaatagtctagaggcataaagcctctagatgcattagtttatgcattctttctttcattcaaagaatatttgttggattcttctgtgtcatatacttagccaaatgctgagtacagtggtgacatagttcttggctttgtggtgcttaataatcctagagatggacaataaataattgtaacaattgcaataaatgctataatagttaaggtaaacaattgagataagtgctgtaagagtgcaccaggggtgagggttttctctacttttttttctgttttggtagagacagggtctcactatgttgcccacggtggtttcaagccatcctcctgtctcaacctcccaaagtgctgggattacaggcatgaaccaccatgcccatcctctactttttttttttttgaagggaatacttttcttaaaaatgcaagtttatgctgacccctggagataagtaaaagttagcctggcaaaaaaagctcacagagcattccaggcagaggaaacagcataaaaaggccctagggtaggaaggcatgtagtgcctttgagccttggagctgggaggtcaatatggttttttgatttttttgtagggggtggggaggaagagtcttgctctgttgcccatgctggagtacagtggcgcgatccagactcactgtaccctccacctcccaggttcaagtgaatcttctgcctcagcttcctgagtagctgggactacaggcaagtgctaccacgcccagctaattttttgtatttttattagagacggggtcttaccatgttgcccaggctggtctcaaactcctgagctcaggcagtccacccgccttggactcccaaaatgctaggattataggcgtgagccaccatgcccagccaagtatggcttttttatagatgaggagacaggcccagaaatgacaaggttccatagctaaatgagcagtggtggtcagagttcatattttccaacttcaagtttagtgcttcctcctctctgtagcacaaaaagcagaatgaagttgactatggagtctgagaaggaagtgggacttaaactttcacttgttattccattcaaaccatgttctgagacacctcagattcctcgtgtaaccggagaatcgataacaaatcaaatatttactgagtgcctgtgatgtctgtggcactgggcaggaccaagttttacctcttataaattttaacaggtgttagagccaggagagagttttgagataatgtatagtctccttgttttacctatgaagaaactgaggctcagggaaaaaaaacggagttgtccagggtcactcaactagtggtagagccagaaccaaggtaagacttctgcagtgttctttccagtattccaggctgcttaagacgtacagggtctggcacatggtaagcccttaataagtatttgtggaaatgagttatatatagtttgtgcctctgagaaacttactgtctagttaaggtaattaaggcaaaaaacaaaactgccatgctgatcagtagtgggattgcgcctgtgaaaagccaccgcactccagcctgggctacatagcaagatccccatctcttaaaaaaaagaaaaaaattgataagacaagctgttataaggcttgcgtatgataacattatagaatttcaaagatgagggagaattctcttcaaacatttattccacaaatatatattgagttcctgctatgtgctaaactcttttggcccctagggatacagcaaggaacaagatagaccaaatcccttccctcatgtagtgtatgttctggtggggagagatagacagcaagtaaatgtatgaacatcatattcagggataaatccattgaagagaagtgaagtagggtaaggggatagaagaagtgagttgtcagggaatgtgtttggcatgtttaaagaatagcagggtatccagggtggccatcagttttggttagggaatacttcttgaagtgggtaagacttgagaaatcttaaataggcttaaagaaggtggggaagatgatatcttagtagggaagaaactttgggagtaggagacaaaagtaggcaagtttcaggtcttcataaagggtagcaaatacgtgtggtagaggcaaggattgggaggtggaagattcataggaagtggaaggtacagctgagaatgtgggtgcaaccggactagagggtttaatgccaggctgaggattttggaagtttctagtctacagtaggcaccgtaggtttagagaaaggaagactcatgatgtgggcacagggccaccaatctggaggtgggtatagtgggccctgagatgaggtcttagtggtagcaatgaagaaggcaccaaccaataaaagatgcctcctgacataggcaggccagggtgacttggatggtcctggatatgtgatggagcagggtagggtccaaaatgaccacaagatttcaaaactaaataaaaatccgtcatgatcaaggggctgtattaggctttccacattcatggtggattttctgcatcttctggaggctgagctgattcccagaacagggctgccttcttgttagtgtaaccttgagcgggtctgatagggcccaccatcacacacatctcatttcaatgagaggacctgaaactgtagcagtctcttacaagtctaccttctttctcatcctttatctatttttatatagtagaaagaattagactattttacctattaatttacattgaatagtaactagaacatgaaaccaatgcctggtttcattaaagtgttccttgaacattctttctgggattcttttttatcatgtctttctgcctgtaatttgttttgtccaggaaagaaagtctaaaatgtagttaaagacaggctttgagccaggtgcagtggctcacgcctgtaatcccagcactttgggaggctgaggtgggtggatcacaaggtcaggagttcaaaccagtctggccaagatggtgaaaccccatctctactaaaatacaaaaattagccgggcatgggggcaggtgcctgtaatcccagctactcgggaggctgaggcagagaattgcttgaacctgggaggcagaggttgcagtgagccgaggttgcaccaccgcactccagcctgggtgacagagcgagactccgtctcagaaaaaaaaaaaaagacaggctttggagactagacctgtggtctaatcccagctcaaacatttattagctgagtatttcagtttcctcttccgtaaaatgagaacaataatagttctttaagactagtcctgatctcatgggatctttgtattcagttagctcatacttgcgtagtgcttaggacattgtctggcataaagtagtttttttcctctatcattgacaactggcagagaactgctgtatgagaatatatcaattggttaaccagttctctgataaagatatttttataggccctccatagataagaaaatgcctactcattcacagttgagtgaacttctggttggaagttgcagtctgggtggcctgaaagacataagaaccatctgtctcatttgtcactgcagtgtattttgttaatgtactgagtttgccttgcctgtagcacctggtttgtccctctctgacatgttatttctgtgtatatccatgtccttcacaccccatgagtacacaccaagggccccagtaattcctggcctactctgtgccttgtacatgggcacatagaaaaaagtttgctgagtttgttttgaaaaccttcccttcagattttagaagtttctgtattcagcttaaccttttccccagccaacttcctagatacacacgcaggaaggaagagaagttagtcacaaatcggtccaactaagtgcctggcaccatgggagatattttcacatctattacattatttctattaatccacttggtaatcctgtaaagcaggtggtattatcctctttttaaagattaggagacaagctcagagaggtcaaataatttgcccaaggacacagaggcaaacagtgacagattcaggtttcaaacacacatacatttacccctcacaaatttttccaaataaaccaaagaagggaagaagagaataacagcaagaaggaaactttctgagatacctgtgtctgtgccttaacctgaaaaaggagaggcccttggtttggtgtcagtctctcagagctggaagaaatcacttgatccctccttttacaaaagaacaatccaaggtttagagaagctcgaaagctcttttaaaaatcatctaatctttttttttcctgagacactccttttggtaaaatttggtaagctagtgaggaagaaaaccctttgggttacagggagagtatctagaggcatgttaatccttactgttagtctttttgatagtcacttcattaaaatgtgatctttttctcttggcttttccccagcagctgctgccctgcccttctgctttctgctttgtcccagaacaagtgggatttatacacctgacccgccagttcccaaggggcccaggggttaccatacttgttttatgctgcactgaattggctgagttttgttcctggttctcgttgtctggtggaacgtgagaagcttcaaagatttttttaaatgaaaggataggatgttgatttaagctaggcattagagtctcatgagctctcagtgcttgaggatttctcaccattttgaagcctaaaaaggactcatttgcagaaaccaagctcttagaccaaatttaaggtgaacattgtggggactgcattggctctgagctgggataccaggccaacccttccactgaatagctgtgtgttcttgagcaagtctcaacttgtctgaggctgcatagggtattaaaaatatgactggcatggtagtctctgagcatgggtttgaatccctcctggaccatctttcagtagctttgtggtggttaggcaagtctattttccttcttttttttttggcgcctgccccagtggattcacatttgtttgagggccacattgctaattaagttgggagagagaagcattcataaagtgaatgtaaagtgaatgtattttataccaagattgaaaaggtcttaaaggtgagaacccctataatgagacatttgttgcagtgctcaccttacgttgcacagttgcacttattaaaagcaacaaattccaataataactgaaaacacagttttctgtttattaaacacctaataagggtcctttattgtttgaaggtactgtgaacatttacttaaatcaagctccttttctggactcttcttttttttattttattttatttttttgagacagagtctggctctgtcgcccaagctggagcgcagtggcacgatctcggctcactgcaagctccacctcccgggttcatgccattctcctgcttcagcctcccgagtagctgggactacaggcgcccatcaccatgcccggctaattttttgtattttttagtagagatagggtttcaccgtgttagccaggatggccttgatctcttgacctcgtgatccacccgcctcggcctcccaaagtgctgggattacaggcgtgagccaccacgcccggctcttttctggactcttaacaatcagtagccactgttgataagtctgcaaatatgagaggtaaacactatagagggagagaatgaacagcctggtacaatgagatattttcttaagaaagaacttcccaggctgactggactttggattgatcctccactaggcttcacagaaatccctaagactttgcattacagtattacatttcttttacatttcctagaataaaggtggtaagagaatagatcaatgaatttttaagactgtaagagagctaaagaagtcaagagtgttctcttgaagagggtctgggcgtaggaggctgtgtgctttgggtgaatatctttgctcaggtacttcctaacagaaaagcagtgtgaatgcataacaggtaaactgaggccaggtttatccacatgagactactcataggtaatctgggagccagaacagttattccagtggaatcatctgtgctgacctttggaacttatctttggaaattgcttttatagctggcagttggatccaaattttcagttgggttcaccacacaaaggaatgtctgttttgcaccaggcccaaggttaggccctggagataagaacataataaagatacagttcttacaccttagttctctgaatggggtgtgggggaggagagtggagagagagggactgaaggagagagaaacatatgcagtgaactgtaattaaataacaaattatgtaaaataggtatagacaaaatgaaacaaacactgcctgattttagggaactttaaagaaaggatagaaatttgattaaggggccgggagcagtggctcacgcctgtaatcccagcactttgggaggccgaggtgggcagaccacctgaggttgggagtttgagaccagcctgaccaacatggagaaactccgtctctactaaaaatacaaaattagccgggcgtcgtggcgcatgcccacaatcccagctatactcgggaggctgaggcaggagaatcacttgaacctgggaggcggaggttgtggtgagccgagattgtgccattgcactccagcctgggcaacaaaagcaaaactctgtttcaaaaaaaaaaattttttttttgattaagggaaaagatagagaagcttatacatagagaataactggaggtgtgaatgtcaggatgcaagtacatgaataaaagtggcaggaatagaaaataggtcaaaatgtaactagagcattcttttgtaaggaatggtgagagagaagggtcctttgggaccacattgtaaggaccatttgctctttcagtaactgtttattgaaggattgtagcagaccaggggccagacatggtttgctagccctttggaggtagcaaaagccaactttaatgatgtgtgagaagtttttgttcctgccccagggcctttgcacatgtcccccctctccagtgttagccttccttccccccttttttgccccgttaatttgtattcatcctttagagctcagcttggaaattacttcctcaaggaatactttggccgcccgcccttttcctagttatgaacttgatatcttcgtaccacttgccccaattataaataaataataataataattattattttttgagacagagtctcgctctgtcgcccaagctggaatgcagtggaatgatcttggctcactgcaacctccgcctaccaggttcaagcaattctcttgcctcagcctcctgagtagctgggactacaggcgcccaccaccatgcctggctaatttttgtatttgtagtagagacaaggtttcaccatattggccaggctggtctcgaactcctgaccttgtgatccacctgcctcagcctcccaaagtgctgggattacaggcgtgagccactgcgcccggccctcaataaataattatattattgtttaatatttgctttgtgtttaatctctctcttgtttgctcctctttccccaacacagtgtcagatgcatagttggcatgcaataaatatttgctgaaagaatgactgaagcgggtccattgaatttagcaataagcagttactgttactgttgaccttggtgagacagtttcagagaaatggtgggggtggaagccagattgcagtgcattatgcagaaagtgggaagtgaggaaatgagggcagcgatgtgtagacaactttttttcttttttctttttttttgagttggagtttcactcttgcccaggctggagtgcaatggcgagatctcagctcactgcaacctctgcctcccgggttcaagccattctcctgcctcagcctcctgagtagctgggattacaggcatgcaccaccatgcctggctaattttgtatttttggtagagatgtggtttctccatgttggtcatggctggtctcaaattcccgacctcaggtgatccacccgcctcagcctcccaaagtactgggattacaggcatgagccaccgtgcccagcctctttttttttttttttttttttttttttgagacagagtctcgctctgttgcccaggcgtgagtgcagtggcgagattactgcaacctccacctcctgggttcaagcgattctcctgcctcagcttcctgagtagctgggactacaggcgtgcaccaccatgcccagccaatttttgtagttttagtagaggtggggttttaccatgttggccaggctggtctcaaactcctgacctcaagtgatccacccaccttggcctcccaagacaactttttcatacatgtggctgtgaaggggagaaacaaggatggtagctagaggagaaaaggatccagtggtttggttttttttaaaattagattttaaaactaaattagattttaaaacttaacgagtttgcatgtcatccttgcgcaggggccatgctaaccttctgtgtctcagtccaattttaatgtatgtgctgctgaagcgagagtaccagaggtttttttgatggcagtgacttgaacttatttaaaagataaggaggagccagtgagggagaggggtgctgtaaagataactaaaagtgcacttcttctaagaagtaagatggaatgggatccagaacaggggtgtcataccgagtagcccagcctttgttccgtggacactggggagtctaacccagagctgagatagcttgcagtgtggatgagccagctgagtacagcagatagggaaaagaagccaaaaatctgaagtagggctggggtgaaggacagggaagggctagagagacatttggaaagtgaaaccaggtggatatgagaggagagagtagagggtcttgatttcgggtctttcatgcttaacccaaagcaggtactaaagtatgtgttgattgaatgtctttgggtttctcaagactggagaaagcagggcaagctctggagggtatggcaataacaagttatcttgaatatcctcatggtggaaagtcctgatcctgtttgaattttggaaatagaaatcattcagagccaagagattgaattgttgagtaagtgggtggtcaggttacagacttaattttgggttaaaaagtaaaaacaagaaacaaggtgtggctctaaaataatgagatgtgctgggggtggggcatggcagctcataaactgaccctgaaagctcttacatgtaagagttccaaaaatatttccaaaacttggaagattcatttggatgtttgtgttcattaaaatctctcactaattcattgtcttgtccactgtccgtaacccaacctgggattggtttgagtgagtctctcagactttctgccttggagtttgtgagagagatggcatactctgtgaccactgtcaccctaaaaccaaaaaggcccctcttgacaaggagtctgaggattttagacccaggaagaatgagtgatgggcatatatatatcctattactgaggcatgagaagagtggaatgggtgggttgaggtggtgttttaaggcctcttgccagcttgtttaactcttctctggggaacgagggggacaactgtgtacattggctgctccagaatgatgttgagcaatcttgaagtgccaggagctgtgctttgtctattcatggcccctgtgcctgtgaaacagggttcggtgactgtcactgtgcctgtggcagtctgtagttacccagagagaacaaagctgcatacacagagcgcacaagggagtcttgtaacaaccttgtcctgctttctagggctgagtcaggtaccacagcttgatctcagctgtcctctttatttcaagaagttgacatctgagccataccaggagtattgtattttgtttgaggcctctctttttggaggaacatggaccgactctgtgcttttgtctatgctggtctctgagctcacacaacccttcaccctcctttctcagccagtgataggtaagtcttccctatcttgcaaggctcagctcaagtgtcagcttcctctacaaagactttcctggttcccctcattggagtgaacaagagttgacatggtagaatggaaagagcagaagctttagaatgagccagacctgagtatgaatgctagatccaccacttagctagtcaaccctgccccctgcctcaagttttaattttcctatccattaagtgaatataataatacctgtgtcacaggattattttgagaattaaatgagattaggtctatgaaagcacctagcagagttcttggcatataggaggcattcattaaatatttgttcttccccttttatacccattacttttctttttctgaactaaaataatacttggttctatctctgaaataacatccaagtgaaaaatcaacaacatgaaagagcagttcttttccagtggatttgcttcttaaggagcagagattatgtaatctaacagcctccaacatacaaagagctttgtatctagaacaggggtccccagcccctggaccgccaactggtacgggtctgtagcctgttaggaaccaggctgcacagcaggaggtgagcggcgggccagtgagcattgctgcctgagctctgcctcctgtcagatcagtggtggcattagattctcataggagtgtgaaccctattgtgaactgcacatgcaagggatctgggttgcatgctccttatgagaatctcactaatggctgatgatctgagttggaacagtttgataccaaaaccatccccccgccccccaacccccagcctagggtccgtggaaaaattggcccctggtgccaaaaaggttgaggactgctgatctagaggaccaatttattcaatgttggttgagtaaatgagctcttggattaggtgatggaaaaatctgaaaaaacagggcttttgaggaataggaaaaggcagtaacatgtttaacccagagagaagtttctggctgttggctgggaatagtcataggaagggctgacactgaaaagaaggagattgtgttcgtttcttcttctcagagctataagcaaaggctgaaagttctagaaaaaggcaagttttgtttcagtagaaaaaaggataatcagaaccatttttagaaaatggaatgagactacttttgaggccatgagttccttgtccctggagagatgagcagaggttggacaagtgcttaccagagatcttgtggaggcagaaactgtgcatctagcagagcattggcctaaccctttcaaatgagatgctgttaactcagtcttattctacatggtaggaatcctgtccctttgcctcctgctactttgggcctctcaacctcttggttttgtgtgcaggtgaagatgtctggaggtgtccaggctgtggggaccacattgctccaagccagatatggtacaggactgtcaacgaaacctggcacggctcttgcttccggtaggtgggcctatcctcccatctttaccagtgtactatgggccaagcactatttcatgttctgatggaaaacacagaaacaagcttctgagttgagaatttcaatcttagggtggggaaaggaatgtaccaaggaagagctcatgaccaaacctcaagtgtggcccccctgaacccaggttaaattggaagagccataaatgggccagctggaggcagggtggggggatgagaggagccctttccagggttgtcccatatccctcactttatgggtgaggaaactgaggcccaggaagagtgactttcctgtggctgcactacagattatgcaggtacttcaagagttgtttgtattcttattttattttattttattttattttattttattttattttatgagagggattcttgctgttgcccaggctggagtgcagtggtgcaatctcggctcactgcaatctctgcctgctgggttcaagtgatttttctgccttagcttcctgagtagctgagatgacaggcacctgccaccatgcgcagctaatttttgtattttagtggagacgggggtttcaacatgttggtcaggctggtcttgaactcctgacctcaaatgatgcacccacctcgacctcccaaagtgctggaatcacaggcgtgaaccactgtgcccagccaagagttgtttttagtgtggttggcagagccagctcttcctcaccacaggttgcctccctaggttcctactttttgttactagctttattatagctacattattattattattgttattattattgagacagagtctcgctctgtcgcccaggctggtgtacagtgatgtgatcttggctcactgcaacctctgccccccgagttcaagcaattctcctgcttcagcccccctagtaggtgggactccaggcacctgccaccacgcccagctaatttttgtatttttagtagaggcggggtttcaccttgttggccaggctggtctcaaactcctgacctcaggtgatccgcctgcctcggcctcccaaaatgttgggattacaggcatgagccaccgcgccctgcctatagctacattatttttgtaggcagctcagtttcttaaaaattatacagacttcaaatcagatttgttcctgctgtctgaggctcagtttcttcatctggaaaatggatggtaataatcttgttgagattgaatgaaataatatatgcagtgtatccagtacatggtagacacccagtgaatggttattccttcctcccatcggattggaattctcaagggtgggaacttgtctttatattcttcacaacgtaaaatagttgaaatttgttggtggaaagaagagcagtccactccagaggctggatgggcatgcctggcccccaaggtctgaagtggtagggctgtgcctatatcctgagaatgagatagactaggcaggcaccttgtgctgtagattccagctcctgcacatagctcttgttgtaaaacatccctgtgcttataccaagtaattgagttgacctttaaacacttgcctcttccctgggaaccatataggggattggcctggagacgtctggcctctggaagagttggaaagcaaccatcattattatcctttcctttcagctataactcagagctctcaagtcttttctgtggatcttattgccttggttcttgccccttttactcccagggaagttgattctgtcttttctgttccatttagtatgacaggagcagagaatgtcagagctgtaagggaccttatagttaaagcctttggctggtcctttcattttatagctgggactaataagtaacgtcaaaacccaatgagttcacagattgggtctcgccttggcatgtaacccatatgttcatattcttgctgttttcctatgtgtatgaatattttctatccaaaataagcaggacagggtagagcaagttaatctttggaatttctggattctcttagagctaaaaaacttcagaactagaagaaaccacccactatatggtataacccattcatatcacagatgaggcctgaaaccaaaaagacttgctcaggccatggatgacaagagctggccctagcactgaactcttgggtcatttgtaggtctagtcagatgctagcttgttagctctgtgcgtgcgtgtgtgtgtgtgtgtgtgtgtgtgtgtgagatagagacagaaagataacatatgtacacaaatacataaagaggaagtagacacgttagcatggtagataagagtacaggcaggccaggcgtggtggctcacgcctgtaatcccagcactttgggaggccaaggcaggtggatcacctgaggtcaggaattcgagaccagcctgaccaacatggtgaaaccccatctctactaaatacagaaaaaaattagcttggcatggtggcacatgcctgtaatcccagctacttgggaagctgaagcaggagaatcgcttgaatccgggaagcagaagttgcagtgagccgagattgtgccattacagtctagcctgggcaacaagagggaaactccatcgcaaaaaaacaaccaccaccaagagtacaggctatggaatgagactatggttttaaatcctggctttgcaatttattaactagccttaagtgacttccctgagcttcaggcaccaatctgtaaaatgaggataagaatattactcatgccacatggttgttagggaggattaaatgtgataacctatataaagtggctagcatagcatctgacatatagaaaactcttaatagggccggacgtggtggcttatgcctgtaatcctagcactctgggaggccgaggcagaaggatcgcttgagcccatgagcccaggagtttgagaccagcctggccaacatggcaaaactccacctctacaaaaaatacaaaaatattagccaggcgtgatggcacacacctgtagtcccagctacttgggaagctgaggagcgatgattacctgagcccagggatatcaaggctgtagtgagctgtgatcatgccactgtactccatccagctgggggacagagtgaaacccctgtctcaaaacaaaacaaatgaaaaaaaaaacccttaataatcagtaactgtcactttatattatgttgtgagtgtgtgtctatatacacctatatgtatacatttctcttattacacattcattggtgatctgatgtggagccccagggattaagggcaactttgaactaccctgacacaatcaagccaaatatcattcccgtggaggaagtagagtatctaggttctgtctcctagttgcagctttaccttgaggacagagactctaatccagctgtgctgaaggagcacatctcctgacttctgagctttcccctggtaaattcaaactggatgtcacggcgccctcagatagagcctggtaatttgccctggggagagtgactgtcttttggatctaatttgacttttgccccagttggaggaaaatcttcagggctaggaaggattgtatttgtctgaccccagagataacctgggttttgaggaacatggggcatcaacctgaatggtcttgtaagatctctcccacgccagcttgccagtgtttctctgatgaatttagagtacctgagtagtgcaggcctgctgggaggaggactctccctctgtgctactcagagaaattcattcttcaaggcccccttccagccttgctcttacccagctgggctacagttacaataaaggaaatgacttttcttctccccttcccccagtacctttgttttcctagtcacagggtggggctggatattgaatggagaaattgctggggtccatcctaaactcctcccctcatctctcccttacattaccccattcttctgtctgcagccacatccataatcctgcctctgttagccttccgacagaccctcaggtgcccaggacaacaggaagctacttaaagctggaacctcagactgtgcaatggaggccagtgacaaaactgaaagtagctctgtcagtaattgtgctggtgcgattaggcagctggccagaatcttttggatctcctggacatatggctgactagtcctcccaagccttcccaacaggcctcttttttttcctttttttcttttcttttttttctttctttctttctttctttttttttttttttttaggctagtgaagtgaaattgtgggagtggaaaaggaacaaagaaatcggtaactggtagtgatcaattacttgtaaacactattgtacttggaccagcccagtaggccttttttaaaactctgagttacctctctttcctttccttgagcagtgccattaattctgtatctggggcaatcctttctgatgttctctggacctggctctctctccttaggagaggccaggagagtagccagagagcatgtcatttgtagctgaggttaaagtgtggagctatcaatggtgacctggcctcttggcatgttagcaagccagaggaccttgacaacttttttgatgattgtccgttcaccctgatcaaaggtgtttggcttaggaggagggaagaaaagctacccctattagtcttgatggccccagcgtgggtctctattgcttgacctggttcctagcagcattatcagaaggaaaatccaccgctcttaaggctcctgggaactttcaggacttcctttctcaggattgcaaacataagactatttgagctttcacttttgaaaagcggttactaatacctatactctgggaaagggctaatgcagatagaagactgtggtcactgcatcaggcaacagaccatttccgctaaatttagtgactccaggaaggccagtgaagaaataacacacgtagcaaccagagactgtgttgtaatatgttggctgacagcagggtactttctgtgatgctgaaagccacattcattttctctcccctcatccccatctaagcaagcctggtagaatcataattacagtaataggtaccacttattgagtactctgtgccagacaccctcctgagcatacgacatgcatagcacatttaatccttacaatgacttaataaaatgtagtactagtcttacctacttcgagaatagggaaatggaggttacttgtttaaagtcacagagctaataggtagcatagctgagatttgaactcaggcattcttactccttgcctgcaagagtctcttggcattcttgaatgcaagcatatttcttaacctcactgaggctcagtttcctcttatataatatggggtaaagagccctcaccctgcctgccacacactggtagtgtcagataacattgaagggtgttagtttaaaggcttcatggactctataatgtcaacaaaagtgctgttaactttcttctgggtctcaggctcctgatgtagagtcagtggagcaaccctgccatctgctgttatgctgttgatgttgctgccacacttactaacctaaacctttgattctggctgtggccttctccagaaggtgtttactcatttgtccagtttatcttttaggaaacagccagcccgtagatcattaaggctggctattggacagggggctggggcctgcctgacagaggaaggaagggcagacatctggttcttcctctgcccctacaagagactccagcctgaccacagagtggtactcctaggatgtagcagcagcatatgagcttgaatgtgccttaatcctgctctttactttgagaagagagaactaaggacccacagatgtttcacagcttctataggaggcagaggtagaaaaatggagagagatgaggccagagatagataactgatattaattaaacgttgtattaagaacctcacttagattatctgattcaatcttcataataaccctgcaacccccacctttttttgagacagggtcttgctctgttgtccaggctacagtgcactggtacaatcatagttcactgcagtgtcaacctcctgagctcaagcaatcctcccacctcagccttgcaagcagcttggactacaggcgtgccaccacaccttgccatttttttttattttaagtagaaacaaggtcttattaatactatgttgcccaggctggtcttgaactccagcgatcctcctgccccagcctcccaaagtgcttgggattacggaagtaagccactgtgcctggccagtgcaacccccattttatactaaaacaggaaggcccagaaaggtttggagtaacttgtccagggtcacacagatgatatttgaactcaggtctccctggctcccaagagagtctgctttccactaggactcccaggagaaaaaaaaaaaaaaaacagtagacttggagacagaaaatctgatttgagtcttagttgagctaggctaactgtgtaactgtgggcaagttccttagcccctgtgagcctcagtttcttatctgtaaaatgtcataaaagaaatccatctcatggagtagttgtgatgatcaaggactctgaaaacattagaatggtttaatgtgaaggattagcagcagcacatggcaacattgtgcatcttatattaactatccaaatatatcaagcgtcatttgctatatataaaagtcatcaaattaggcactgtgggggatacggagttggcatactagcctggcctcttaattaattcattaattagcttatttatttttgagataggtcttgctctattgcccaggctggagtgcagtggcatgatgatagcttactatagcctcaatctcccaggcttaaacaatcctcctgagtagctgggactacaggcacacactaccatgcccagctaatttttttttaattttttgtagagacagggtcttgctctgttgcccaggctggtctcaaactcctgggctcgagatcctcccacctgggcctcacaaagtgttgggattacaggtatgagccacggcacctggcctggtctcttaactggttccctaagacagctggaaatagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattagtatctgtcagtcttgaaatgttctcttcccttggctttcatgacattccacactctcctggttttctcttacctctctggtaatacctgtttgcttatccttctttgtccagctctgggatgttaccattccttcaggcgtgctgttttctccttaggcagtcttacacacactcatgacttccttccattgtcctccacacactgatgaccctaaaatcagtatctccagcctaaacctttccactgagttctagacccatatgttgtactatcaacctggcttgtccatttgaatgtcttccaggcacttcagactctcttctctagactttgctggactttcactcttccccctaaaactggctcctcttccactgaaacatgtatgtcattgagaggcaccaccatccacccagtgcctaagccagaaacctaggaatccttgatacctgttctctctcatcctgcatatccaagcctatcagttttatctctaaattatattttggtaggtttacttctttccttttctcccaccaccaccctgctccaagctaccatcatctcacctggatgtctgcaatagcctcatctcccacagccactctgcaccccctaatctgttctctatagagcagttggaaggagtgatttttgttgtttgttttgttttgttttagacagagtctcactctgttccccaggctggagtgcagtggcacaatttcggctcactgcaacttctgcctcccgggtttaagcaattctcctgcctcagcctcccaagtagctgggattaaggcaccggcccccatacccagctaatttttatatttttagtagagatggggttttgccatgttggccaagctagtctcgaactcctgacctcaagtgatccacctgcctcggcctcccaaagtgctgggattacaggtgtgagccactgcacctggctggaaggagtgatcttaaaaaaaaaaaaaacaaaaaaaaacttgactgtgtcactctgtgttgtctctcctaccttgtatacttccacaacttcccagtgttcttggataaagaccaaaatccttaacttggccaggcgcggtggctcacacctatcatctcagcactttgggaggccgaggcaggcagatcatgaagtcaagagattgagaccatcctggccaacatggtgaaaccccatctctactaaaaatacaaaaattagctggtcgtggtggcgtgtgcctgtagtcccagctacttgggaggctgaggcaggagaatcacttgaacctgggaggcagaggttgcagtgagcccagatcacgccactgcactccagcctggtgacagagtaagactccatctcaaaaaaaaaaaaaaaaaaaaaaattccttaatttggcctacagtagagccctccgtaatgtggcctctctccacatctccacaacctcctgctccctgcacttcagcctcacctctcttctggacaggccctccttctgacaagggctttgttcattctgctccctctgcctagaatgcccccttactctgttcacttaactcctgcttatcgtttagatctttacctggatggctcagagaaatatagaagtaattcctcaccctgaaaaataggttaggtccctgttttatgttttcatagacctttcctttgaggctttttttaaaaaagtagttttaatctcacatttattcatgtgatcatctccttaatgatatcttaagacctctaatagaacaatttggtcatggactgtggggtttttgcccctcattgtgtcagcactgagcatattgttggcataggagggatatttgttgaatgaattgctagaggtggccaagagatatgatgtaagtcaggcttttccctgcccttccccttccccttccccacatccttcctatagcagccaccgtggctgcagttactgtaaatggcaagacggaatcagttccggacattgggttgttttagaaaattgcctgcaagtgtcagggtgataagttaaagctttgtcttttgccctcagaggagctatcccatagtgagtagaagccagagaagctgaccccaggagtccttctttccagcagcaggtcttgagctgcacttctctgtagctacaatccaggcaggaacaagccctaggtacctccggagaggagggcaagagaggaagaatgagttcagctactctagccaccaaactgattatgaattgccctgaaatctgaaaaatttcaattccaatcgtaagtttgttttgtttcattttgttttcttaaattgtatatttgaaagatggcattaactaaagatatatattcaatatagagtggaaaaaatggaatacttgcatagtatcttttacttataggtgatttatgatggggagtggggtggataggttggcagttcccccaagaagttggaaatgaagtttgtcctctgtgagttgaactaattagatccacaagtaatgaaagcagtattgtgttgtagttaagagcacactctagaaccagattgcttagtttcaaatcctggttctgccttttattatctgtgtactttgggcaagttacttgccctttgtgtgcttcatttttctcatctagaaaatggagaggccaggcgtagtggctcatgcctataatcccagcactttgggaggccgaggtgggcagatcacctgaggtgagaagttcaagaccagcctggccaacatggtgaaaccctgtctctacaaaaatacaaaaattagccaggcatgatggcgggtgcctgtaatcccagctacccaggagcctgaggcgggagaaacacttgaacctggaaggcagaggttgtagtgagccaggattgcaccactgcactccagcctgggtgacaagagctagactcagtctaaaaaaaaaaaaaaaaaacaaactggagatacaggctgggtgcagggcttacacttataatatcagcactttgggaggcctaggcgggaggattgcttgaactcaggagtttcaagatcagtctgggtaacagagcaagacctcatccccacaaaaaatcaaaaatttagccaggcatggtggctcatgcctgtggtcccagctactcaggaggctgaggcgagaggattgcttgagcccaggaggttgaggctgcagtgaaccatgactgcaccactacatgccagcctggatgacagagcaagaccctatctcaaaaaaaaaaaaaaaaagaaacgagccaggcgcgtttgctcacgccagtaatcccagcactttgggaggccaaggcaggtggatcacttgaggtcaggagatcgagactagcctggccaacatggtgaaaccccatctcaactgaaaatacaaaaattagccaggcatggtggcatgctcctgtagtcccagctactcacttggaggctgaggcacgagaatcgcttgaacccaggaggcggaggttgcagtgggccaacatcatgtcactgcactccagcctgggagacagagcgagactctgtctcaataaataaataaacataaaataaaataaaataaaataaaataaaataaaaaaatatggaggccagcaggcacggtggctcacgcatgtaatcccagcactttgggaggccgaggggggcggatcacaaggtcaggagatcgagaccatcctggctaacacagtgaaaccgcgtctctactaaaaatacacaaaattagccaggcatggtggcaggcacctgtagtccctgctactcaggaggctgaggcaggagaatggcgtgaacccgggaggcggagcttgcagtgagctgagatcgcgccactgcagtccagcctgggcgacagagcaagactctgtctcaaaaaaaaaaaaaaaaatggaggttgggcgcggtggctcgcgcctgtaatcccagcactttgggaggtcgaggcgggcggatcacctgaggtcaggagttccagaccagcctggccaacatggtgaaaccttgtctctactaaaattacaaaaattagccaggcacgatggcaggcacctgtaatcccagctacttaggagactaaggcaggagaatagcttgaacctgggagatggaggttgcagtgtgctgagatcgcgccactgccctccagtagagtgagattccgtctcaaaaaaaaaaaaaaagaagaaatggagatacaaacttactacctacctccttacaacctaccctcacagtattactgtgaataaaagtgtgtgtagcactgggaacactattcacagagcactcatgaatgtttgttctttgttattagttactagagaggcaaatgtctgccagggctgaataatatgtgtgaattggtgattgtcgcacatatctaaagaagtagttatttttttcaattaaaacttagtttaaaaaccaatataaggccgagcgcagtggctcacacctgtaatcccagcactttgggaggccgaggtgggcagatcatttgaggtcaggagttcgagactagcctggccaacatggtgaaaccctgtctctgctaaaaaaaaaaaaaagtacaaaaattagccaggcatgatggcaggtccctgtaatcccagctacttgggaggccgaggcaggagaattgcttgaacccaggaggtggaggttgtagtgagccgagtttgtgccactgcacttcagcctgggtgacagagggagacactgtctcaaaaaaaaaaaaaaaaaaccaaaaccaatataataaataagtggccagcaatgaaacagaaagtgaaaagttagtgaagcaaaactagtactgtattcagataaagatgctgaatctagatttggtcaccagaatagggtcctttgtggcaacctgggctagtttggctgactcaccactgccaggatgaaatttctttcagtggctactcatttccctttattttaagtccatgctcacagagcaaccttctgatgcctaattcagcttcctgggatacttaataacaggaagggtctggaagtagtacctgtataggggatatgagtgttctgattttaatagtcaattcataagtgtacagagggtttgataaatggttaggtcagaaccatcacagaatgtctacacctctttggacattaggaaggtcaaaaacctgaaaggccaaaagctaggcctagattagggtcattcaccaagaaaacatcagccttgaagagttctctgggtggtccaccagtcaaccttcctttgatcacacctccttcctcgttgcttctttaagcattgacctgtaatgggtatggaattttttgctcacctaactccttccttttacagaggaagaagttgaagcccagagagatttaatggcttgcctaagatcacacgcagattttctgttaaccagggtgatttttcaggtgttccctgccagacgagggcttttttccttgaattgcctagagatttcttgagatatccgaagcatttttcccagtgcagcctggagaaggatgtccctgtcaacacagcatttgttactcaatgttagacattcaattttctaattagtatcatggagcaacagtggatgattatctataaggggttgcaattccatgcttatgtgcttacagcccatatagacaaatatcagctgttaaaatgacaaggcagtagagatgtggccccaggacaaaggcatactctgctgttagtgaacactagttggccagcaaatttcacatgggcatatacacggccaactgtagactttaggcatttatacccattcagagagccaaactggcaactaaagatcagcattctctttggcatttcagctttgcgttctgttaaaaatcactgcttgcttaaatacctctgatagctcttcactgcctgtaggcaactctttagcctagcagacttggtctttagtgctctgcccctactctcttccaccattctggcctcctgtctaattgctgcccatatgtgccatgcactagagcttacagacctgctcagcgttatatgagcataccatactctttatgcctcagtgcatttgcacatgttgttccttcaggccagaatgcctgttactgcctggcaatcagcctattagagtctgccaataccatcccatcttctgtggaggagccccccgccaaatccacccatacctctccccaccaatcagagacttcttctctctttgttattctcttcgttattctcttcatacctcagttatatccatttcagtatttgtttacacatctagcatcactcttagagtgtgaaattctccaagtgtggagccgtatctagtttgtctttgtatcccagagcttagcaaagtgcctagaatgtagtgggtgctcagagtgtttgctgggtgaatgatgtatttgttgaacgactctttggacacttgaataaagtccatccagtatgcaccattaccatctcttcgctctacaatattcttttaggcaagagcttatcttttgaggtgataagataagctcaaacttatgtagactaagacctcagtctgtaaatgtcatccctaagtcttaaaccatcaaaaccagggcctcaaggaatggcatgccttctgcaactgtagcaacctgctgtgcttattttgccgtgtttttcatttttcccccaaaagctagagtcccttctcccatgggcagtgctggaagtgtgctaacaaattctttctccatactgcttacgattacaaaaaaaaccctcagcatctcatgccagacttgagttaaggttgttttcttttgtgtgtcagctgtattctggtcatgacttcctgatgatgccctatagagattttgctgagatcagagggtgctccactgccatcagtagcactgactcttgcagaagcaccgtttctgaagttggctaatgtcatccctcacgtttgtttgtttgaaatttgttttagttccagagatagcactttcatggaatgacgctatcttctagaatcactttttttttttttttgagttggagtctcgctgtgtcgccaggctggagtgcagtggcacaatctcagctcactgcaatctccaccttccgggttcaagtgattcccctgcctcagcctcccgaggagctgttactacaggcgcacacccccactcctggctaattttatgtgttttagtagagacggggtttcaccgtgttggccaggatggtctcgatctcctgactttgtgatctgcctgcttcagcctcccaaagtgctgggattacaggtgtgagtcaccgcgcctggcctagaatcacctttttataccataacgtgagcaccactgccgcgtcaccaaggaaagagagaggcagctactgtggggttacaaatgggtaagagtggcaccaggaaggtgaaagtctctacttagccaaggcttaacaaaatgtcaatcaccaaacatttatttattaagctacgttcaggataagaagatgaacaagctatctgtacattcattttctcgtttgtaacaaggtaatgatagtgatctatcctgcctgcctctgagggttattgtgagaataaaatgaaatcaagtggaaaagcacttaggaaaaagaaaagcattggttttcaattgttagtgtggatcagaaacactggggcttgtttaaaatgcagattcttagccccagtctcagcgattctgattctgtatatctgaagtgggactcaggaatcttgattttcaacaagctgaccagagggtccaatgctgctattcctttagttacactttcagaaatattactgtaaatcaaatggcaagaataaaatagttatttgaggcagttttagtatgttggacctggagtccaaagacttgggtcaaactccagctttgtcagttcctagacctgtgaccttaaacagcaaccttctctgtgaaccttagttccctcaggaacggctctggtcacctcctgctgtactccattgatgactcaccacataaggctccctgggagtcccccaaacctttgctctcttaactccttttacagcctcctacatctcctgcaggtgctgtcttctcctcctttttccaggccctgctctgacacagcattcattctcctctgggaagggttccttcaatgtgtctccaagcacatcacacccaggaaggaccctgtggccatatctgtctatcaccagatcaaactacgtgaaggcaggcactaggtactgtcagtgcccagcataggcctggcccataccaggtgtccacagatgcctagtaaagaaacctatgattcaggacccccatgatgagcaactatagcactagaacagtgataataactaatgtttataatgcatcttcagtttacagagggcttttgtactcatcatctagttcagttcctgcaacaacctcttgaggaatatagcacaagcaggacaagggaagcccagagatgttaaataatttatccaagtttatgctgctgggaagggcagcactgaaattaaaagaaaagttttctgagctcaaatcccatgccctttcctcaatgtgagctctagcaaggtattcaggaatcctgcctctacagtttagagcctcaaattgctgggtatgttgagttcttgtatctgatttttctagatttcctgcccacattcttactgtctggatatcaggaaagagtttatcaaatgcctgtggaaatccaagataaggtctcatgatgagtaacccagtgaaaacatgaagtcaagtctaactagtcactactatttcactactgctgactcctgatgatcagctccttttctaagtgcttactgtccacttattccatcatctgcctagaatttatgtgaaggaatcaaagcaaaaggatcataaggcttcctttttccagtatgtttttcctcctttttgaaaactgggccagttagctatctccatttttatttcatgaatacatccccagcgcctggtatatagtagatatggaacattacactttggagatattgcacccattctccagtttctccaaagttactaacaatggttccatcactgtgccaacatattttcttttttcaatatattgggaaataattctcccagtctgaaaatctgaacacatttcatgtgacttggtatcctcatatgtcttgggcttccaattctccattcctagtttcaagttcatgaactgtaaaacaaaggattagactaaatctctaaagttctatccagatgccaaattcttttctctttccatgatacctaagatagatgccaaatattgtcttttacctggtgtttgtgaacatgacatcacattacaggagtagcagatactaaactctcactctgtaaaacactgactgagttccatgagccagatactgaagtgagcttgttcacatatgttctcatttaatgctcataaccctgtgaagctgggaattgctgggacattttatttatttatttattgagacggagtctggctctgtcacctaggctggtgtgcaatggcatgatcttggctcaccgcaacctccgcctcccgggttcaagcgattctcttgcctcagcctccgcagtagctgggattacgggcacacaccaccacatccagctaattttgtatttttagcagagatggagtttctccatgttggccaggttggtcacgaacacttgacctcaagtgatctgcctgcctcagcctcccaaagtgctgggattacaggcatgagccaccatgcctgcccgggacccttgttttagaaggatgactgctgctataatgtagaaagtgatttggaagaggggaggagtggggcacgaaagatggttagtagatgggggtggtaatgcttacctttcagtatttggaggcttcggagtcctcaaaaattctcttccttgattggagtcctcccagccaatagagggcttcacacaaacagtttcttgggttttgaattgtttgaccagagctttcttccgacaaaaggttggggtgattcattcacttaccacaccttgcctgaacattcacttggggctgccggttatgaaggctattgttctccagcctgtcacagacgctttgaagacctgtgcctcagctggttctaaggagtcagtttgttcagctccgtgccaggtttccaacttatgaaatgtgctggagattaacacctctcctgccattttatccctactataattgccagtcaaaggattcctgcagttgcctctggcagccataactgatgaatgttctgccagctgctctgaggacctagaagagcagttttctatccaggaccagtttccaagggtgggagggtgaaatatatcctccagtgtgacatttcatctcccagtgatgggtggcttgggccctttgaagttggctctgaggaaccacacacttgggtctgagcagccagcagcttatcacatctggtgatcaatccttcaaaggttcctcctgaagtctgaatttttggaggtcaaatggattccacctgggaggggcttctgcttcaactcaggacatggggagaaggctgttcctcttccagggggaggcagttttcatggcattgagatgtcctctcacttattccccacccacccaccaagtcctttgtaagaggagtagggggagaggagagcgcctgcagcctcctgctcacattcctagacaccgactcactgagcccgtcgccgctggaacagcagagctgtgtgaaatgtcaagaggagttatgctcataggctccctggcctcagtctctttgtggcttgcatattcttccattagtactgtgttcatcacatggaaatcagagggtacaattaaaagataatttgctagtcccagacttaatttggggcccccttcttgcctgattgaattacaggggaacataatagatttttggtgagaaatagttgtctgtgtggctgggagaaagattgctcccagctctccagctgggcagccctttcagtatcccgtatgttatttccccacttccagcccacctcacctcctctgtggcccttgtgtgtcccctcggctaggatcctgacctcctgctcaagagtttaaactcaacttgagacccaaggaaaatagagagccctctgcaacctcataggggtgaaaaatgttgatgctgggagctatttagagacctaaccaaggcccagacagagagagtgacttgctaaaggccacatagctagcccacagtagttgtaacaatagtcttaatgatattaatggctaacatttatcaacctttaatgtgtcccagactttgtgccaagggcttacatgcagtgcattgtcgcattcaaacccagacagtctggctctgggcccaggctgagctttggtatagcatggtagaacgttgtctataatgtctagtctgggttcaaatcctggcttcacttctcacatttacagctgagtgacctcaggcaagtgatttaacctccctgtacctcagttgctttatctgtaaagagaaaaatcacagcactgtggaatagtgggggttaaaattcattcatacaagtagtgctgcaagcaatgtttaatacagggtgagcacctgttcagtgcttccttcttctggctgcctctggggctagagtgtggtgtcttcgtggtatagatagatagatatggctgagctctgcacaaacaccaagagctgttcttcactattagaggtagtaaacagagtggttgagctctgtggttctagaacagaggccggcaagctatggcccattgcctattttaatacggcctgtgattgattgattttttttttctttttgagacagagtttcactcttgttgcccaggctggaatgcaatggcacgaactcagctcaccgcaacctctgcctcctgggttcaagcgattctcctgtctcagcctctcgagtagctgggattacaggcatgtgccaccacgcctggctaatttttgtatttttagtagagacagggtttctccatgttggtcaggctagtctcgaacttccaacctcaggtgatctgcccgcctcagccttccaaagtgctgggattacaggcgtgagccaccatgactggcctgattgactgatttttttagtagagatagggtcttggtttgttacccaggctggtctcaaacttctggcttcaagcagtcctccctccttggcctctcgaatgctgggattataggcatgagccactatgcctggcctatatgacctgtgatttttaatggttaggggaaaaaaagcaaaagaatgctttgtgacatgtggaaattacatgaaactcaaatatcagtgtcccagcctgggcaacaaagtgagaccctgtctctacaaaaaataaaaaaaaataagccagggccgggcgcagtggctcacacctataatctcagcactttgggaggccgaggcaagtggatcacctgaggtcaggagttcaagaccagcctgaccaatatggtgaaaccctgtctgtactaaaaacacaaaaattagccgagcatggtggcatgcgcctgtagtcccagctacttgggaggctgagacaagagaattgcttgaacctgggaggcggaggttgcagtgagccaagatcgcgacactacactgcagcctgggcaacagagcgagactccgacacacgcacgcacgcacacacacacacacacacacacacacacacacgctgggtatggtggccagcacgtgtggtcccaggatgcactggaggcttaggtaggaggatcacttgagcttaggtggttgagactacaatgaaccatgtttataccactgcactttagccagggcaacagtgtgagactgaatctcaaaagaaaaaaaaaaaaaagaaaaaaatctttccataagtaaatatctgttggaacatagccatgtcccttagtttatgttttatatatggctgcttttgccctataatgacacaattgagtggccacgacagtctgtatggcctgcagagcctaagatatttgctctctggccctttacagaaaaagtgccttgacctgtgctctagagccatatgtaccaggtttgaaactcagcctcacagctgggtgtgatggcacgcatctgtagtcccagctactctggaggctgaggtgagaggatcacttgagtccagaaggtcgaggtcaagattgtagtgagccatgatggcatcaccgcactccagcctgagtgacagagagagaccctgactcaaaaaaaaaaaaacaaaaaaaaaaaacaccctcaccacttatcagctatttgtcttgagaatagtgacataacccctcagaacctatttcctaatctgttaaatgaggctgatgacgtttcctccttttactggcaatttaaacatgatggataataaatgctaagcacttaacacagggcctagaagatattaactgctcaataaatggtagcttcttaacagtattcaaacccatgtgctcttatcacatgcattgttgtccctgtgtccagttggtggaatgggaaaaggctcccttgtaaccccatctaccatctttatcagactttcctgccatggttcacagtaagagatagaagctgcacggtgacttctggctctttacaatggtgagcggtgtgtgcctggtaagggagagctgatgtcactgccccaaatccagtagtgagatctgagtgttctggtttcctccagcagccttgctttttcctttacaatcctgcaggcagggagacaagggctttctacatggtaggctctggtttggtcatcgtcacaactgggggctgttcaggtgggctcccattccagatacctaggcttatcaatcccttttggcaccccaggcctttttctccctcatgccccatttttcagtttgaaaagcatggttatcacaggacaagtagaagaagctccactgtccactgaggccaatggatggtgttctgcatgtgaacactcagtgaatagtgagtgaatgagagtaacctgggctccatcctatttgcagagagctttggaaaagatttttctccttaaagagccagaatgaagcctggtagtgggagagctccagctctagagtcacatgagcctacatttaaattccagccctgccactgactccctttttgaccttgagtgagttacctaatctctctgtacctcacttttcttgtctgtagagtgggaataattcctgtctcagagaaataaaagagtgcatatagtgtttgccacatggagacacatcaggtgtaggttaatactctgggccttgtttccttatttgcaacacagccctgccctggagtggaagtggcacctcccattggtcagctcttgaggctgtccccaggacaggcagagggagggaatgaatgggagccctagtgccaggacagaacagatggcagctcagagctaggatggctctctggacctgtctctcctaccagaggtccccccgtctggtgtggctcttcctggacctggcatcctctgctttttttttttttccacctccaagcagaattactgtcctgtaggcagctcctctgcttgaggacatctggggccagatatgttcacactctatcctgccttgcccttccctgagctcaggatggacgctcaattggtcccagttattgtctgcagcgcctgcctgcagcctcgatccagcccagctccaccccttgcctgcaaggtctgtttcctaacagctgctccaaccacacacctcggttctgcgggagcccctcctcttcctccctccctccctcattcaggggtgggactgaagaagaaggctaacttgacagcagcgcttctttcttagctagtcaccggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgagttggtctccgagttcccctctccatctctcctggcccctggtcctgagaggagggtggtctccctaaatctccttctcacttagtcctttaccatcggttctgccgggcagaagccagcggaggttatacccaaggagaatcggccttgtgaggtacccccattatgtcctggaagtggtgaggggagggatatacccagaaggaacttcttagggagctccagctccccttctatcccagacaaacctgaaggagcctccaaaagatgccactgacctgcccattgtagatgttactgcttccggggggaatagcccaaatagagtgctgtttccagctctcacatgtcttacctgcgggccatgctgcctgcccaggaatttgtcccaacaagcaggatgggcaggttttgccaaactgtggaaactggcaagtcctgggtgtgggtagcctggtacacagtaggcaccttataaacgtttgttctcttaatggcaggcacatttgcctctggccttgaagggcttctgagctcccaggtgaatgtagttgctggggaaagacctgggcgagtgcttctaagactggagcaatgggctttagagtgttcctgagctgctgggccagcccccacacctcctcagtccctaggcctaagtacctccacgagcctctctctgtggggcttctcagagggagatgtggaaactctacctctaacctggctttctttgctcattgccccactccacctcccatagaaactccccagggggtttctggccctctgggtcccttctgaatggagccattccaggctagggtggggtttgttttcattctttgggagcagcctgttgttccaaaaaggctgcctccccctcaccagtggtcctggtcgacttttcccttctggcttctctaagctaggtccagtgcccagatcttgctgccgggatactagtcaggtggccaggccctgggcagaaaagcagtgcaccatgtggttttgtggaatgaccggaccctggtagattgctgggaagtgtctggacagggggaagggggaagggaactggtcctcaatgctgactctaccaagcgccctgctagacactttatcctttaatctctcaacagcctaaagagattatatatccccattttacagatgaggcaaccagtttcaacagagttaacatatggagcctcactgggcagctttttctgtcttcctgactttctctcatccttcagggggctgcaggtttgttttcttctcctagtggagaggaaattctcaggtttgttttcctctcctagcagagagtaaaaaaagggatagtttgcctgacttgttgaaggtgtggctgagattgttttctaaagagccaatggaaattgatcttgagtttaggagaaagcttttacatgtggaattaagatgccaagtgttgaagtagccacatttcaggtcctcattaatttctcttaatcctgggaaggcagcttaggagaagggttgttcctttaggagccaggaactataccccttttacccttggagaggcagggaagccagggaggacacaacttctcaggaagaggagaagctagagcagatagtgaactctcaacctgaacctttaagggccagaccactaatgccacccaagtccacctgccgtttgtcttgttctgtcccaggctttctggagaacctgatcttcttgcccctacccccaagctccgtttgcccagctagagtctggggggtactgactgactttcgtagacattcttcccttccccaaataagaggccacattcctgaagtcacttctgaagagatagctgccacacagggctctttccccccagggagggaccacccagaccctctgctctcccaggtatccgttaccacatcactacctggtcagaaagctgtttctgccattagcccctccctcttttattataggatatcctcaagggctcctctttgggcctcagtttcatccttggcagaaagtagaagctagacttcttgggctcctgaacagggtccttgctggattctgtgaaacaaattaagttcttgaccctaggcctctgggggagtacaaagtctatgggagttctggggctgtggttgcaaggaaagtgacgcaaccagattccatggggacatgatcaggcgtgacatgtgagggaggaagagggagcaagggaatgaagaatacaacttctgtgtcccatacacccctgcctgacaggccatacatactcagcagagaatgcactgtctttcctaccacactagcgtgagaagtgagctgcaattaccactgtgcttccaagtaagaaaatacctcaaattggaatttacaaaagaggtaaattagggagtggcttttgtcggacatctttaaagcatttttctttttatagaatttcacttaatgtccaatactgatttaatgagcttgggtttacacattatctcttgaagaaaacaaatgaacctttgtgttccaaagcaatccatgtttaaagggaaaaaattatgcataactctgcccagcttcacagtaacctttggcaggtgccttaggtcctctgggactcttttccttatctgaaaaatgaaggacttggatcaggtgaatggttcccagctctgcaacttatgtggctcctcagaggcacacaagctcttttccattatttgccaaataatggaggccctgtctttaactgcagtacaactacacaaaatacttgaaactacagtcttcctggtttttggttggaactgaatcagtgcactctagcaacacttatttcttgctgttcgtaggcttcattatgtgtttggttaattttttaaaacaacaataacatattccataataattacagcttaattggcagactgtttcagtctataggatctgcaggaaggaggagtaataaagggatttttgactgagctcttatggaacagagtctctctaggcccctgtcatatctgcccttctgggccctggggaaaagttggcatccccagttgtggtgctctccaggtgccctcaggctgtggtggagggagcttcccattctctccttcagcccactcaattcagaggctaggggctgaaagaagcttctctacaactggctgttcactgggaggttaagggatgaccatccagccaggccttcctcaggacatgggagggcttatgctttaacatgtgtaaatccactgcaataatgactggttcttttaccccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggccaaggctggaggatcacctgagtccaggagtttaagaccagcctgggcaacatagggagaccctgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaagttgatttctatttggatagataaataaaggtcattttaggacctttctttttcacttacagaaatctgtttcattctgggctgagaagcaggtccatattgctaggcataggagaaaaaggggtctgtctgcatttgcccttggtggtctcaaattggggagggaaagaaatgaacacttactggctaccttctgtgagccaggcatcatgcaagacatctgtacataatttaattctcataaccccataagatattattagcaatgtacaagtgaggaaactgaggctcagagtcatgaagtaactggccttgggtgacacagatggtaaatggcagagaaggaatatggatccaggtcttgaaagagaaaatctcaactgattatcttttttaaaaaactcatatgttctctgctgactcaaaaggtctctgtgtggatctgggttgacccactgaactgaccatcagggttccatgcactttgtatctgcccaagccctcagaacccctcagtaatgttttggaagatgagttttggaggttgtccttaggcatagcctcagcgtatgtaggcctctaggtgatctcccctaacctgaggatttcagctcaattcactctggctcctcaggacagtgggatgactggttcagacctcagctttaccacctcccagctgggtactcttctacctacagccagggcagattttgactttcacttgaaacttccaaaaattgaaaggtagaaaaacagccttggctttgggaagaacgtatgatgtccatggcctctaagcatctgaggtgggacatgttcgagtagcaccttacagttccaaagtgtgttctgggttctttgtttaaaagaacagagactgctggggaattgaacactgtgaagtatatgaaggaggagaattgtgctatttaacattcagtacttgggctaaaggagaagcatcacgaagtgttaacactcaaagggtcttgagctgtcagggctccagcttccttattttcacaggtgagaatcctgaggctcagctgttgagatgtgctgtctcactccggtgacatagtacagtggatgtggctttgcagccaagcacacatagcttcacattccagctccatcaattatgtattgggcagctttgcagaatgatttgactttaactctgcttttcagtcttctgtaaaacagggataatcctgctaccgtagggttgtcaggattagagataatataaataaggtacctcatataggacctggattatggctggcattcaataaatagtagctgttaattgatagctaagctagaactctgaagtctaccatggcaacttcttaagtggtctgagaacccagttgtgttctgtggcaaaacacagcttagggatccatacccagccctcctgtcagctgttcaccttccagttcttcagagacatgtgtggcagtgactttggccacatagctggctgtgccctttaaaggcattccttgacacagatatgtggactggtgacgttgctctccagccaggtgttcttcccagcaggctggcctggctgtctcctgcatgcctgtacttgtttgtctccctgctccctctcctgggcctggccagagctacttgcagcaaacaaaagcaggatattggcaatggaaaggagggtgtgttctggtgctcccatgccctgcggcgcacataccattgcaagggcgtaacagagcccaggcctgcatttgggtgcaaataagtctgcacacagaagaaaagaaggacctggtgaccaggagccatggaacccttgtgctcccctacctgggctactggttcttgccactcctaccattttcagtttggaaatatttgttaaggctttgctcttccaggtcctttgcttggtgctgagtctaccaagagtaagtgggatgctgtttttgtcctcagggagctaacagtctagtgaagaagaaagatggttgcccaggaacttctaagtcagaaggcaggaggcaagaaggaagcccctgctcctactgccagccctctgttgggcaccccatagttcttcagaaccacatttaatcctcactgcaggccaggcatagtggctcacacctgtaatcgcagcacttcgggaggccaaggcgggcagatcacttgaggtcgggagttcgagaccagcctcaccaacatggggaaaccccgtctctactaaaaatagaaaaattagccgggtgtggtggcatgcgccagtaatcccagctactcaggaggctgaggtgggaaaatcacttgaactcgggaagcagaggttgcagtgagccgagattgtgccactgcactccagcctgggcgataagagcaaaattccatctcaaaaaaaaaaagaaaaaagaaaaaatcctcactgctaccttgaaagtaggtgatgacattgccatttcacaaatgagaagtgaaggggctagcccaagatcacttaggtggtaaatggtggtgctaagattagaacctcagatcatctagggaaaaacacagatatgcacagagttaaggggacccagggtattgtttgtcctcttgtttcacaggtggggaaacaacccagagagggaaaggggcttgtccaaggcaatttagcacccaagaacttgaacccatatctctctcctcctcatttagagctcatcccacatgtatcttatattgagaggagtgtgagccacataccaagaacagtcttcccctctgcctccaacctcactgtgcagttttgagacacttcacagccatactcttcatgccatacccagcccttaagaccctgaagttccccttccataagacaagtaggaaaagctatagggtaaaaatagccatcagtgtttgttgagcacccaggaggaattgggcactccagaaagataaagggattctcagggacttgcttctctagacttccctagctcagctgcttcaactcattcctgcccctcttctctacctcccgcagtgctcagaagtagtagaactcactgtggcctctcaccttgcattgttgagttttatttagactttctcttcctcaactcttcataagctcatgaaaggtgaagtagggtgccctgtgtatttatcttttatatctgcagtgcttagcaagttataataatgcacttgcctggcaaaaggctttctctcatacattagcttatttcctcttcacattggctctttgtagtaataggatgctattagttattttcaatgagagaaagctactaagagaagttgtccagctagtgacagtaagtggctgataaagtgagctgccattacattgtcatcatctttaatagaagttaacacatactgagtttctactatattgggtcttttttttttttttttttttttttttttttttttttttgagacggaatcttgctctgttgtccaggctggagtgcagtggtgcaattttgggtcaccacaacctccgcttcccaggttcaagcgattctcctgcctcagcctcctgagtagctgggactaccagtgcacgccaccacgcccggctaatttttgtatttttagtagagacagggtttcaccatgttggccaggctggtcttgaactcctgaccttgtgatctgcccgcctcagcctcccaaagtgctgggattacaggtgtgagccaccgcgccctgcctatattaggacttttatataagctatctctagctagctagctagctagctataatgttttttgagacagagtctgactctgtcacccaggctggagtgcagtggcgtgatctcgactcactgcaacctccacctcctgggttccagtgattctcctgcctcagcctcccgagtagctgggattataggtgcatgccaccacgcccagctaattttttgtatttttagtagaccaggtttcaccatgttggccaggctggtctcgaactcctgacttcaagtgatccacccgcctcggcctcccaaagtgctgggattataagcataagccactgtgcccagctgctctctatatttttaatacatattatttccattaattttcacagcagttcattttatagatgaggaaactaggccagagaagtaaaatatcttgcccaagatgatgtaactagtaagtggcaggatcaagattcaaaccaagcaatgttcaaacctcttggaagcaagaatgtggccactgtggaaggtgcaaggccttgacaacaagaatagggaaaagaaggagctagaaggaaagagatggcatgggctcagcaggccagggagctcttagctgtgtgtgttgggaagctcagaagggaggaagaggttgtctgtgcaggtaagtcctgagaacacaccagacttttgagaggtggagcttcatagccaggtcattaggggagaagggagctatagattttttttttttttttttttttttttttttttttagagacggggtcttactatgttgcccaggctggtcttgaactcctgggctcaagtgatcctcccacctcagcctcccaaagtgctgggattagaggcatcagccaccccgcccagcgagctatggatctaacatgtacatcttacacagtgctaatagaatgttgggtttcttccccaatattttattttgaaaaaaaattcaaatatatagaaaagttgaaaatgtagttcaaagaacacctacatacctttcacatagattcatgatttgttaatgttatgccactttgtatatatctctctccctctatctgtatacttttatttatttatttttgctgaactatttcagagtaacttaaaggcatcttgattttacccttgaacagttcaatatgtttctgctaagaattctcctatataagtcagatatcattacatctaagaaaattcacggcaattttacaatataatattatagtccaaatccatatttcctcagttgttccaaaaaatgttcatggctgtttccttttttaatctaaatttgaatccaagtttgaggcattgtatttggttgctgtgtctctagggtttttaaaatctgtgccttttcttctccccatgactttttagaagagtcaagaccggttattcttatagaataacccacattctagatttgcctgattagtttttttatacttaacgtatttttggcaagaacattacattggtaacgctgttggtgatgggtcagttttgaagagtggagatgattaaactgcttttgttcattgaagtatctgtcaagaccagagatccttaactggtgccataaataggtttcagagaatcctttatatatacaccctgtcccccacctaaattatatacacatcttctttatatattcatttttctaggggaggcttcttggcttttatcaaattctcagagggccccaagacccaaagaggttatgaaacactagtctgtccactgaggcaggcaacacagagctggtttctggggccttgttcagtctgaaccagcttcccttggggagatagcacaaggctgtaactttgccccatcttggctttggatcaaagaggactgtccattttgttgtcatacctaggaaccagggacagcttatgtggcctggttccagggatccaggagaatttcagttcttgtcttgcctttcaggtgttcagaatgccaggattccctcaccaactggtactatgagaaggatgggaagctctactgccccaaggactactgggggaagtttggggagttctgtcatgggtgctccctgctgatgacagggccttttatggtgagtgaatcccttcatatctgcccctcttggtcttcagagtccattgacagtgcttccagttccctgtggcctgttaatcttttagtctttccatcagccagggcatctccctttatttattcattcattcaactagcaggtatcaattgagcacctactaagtgaaaggtaagatccttccctcaaagacttaatagttgaacgttgggagtgggaggagaggcaggcagagaggagacacaatatagttggataaggacctccaaggagagtgttacaggctgagaggaggatatacttaggttgtctttagggaatcagaaaaggagactctggaataggctggcagagagaggggctacctcctatacctgctctggacaaacgactttaagcatagtgacagacttgccaaccctgtattggaagaactgatcttttttagtggggatgattacttctggggatttcttctcataactgagaccaaaacagttttgtgcagtctcagaaatgacaggaggtaccaatctgacacttcctttggaagctctagggcagagagtgaaagagtggattttgacgggggccttgcttggaggtcattcacccacccctgtcctcactccagcaacagtgataactcacttccttcctccctttgtacacccttctccccacctgctcacaggtggctggggagttcaagtaccacccagagtgctttgcctgtatgagctgcaaggtgatcattgaggatggggatgcatatgcactggtgcagcatgccaccctctactggtaagatagtggtcctttgtctatcctctcccatataagagtggctggcggggagggacagtggcagggtgagttgggcagaaggagtgttagggtagtcagagcattggattcttaccacagcagtgctcttaaccagctctttaacttgtaagcagaatgatttacacatgtctctaccctttttccttaccaaccttgaaaatgtcttcactctgccctgcaatcctcccagtgggaggcactcttcaaggacgatcccagaacattaaagtcaaagaccccttagagctcaccctgtccaaccaccttggttgataaaagaagtcagcctggggcccatggaatagaatagtacaagggcaaggttctcattgtgagtcaaaggtagagtgaagagaacccagaccatctcaccccaacccaggccagtgtttttccaaatataccacttgctgcagatctagctcagcacccccagtcccagcccaccctgagaacccaggctcctcattctgagcagccagctagaatcatgacaaagagggtggtagtgagactatgggtactgttgcttaaagccacatggtgcagtggttgctggggggcttctgtgtgggactctagcatcttattcccccctgtgccctctccccagtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagagtaagtattttgagaacccttcagcaggggttcttgagcagagtctgtaaatgggcctcagagggcttagacctccaaagtctcatgcagaactccctttattctcatctcatatctttctcctggaccccactatgctgtaaccgtacctgggccttggcacttactgttctctctgcccaggctacttcctacccgatacttaaggcaagaatcactcacctttcaggtgtcaggtttcaggtcatgtttgctctttgaaatcatctggcttgattatgtgtattagttgtttatcttctatcccctccactagaatgtaaattccagaagaaacttgctgtcttattcagtgctgcatgcccagggcttggaagagtacctggcatatagtaggagttgattgattattattttgtcagtcgagagaatgaatggagaaaatgtggtccatggcccaaaagaagttaagaccctatcctagattcaggccagagaccagatggagaaagagtctgtgtctatctaataccagtaatgtcgtacctctggccgcttaccatgtaaatattgattgtgtatctaccatgtgttggacactaggctagtgcttgcacagcaggtgaaagatactagagtttgggaagtcaggaggagctaaggtctgttctacaaccttattagatgaagaggagagggaattgtgttcagggcagagggagaagcatttctccaaaagtaggagtcttaatcatgtctgatgtaggttgagtgtggccagaaaaggggctgttaagtatagagggcctggattatgaaaatccagcagatccattgagagtttaagcagcaaggtgttgtgaccaagttaacattttagaaggatcactggtatggaggttggattggagaggggaaagcctaaaggtatagagactagttaggaagctattgtaggctgggcatggtggttcatgcctgtaatctcagcactttgggaggctgaggtgggaggattgcttgaggccaggagttgaagaccaacctggccaacatagcaagaccccgtctctgtttttcttaattaaaagaaaagtccagacgtagacatagtggctcacgcctgtaatgccagcactttgggaggccaaggtgggcagattgcttgaggtcaagagtttgggattaggccaggcgcagtggctcacgcctgtaatcccagcactttgggaggccgaggtgggcggatcacaaggtcaggagatcaagaccatcctggctaacacaatgaaaccccgtctctactaaaagtacaaaaattagccgggcatggtggcggacgcctgtagtcccagctactcgggaggctgaggcaggagaatggcatgaacctaggaggcggagcttgctgtgagcagagatcacgccactgcactccagcctgagcgacagagcgagactccatctcaaaaaaaaaaaagagtttgggattagcctggccaacatggcaaaaccccatctctacaaaaagtacaaaaaaattagctgggtatggtggtgcgcgcctgtaatcccagttactcaggaggctgaggcatgagaattgcttgagcctgggaggtggaggttgcagtgagcccagatcatgccactgcactccagcctggatgacagagtaagatgccatctcaaataaaaattaaaaacaaagtttaaaaaaaaaatagaagctattaccgtgatccaggtaagagatgtgaataactacaatgatggaaagaaggcagagttcttagagatgggagtaggagagatgagggaactccagattgggaagatgatgttcaagtttctggcttaggccacagggtgagtggcaattcccttcactgagatggggcatcctggaaaaggtgttgcctttctgtgtgggtatcctgggccccttaggggccactggtggcctgggacctggtaaaccttccctgcacaagcagaattggtcaagcaggtttttaggacatctttaccctgcctcaactcttgtctggcccagggtcaaccggatgcacatcagtcccaacaatcgaaacgccatccaccctggggaccgcatcctggagatcaatgggacccccgtccgcacacttcgagtggaggaggtagagtgtgtgtctaatctgtcttgtgagggtgggacatggaacagatcctctgagaaatcaggctgtagcctttaccttttcctacccccagcccatctctttgtcttagcattgagcctgtgaccactggtgacctatttcagcgtaacaggttcccagggtagcagggatggttgatggacgggagagctgacaggatgccaggcagagggcactgtgaggccactggcagctaaaggccaccattagacaagttgagcactggccacactgtgcctgagtcatctgggttggccatgggtggcctgggatggggcagcctgtgggagctttatactgctcttggccacaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggtgccacctcccaccctggctctgttctgtcctatgtctgtctctcggatgaagctgagctggctttcagaagcctgcagagttaggaaaggaaccagctggccagggacagactatgaggattgtgctgacccagctgcccctgtggggatcacagtttacagccagagcctgtgcggacccagctgtctgccaggtttccttagaaacctgagagtcagtctctgtccactgaactcctaagctggacaggaggcagtgatgctaaaccctgaagggcaacatggcctatggagaaagcatggagctcagagcctggagtaggggcacagataggattgaataaattgtgtagaaagactttgaaaacaataaagcaaaagatgaatgaacgttttttttagacttgagggaccaacaacccccaaaccccagattctgccaggtccatggggaaggagaagttgccttgagtggaagccccaagtagggagacttacagaaaagaagtcaagagcactggctcccaggcagaaatactgataccctactggggcttcaggctgagctcctcccttcacaaatcacttcatctctctgagcctgtttctgcatctgtgacataagatggtaagataaaggtggctgtctcaccaattatgtaaggattaaatgtggaaaaggacataaagttgtatagtgctgccatagggacagtgttcagtaaacgtgacacattcttagtatcactaagaatcaggttcttggccaggcaccgtggctcatgcctgtaatcccaacactctgggaggcctaggtcggaggatggcttgaacacaggagtttgagaccagcctgagcaacatagtgagacactgtctctacaaaaaaaaaataataataataattgtttttaattagatgggcagggcactgtggctcacacctgtaatcccagcactttgggaggccaaggccggaggattgcttgaggccaggagttcaggagcagcctgggccacattcctgtctctacaaagaataaaaaacttaactgggcatggtggcacatgcctgtaatcccagctactcaagaggctgaggaggaggattgcctgagcccaggagttcaagactgcagtgagccttgatcacaccactgtactacagcttgggcaacagagtgagaccttgtctccaaaaaaaaaagtttgtttttttttatccactctcctcaccaaacaaactgagtaagttagagccctctcagctggcatgtgttggaaacagtgccctctcattaaagtgctgccctcactcccattgcctcttggccttggtcagtatgatgaaattagtgggaggcagggcaacagagggcagggaagagctagaaatccatggcctggaaaagggaagatttgggagtggccaggtatctgtagagccaccatgcagaggaggggggcagctagccttgtgtgctctggtgggcatggtcagcaggaggcagagcaaaaggacaagggtaagtaaacctgtaggtcgggacaagccaagagccatccagcgtcagtcctctctgggtagcccaagtaaagcaggagcataccccagagagaaagttcgcagggctgttcacctgcagtgctgtggacttcaaccttcttgttccttcttcagtaagtgaaaataacagtcattgaccatgactattatcgaccgcttttgaaaatgtaaacatagtgactttattgctgtaaaaatcatacgtgtttatcatcttaaaattcaggaaacatggacaggtacaaagatgtgcaaaatatcatccaaaatcccatttgctggccaggcacggtggctcacgcctgtaatcccagcacattgggaggccgaggcgggcaaatcacttgaggtcaggagtttgagaccagcctggccaacatggtgaaaccctatctctactaaaaatacaataattaggctgggcgcagtggctcacgcctataatcccagcactttgggaggccgaggtgggcgaatcacaaggtcaggagtttgagactagcctggccaatatggtgaaaccccatctctactaaaaatacaaaaattagggccgggtgtggtggctcacgcctgtaatcccagcacttagggaggccgagacagatggatcgcgagatcaggagttcgagaccaacctagccaacatggtgaaaccccatctctactaaaaaaatacaaaaattattcggttgtggtggcacacgcctgtaatcccagctacttgggaggctgaggcaggagaatctcttgaacctgggaggcagaggttgcagtgagtggagatcccgccgttgcactccagcctgggcgacagagtgagactccatcaaaaaaaaaaaaaaaaaaaaaaaaattagccgggcgtggtggcgtgcacctatactcccagctacttgggaggctgaggcaggagaatcgcttgaacctggaaggcggaggtcgcagtgagccgagatcgtgccattgcacttcagcctgggcgacagagcgagactctgtctcaaaaataataataataacaataactagccgggcctggtggcacatgcctgtagtcccagttactcaggaggcggaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacattggaatgaacaggtgcccctaagtttcctccctccagggtttcttggccggtctctgaggactacacatccctactcccgtctttcctcatcttcaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgagcgcaggcaacaattgctttgctcttctgcccccagtccctctgtcactgtctttcggggatttctcatcacttggccccaccccacaccatgcaggatgccaggcctccttcctggctttgggtgttggtgtgagaggtatccttcacccccacccaggccacctaaggtcaatgttgctgttacagtgagcttgtggacctggagatccaggttgggttgagctgtgcctgtggccctcctgcctccagtcagtgggtgtttgttaggtgcctgcagacctcagtaccgggcatgctacaaggagcacacaggggaatggctcctgcctccctggtgaacagtctcagggactaacctctctctttctctcctcctcctcctcttctgctgagaactgggagggggggtcaggtaagacgtgtgtctcagcttgggggcagcagggctggagagctcacccccgatccacccagctccctggtgcatgtctttggcactgaccttcctgcccccagacttctgttcactcaggagactcacttctatgccaaatgaccagagcccctgcttggcttggcagcatcccctcctgccttcttccccacttcccttttctgggttcttgcctgtcctctgtgcatgcccagctctccaggaaagagggtttgcttccgtgtgagtcccatgttgctccacgctgcatcttccacacatgaactctgtcattctgacccggctcagtgtgccctccaagggatgggatggccagctgcatagattttctcaaacagttctccagaacttcctctggtctcagcaccattaacagtcaccctccctgtaggtgacacacaaagccacgggcaaagtgatggtcatgaaagagttaattcgatgtgatgaggagacccagaaaacttttctgactgaggtaagaagatggagggggcccgggaggttggtgtcaccattggaagagagaagaccttacaaataatggcttcaagagaaaatacagtttggaattactgtcttaaagactaagcagaaaagagccctagaggaatatcccactccctctaaattacagcgtaattatttgttcaatgaacacttactaaaagcaacacaaacagggtacaagggatgcagtaacaaaagatacagggttcagaagagctctcaggttatgaggatgatggacatgaaaacactccaatttagtacaactcaatgttataatcctcacctgaacgccctgctaagggagcctggaggggagctccctgagcactcacactccttgggcatttacagttttcactacccctcccaagttacttcatggagtaacttaagttggggacacctgtggtctgggtattgccctccaagccacttggccactcccaccccagttctcccaatgcagttccaagggtaaggcctatgaagccatctccatctatatggtggtggtcttccctcatcctgatcttagtgccctgtcatatcacaagataggaggtaggagatacaggtggtaacacttgtcaagctgattccttggagggaagaggtaaggaagacagtgagaagttaaccaccagctttccttggcttcccccacccccaggtgaaagtgatgcgcagcctggaccaccccaatgtgctcaagttcattggtgtgctgtacaaggataagaagctgaacctcctgacagagtacattgaggggggcacactgaaggactttctgcgcagtatggtgagcacaccaccccatagtctccaggagccttggtgggttgtcagacacctatgctatcactaccctaggagcttaaagggcagaggggccctgctttgcctccaaaggaccatgctgggtgggactgagcatacacagggaggcttcactgggagaccacattgacccatggggcctggaccacgagtgggacagggctcaacagcctctgaaaatcattccccattctgcaggatccgttcccctggcagcagaaggtcaggtttgccaaaggaatcgcctccggaatggtgagtcccaccaacaaacctgccagcagggcgagagtagggagaggtgtgagaattgtgggcttcactggaaggtagagaccccttcctatgcaacttgtgtgggctgggtcagcagctattcattgagtttgtctgtgtcactgaaactgaccccagccaactgttctcagttcacagccctgttttcaaagaattacacatctctaaaggcaaacagggcacggacaaggcaaactggagaggcaaactgtagcctgagatggcctgggcttgccatcacaggtattcaggtgctgagggcccttagaccaactagagcacctcactgcctaggaaatcaatgaaggggaaatgagttctagcggagccctgaaggatcagaattggataaagttcttattggcagagaggcaccaggattgaagtgacaggagcaaagacctgggaggaaagaggagaaaatcatctatttcacctggaaacaaatgattccaagcatagaaataataacagctgacaagtactgagtgccctctatatgctaggcactgggctgagggattaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttttttgtttttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctgggctcaagcattcctcctgcctcgccctcccaaagtgttgggattacagttgtgagccaccatgcccggcaggaaaagatttttaagcaagaaagcttaagagctgtggtttttccaaaatgagtctgggctggcacagtggctcatgcctgtaatcccagcacttttttgggaggccgaggtgagtggatcacttgaggtcaggagtttgagaccagcctggccaactggtgaaaccctgtttctactaaagaaaaaaatgcaaaaattagctgggcgtggtggtgcacgcctgtagtcccagctactcaggaggccgaggcaggagaatagcttgaacctgggaggcagaagttgcagtgagccaagatcacaccactgcattccagcctgggtgacagagtgagacttcatctcaaaaaaaaaaaaaaagagagactgatatggttagtacattggggtggaatgcggagggtccagggaatggagccctgcatagggggctaatgaaacatttcaaatttctgaattaaggtagtggctgtggggacaggagcctgggaggccgggtggagtcagaatggagagactggttggcaatgagggaacaggaggaggaggaggaggagttacgagtggcttgaggtgtcacttaccagacatttgggggatgggggatagccatgattgttgagcaactggtttgggaagagctagcattgatccctgctgttctgtgctagcagaacctatcagcatcttctgggcaggaaactggctccatgagactggcttagggagaggctgctagtcacctaatctgcagagaaggggcagctggagctgtgggacagaagaggcatccatgtagctggtgggggtgtctcagcttgtgaagaggagatggctttgagcagggctgacactgaaaaggctggaagaaaaaaacagacacacaagagtctcaggatcaggtagcataggaaagttgtggacagtctttgaggagcactccctcaggcaggcaggcaggcaggtcatgagctatagcgattcaggaagagctccctgggtgtgtgagcagctccaggagcctaagggatgaaagtagtattgcagggggctggagagcaaggagtggctccttctacatttgcaagggaaggagaaaggaagttgctcctgagagtggtaagagtcagtggtggaggcctggagaggagacataacaaacaaatttgttgacaaacattttggtaggaagggggagagcttaaagtttagacagtggggaaggtggagtcttagaggaggtgaatgtctgaaagacagagctagctggagcaagaagtcacttctctgttgcaggcaggaaggatccaaagtggctcaagccagagattgggagagtggggaggagggagcagcctggatctaagtaaaatgggtagaggtggagggggtgctgcaacggccagggttttctgaagttggggacattaggagagagctgtgagggctttggccagccactgtgctagtgattggtgaaccaaaggatgggcaggagatggcagcagggaagcagaggaagtccaggcttcctgttggtattgggacaagggagaggccataggaggccctggccctgttgtccaggttgggttctgaagctgggtgggcatggcctggtaggagagcatctatggcgcccaattccagattcagggtctagttgatttgctggccctgtagcctcagctcatgcttctgttccaggcctatttgcactctatgtgcatcatccaccgggatctgaactcgcacaactgcctcatcaagttggtatgtcccactgctctgggcctggcctccagggtcctatccttcctggcttccttgtcacaaaggaggctgacttgtcccctctggctagagggcagaggtgttgcctaggagctcctatctttcccttcctgcttcttccaatgcccttctctgtcctctgggagctccgagacacacacagacataatttcaccttctctcattagcaacctttgaaataatttgattagaagggacttcagaagtttgttgactatatgtagaaaaccctgtcattttacctgcttttgccccatagtagtcttgtaaaacagttcattgctgaccccattttacagtggtggcacctgaagcctcagcctgaggccaccgagctagtaaatttacagggaccagtttgagaccagcattcctcccactgcccctcagctgtggtggttacaatgttgtttgtcttactgacttgctatctggcttcctgggtgtctaccggctggccctggctctgccctctagacccacaccacgcaatcttcattcctttcccacatgactgccctgtagctattcaaagagcttgtctcccccaagtctccccatctactgcctccaccttgcctttttctgtcttatcctggttctagccactgcctgaaatcattttaggaataagacaggacagggaaaaacaaaagcaaccccctgtcccacctctgagttccactctccaagtccctgagcctcacctccagggctccagtggctctgccatgaacccactgtgggctgggagtctgctgtgcacagataccagaccctcagaaacacaaatgccaagtgtgtctgtttttttgttttgttttgttttgttttttagatggagtctcattctgtttcccaggctggagtgcagtggtgcaatcttggcttactgcagcctctacctcccgggttctagtgattcttctgcttcagcctcccaagtagctaggactacaggcgtgtgccaccacgcccagctaatttttttttttttttttttgtatttttagtagagacggggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggtgagtcctgaagccctggaggggacacccgcagagggaggacagatgctgcccttgcatcagagccctgggaattccaggggaggcctgtgaagcgtaggaccggatacccagagctgaggatatttttcccttgccaggtggggcctcacgatttagctcctgagctcagggggctgggaactgatcagtgtcccatcatgggggataaggtgagttctgactgtggcatttgtgcctcagggatcgctaagagctcaggctattgtcccagctttagccttctctctccatggtgagaactgaagtgtggtgccctctggtggataatgctcaaaccaaccagagatgctggttgggattcttgaaatcagggttgtgaggcctcagaaatggtctgaatacaatccattttggagtctgaggcccagagaagttcagtgaattgcctaggagcatacagctgcctaatggcagaggctagatgaaccctagtctggttcttttccactttaacgtgcagtttcatcctaggcagtgttatgttataagggctctccaaggcagttcacctacagctgaggaaggactattttcaggtggtgtctgcgcaggacagcctgtggggtgtccctacagaacctgttctagccctagttcttagctgtggcttagattgaccctagacccagtgcagagcaggtaagggatgtaaacttaacagtgtgctctcctgtgttccccaaggaaagagctatgatgagacggtggatatcttctcctttgggatcgttctctgtgaggtgagctctggcaccaaggccatgcccgaggcagcaggcctagcagctctgccttccctcggaactggggcatctcctcctagggatgactagcttgactaaaatcaacatgggtgtagggttttatggtttataacgcatctgcacatctttgccacgttcgtgtttcattggtcttaagagaaggactggcagggtttttttgttttagatggagcctcacttcgttgcccaggctggagtgcagtggcacaatctgggctcactgcaacctctgccttctgggttcaagtgattctcctgcctcagcctcccaagtagctgggactaccggcacacaccaccatgcccggctaatttttgtatttttagtagagacagggtttcaccatgttggccaggctggtcttgaactccggacctcaggtgatccgcctgcctcagcctctaaaagtgctggaattaataggcgtgagctacctcgcccggccaggtttttttttttttttttttagttgaggaaactgaggcttggaagagggcagtggcttgcacatggtcgataaggggcagatgagactcagaattccagaaggaagggcaagagactgttcatgtggctgtctagctagctcttgggccaaatgtagcccttctcagttcccttcaagtagaagtagccactctaggaagtgtcagccctgtgccaggtaccacgtggacagagtgaggaatcttggaaagattcctacctttaggagtttagtcaggtgacagcatatctcagcgactcaaacacacacacattcaaagccttctgtaattcctacaaagttgtgaggggtagaggagaggagagacaagggatggttaggataatgaaggaatgttttgtttttgtttttgtttttgagatggagtttcactctgtcacccaggctggagtgcagaggtgcaatcttggctcactgcagcctccgcctcccaggttcaagcaatcctcctgcctcagcctcccaagtagctgggactacaggtgtgcgccaccacgcctggctaatttttgtattttcagtagagacagggtttcgccatattggccaggctggtctcaaatgcctgacctcaggtgatccacccgcttcagcctcccaaagtgctgagattacaggcatgagctaccgtgcctggccatgaaggaagatttgttttaaaaaattgttttctttaatattaattgaacacctctgttcagagcactgggctggtgccagagggtttcagacatgaatcagatccagcacctcatagagccttaactctggcacacacacacagccacaaggagacacagacaaggcagggtaggatgagtggaagctaggagcagatgctgatttggaacacttggcttctgcagtgaagccccttcttagtcctcttcagtaacccagctctcagtggatacaggtctggattagtaagatttggagagatgattggggattggggagagctctctaacctattttaccacctcctcttctgccattcttcctgtccacatcccagcatccctttcccttgccaagtatctgtggcctctgtagtcctttgtaaacagctgtcttcttaccctacagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcaggttggtatcctgcctttttctcccagctcacagggtcctgggacgtttgcctctgtctaaggccacccctgagccctctgcaagcacaggggtgagagaagccttgaggtcaagaatgtggctgtcaacccctgagccatctgacaacacatatgtacaggttggagaagagagaggtaaagacatagcagcaagtaatctggataggacacagaaacacagccattaaaagaaagtttaaaagaaggaaattcacccaaaccatttgaatacagtaagtgtattcatctttcgatattcccctgtccatatctacacatatacttttttttatagtaaatagttctgtattttgccctgcatttcccttgtgtttactatccagtcttcctgtttatcatttttgtcgacaacatgaaattctattgagagactgtctgaacatattgtaatgtagatgttcaggtttttccagtttctctttacaataggtatttaactacagtgagcagttttatgcatttagctaatttctcctttgaggaagtattttcaaaattacctttattcttctcaggtaataatttcattattaccaaagttaccctaggtcttttcaagtgtgtggttaaaaaacgagaatctggctgggcgcgatggctcacacctgtaatcccagcactttgggaggctgaggctggtggatcacctgaggtctggagttcgagaccagcctggccaacatggtgaaaccccatctctactaaaaatacaaaacttagccaggcatggtggcaggtgcctgtaaccccagctacttgggaggctgaggcaggagaattgcttgaacccaggggcggaggttgcagtgagccgatatcacgccattgcactccagcctcggcaacaagagtgaaactctgtctcaaaaatggggttcttttcctgccatcaaaaatcatgtttcttttaaaaacaagttcaaacattaccaaagtttatagcacaggaaatacgtcttctgtaatctcccttaaccaatatatccctcaacattctcctcacccccaactccaccctcccaggataaccagttgggacataatctttatttaaaaatggtttccggatagagaaagcgcttcggcggcggcagccccggcggcggccgcaggggacaaagggcgggcggatcggcggggagggggcggggcgcgaccaggccaggcccgggggctccgcatgctgcagctgcccccgggcgcccccgccgccgccctcgccgcggagccggcgagctaacctgagccagccggcgggcgtcacggaggcggcggcacaaggaggggccccacgcgcgcacgtggccccggaggccgccgtggcggacagcggcaccgcggggggcgcggcgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtcgtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcactactaggtgaaggagtttgcctgacgttatacaaccaggaagtagctgagcctagatcccttccacccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggc

SEQ ID NO: 36111 - DNA, 46265 bp, Homo sapiens
ggcggagagggagcctggtgggcgggcggggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggtgggtgaggggcggcggcgggggaggggacgactctgctgagctcagcctctcttggtggatgtggggcggggcgctcgagtaggacccgacgccaaggggagggggctgacctgtgcttggtccaccccaggtaggggctgagagaggcttgaggtggaagtgggggtcgggcactctgacctggtcgaggaggggctagggtttgaaccggggacagagtctaggtgagctggggcttgggagctattagcgtagaggatccgggttcggttgctctggcgagggctccagcatcacaggtgaggagcagagctcagcttgtgctcgaggatgggggtgcggggtcctggggcgatcggggctcgggctggagcgggtggggtcgcgtcttttcgggtgtaggggagctgcgttttcaggggcctcggtttcctcccgtctccgggcgggtgcgggaaagaggggcgccaggggcgggcggcggggcggaacggggcggggcggcgggcccagcgaggggggtggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagaggtgggtgcgccctggcggcgcggggctctgagaagcgccagactgggggcagcgaagtctgggaaggcatggaagagcgctggccagggacctcgggtcccgcgcagggcctgggaagggccgacagcagatgcggagtgacctggaggcagcgcacggtgatccctactcccgcctcgttttgcctccttgccaaaaagtctggatctgagcctgtccaccgagaggctctgcactggaccctccctaggtagctggggccaccacctgcctgcagttggcgtcaggcatgccgttggccttccctattgtcagcagaggtttgcagggcccctggtattccagcactgtggtttcacagaaacccgggacaagctccaggcatcgccaagttctagcttgtccgttatgctttgagcttgttaggatgccatgcagggacaaagaggcaaagagccctgagctttgctggcagtctgtctgggctgtcttgcttctcacgcaatgtgggggcagagagggaagatggaaatcctaaatctcagcactgtatgagtggcggatgaggatgtgagaggcaataccccctccacccaacggtgcttcgcagttgtcctgggctcaggtcctcctctgccactcagtagcagggtgacattgggcaaatcacttaatatcctgcacctcagtttcctgtgaaaactaaatgtcatatgtgtgggcacctggcaaataataggtgcgcagtatttagcaactattatcagataccacgtaccttagcaaagctttgcctagcttctgccctccatcacctccaggtctaaacactgtgggtggcatcttgttctgtcctctgtgatggtcacccacgcatgcccagggctacctgggcaggagatgtcactggcccagccctctctgtccaggtgcggggagctgtccctggtgcctggggtgggtagacgagggcgctgttgggcccaatctgtctgtagcctgtgtctatagagaggagccagccgtcctagtgaaggaggcagcaggaaaccaatgtccaggctggttggcccctggtctggcttcacatccctgctgtctccagcttggtatcccccttgggcaaagccttaactgctggcccttgtctccagggggaagttgctttctccccgcagccctttgtagtttggggctatttcccctcccactccacaacagttagcctgtggagtttgcagtgaaggggacactggcttgggaggcagtgaaatgggcagctgtccttgaatatccactggacaggcccagatcccaagacccatgatctttctgtttcctgtgattgcaaaacaatcatgacatggagcaattaaagggtgaagggattcagataggccccaatgtctcttaactctgaagcttcaaattaagtggagtttgcgatgcctctggttctagggcaggccatctgctttccttatccaggttctaggactttccctcctgcacacagattcccggtaagactgactaagtcacctctatgtttttgtgcccaccactgttcagaaagtctgcagcgtggtcctctgacgttagcttctgctgagggaggagagagagcagcaagggcctcttcagtctcttcttgagcagagcagtgtggggccctgcaggacctagtgacggggtcttctccatgggcgttatccagactggattttgccaagaccccagctttcctccctctagatgtggctctgtgtaggttggggggttgaagtttgccaccagaggagatgtgggctgtcacttctaccccactctttcccagaggtgtcctcgctggcagtgggtacaggatgagagaggttgaacaccatggcaggagaagaggcagtggggactgatcttccctcatccagtccctgctctgccacttactggcagtggcgttccgagtctgaagtggagaaatgtccacctcttagggtaaggtgagaattaaatgagatgctgcaagtaaagcaaatcagtgagttgggcagctatccctgaatatccactggtcaggtcaagagcccaagatccatgatctttgtttcctgtgattgtgaaactatcatgacatggaacaattaaagggtgaagggagtcatataggccccaatgtctcttaattctgcagcttcacattaaattgagcttgtgatgcctgtggttctagggcaggccatccgctgactgcctaaaatggggttaagtaaaacacgtgtaatacaggtagcttcattgtgaggtggctgtaaggatgacatgatggttggttgtaaataagtaacaggtatcattatcatcatattactagtagcagtatgaatgataacaaaacaccaccagtgtctgatagattctcaatagaatctatcttttaaaatatcttaaaccattaaaaattaatcttaaaatactaaaagtatcttttagatatcttcaaaaatagaatacaatagattgtttatagactgtggttattagtattaactttttatggagactgccagaatgccccttaaatctcatagacacaggataattggtatttagtcattgttcaggggaaaaatcaaaaaggacctgggccagatgcattatttgtttacatagttgcatcatgaatctcctttcaagtaacttcctggcattttcaatgttccagctgaatcaagctgttgaagtttcttaaggggaaggacaaagcagctctacttgtacggtcattattggaagaagcatatcttcaaatggcttcaatctgggatattcctactttcctgtgttactattctatatgctaccaatcaatgtattctgaagatataaccactctgtttctcttcccctcatggccagctctgtaactcactcattttagaatgttcttactgcctcacctatttctagtataagtgccatttttaatagcattcacattcctcctctacgaaacagctccttttgcttcagacttaagtttctcttgctagtggcaataatagttgcggttgaaatttccattgtaaactatacttttagttcatggtgccatttaagaaccgttagctcattctgttgaaataaccagtggctgagctggggggaaaagttttataaaaagactatctgctcagcccagagcaaattctaggtttggcaacttgtcaattatttgaaagccaaactgatcccgatgggaattttaaaaacactaaaacattctcttcttctgggtgggtcctctccagcaccttcagtcttctcttcccagctgcgtttttttctatcactaaccagagtggtaactgagggcaaggtctcttgcttttaaggaaagtcattttcttgcccattctgtcttctatctcagccccatttcttctcccctttgttggcaagctcttcaaacacatgatatcaacgtttgctcttcctgcttctagctacccattcccttcagaactctggcaaaacaaactggcttcttttgaaactgccttcttaaagggcaacgggataaaaacagctgtgtatttcatctttgctgtgtggcagatagtgtatttcatgccttaattcttatatctactgcatggtccttaattcttatatctactcaacaaagtaggacatccctattttacaaatgagcaagctgaggtttagtgggatttggtatcttgcctaaagtcatacagctactttgtggcagagccaggacttgaacccaccttgtctgactccagaatcctggtactttccactgtgttcctctccgaggatgctgcaggcaatgacttgactcatccagtggccatctctcagtggcttgatccttctagacttacttagagtctttcccacctagaaggtccctacccagaagtagctcccatctcctagacctaattctagccagtttcctgactcccctctctttctgatctactctttatattatttcccgctagccttctggaacttgctgtagttccctattgcctggaacggagattcttaactggggatcagagggaggggagggaaatcctcagaataagctgagaagctcagtattatcagggtctcatctctagaaatcccaattcagcgggtccatgaagggatccagatatttcaattttttaaacttttggacctgactctataatcacagcttccccataaggttgctgtcaatattcaaggcatctggtgcaacgattcagacatagtcaatgccccaaacgtgggggctattcttagaattattattgttatgaagccagtgatcaagtttcaaacatctcagcagccatctcagaatccagcacagaatccggccactgactaagtccttgttgagcctttctgcctaccaggttttattcacactttgagtttagtgtttttgtgttgcattgagacatgaggattctttcctcttatcctcctcagctcagcaaacctggtggttaaagcaggggctcatctagtacttaaggggatagaggacagtgatttttttaaataggaaaatactttttgagcattctttttttaaaaaaaaaaataaaaatagcccatagtcaaaaatagcagtgttggaaaattgccaactatcaggtagaacttctctttatgtctctcatttgaaattcctagagagagtatctgattggctcaattagtctatgatgtggcctccctttgggtcccatcagctgtgaacaggtcacattgtcaactgcccactcatcagggccaggacagggtgataaatctggaaggggaagttgggtgcagatatgaggtcactgacatatctggtatagatgttatggaggatcatgagcctggaggatttgaggacagcggccacagaaacctgacaccagagaagaacatatgtctaagaaaaccagaaggggtgtggaccccgggaactggttaactgaccctctacaagggtccctctgcaaggatttcctacaagggtacccaagaggcagggtggggaaggagacacagctgtggccctacctacagggagtaagtttaggttccctccatcccctgcccctaccaccaccaacaacaggtcctgccacaaggacttaagagcaaatagtgcatttgggatgtgctcccagaaaacactagcaggaagtgggaaagtgtgatgaaagaaaagaaagacaatcaacggtatgcctgcaagcaggttactgctgcgggcatctagggctccatcccactggaggccttagagggagactacgtagattctacatgctttagaattgtctagcgaagggagaagctagactgtttacctccatagcctgactttcattgctaggatgttaactccctagcacttggggcctctgcagactgagcatactttggtgaccagagaatgcccttagagagagacagagttggttgttggcatgtatgggaactggatacaggtgacctccagattaggccaccaggagatgggcagggcatcaacagcgtttacacagggagcaagactatctagtggaaacatgttcaaatcccagctccaccctttcctgggactctggggaatttatctagtcttcctgagcctcagtttccctatttgtaatatgaggacattaacacccacctcccagagagattgtgaaatttcagtgctgtaatatatgtaaaacgtttagtataatatcttatcatagtgagtactcaattaatagcacctatcatcatcatcattctttgtaattgcagaagaggaaaagagattttttttttctaatagactcccatttgtaacaagagaaaataattttgctcattaaattcatcgatttaatagatggaggcagaagaagctgctgctaaagcatcatcagaagtgaacctggcaaacttacctcccagctatcacaatgagaccaacacagacacgaaggttggaaataataccatccatgtgcaccgagaaattcacaaggtaagtcatggccagcacttcctcctttctatagcgtccagtcccatcagagaactaaggtttttttgtttttgttttttcatatgtgatatacaagcccaaactacaattgagaatcataaaatacggattgaaaaccagaaggagtaatgttactgttgaaagtggagagacaatgtatcaggatcctaaactgcttttgcatttaagcaatatatttaaccctaggcttcctgccagtccagttgcaaaggaatgtccagggattatcatttgaaaaaaagaaagcaaatggatgtctaaaaagaccctttcctagcattgaatttgtggaattgatctatctcataggtttttatgtatgtctcagtagggattgaactagagaccacgttatggtgaattgaccctcacttttttttaggaggaatgtaaatatgatataccccatttccaaaagagaaaccctctattgctacaaaattaaacattcatttgctggttgtgcgttcaaaattctctggcagatttttccccaaactaccacctgtctgagtgcctcttggtctaacatcatgcatgaagaacaaccaggttcattcccattctgacctgatgaagaaagctctgcgaatctcaaggaacatagcactagcttgcccctggtgtgcaatgtctctgacatgatttggcaggactctgagagcaaactgcctaagactgtgtgctgtgcagatattcagggtcgttgtgagcatcccgttgtgaatatcaaggagcctgccccctcagctcatctcaactcctgtatgcaagggcacagcggcttcacaaaagagcctcacttttattcaagtgcgcaggtaattacttggttgaaacaatagtgtttctgtgccacagagcacaggggatcaatttttatgtgccgttgccttgactataaagtagcttttgtgtggcacttctcccactgcatcgtaatgggctcagttagatggatcagctacagagtgtatgagctccaggtaaatgaatgagtttaccagcagaacataatcctttggcattgctcatctgcgactgaagaatgttttcaaagtgattattttattcttgtcaaaaccaatatcaagtcaccctttctgacaataattaaccaacaggtttggttgcttcttaaagttgcttcttgtaaatgtcagaatacctgagtgtgagtcctaccagtcactagtgtgatttttgaaaaattacttaaatgtcctgattctcactaactgcatttatgaaataaggatatcaacatctacattacagtactgtgcaggtcaaatgacctaaagtatatgaaagttcattgtaaactgtaaaatgcaatgcaaaaaccactgttcttattattactgttattataataaagttatgttattaacacagtgcagtagttctcaactgggcttcatagaacaccaatcttcggccaggcgtgatggctcaggcctgtaatcccagcactttgggaggctaaggtgggaggatcacttgaggttaggagttcgagaccagcctggccaacatggtgaaaccccacttctaataaaaatacaaaaaaaaaaaaattagccttagccaggcatggtgtcacgtgcctgtaatcccagcgacttgggaaactgaggtaggagaatcacttgaacctggaagcagaggttgcagtgagctgagatcatgccactgcattccagcctgggtgacagagtgagactgtcaaaaaaaagaaaaaaaaaaaaggccaggcacggtggcttatgcctatattcccagcactttgggaggccaaggcgggcggatcacctgagatcaggagctcgagaccagcctggccaacatggcgaaaccccgtctctactaaaactacaaaaattagctgggcatggtggcacgcacctgtagtcccagctactcagggaggctgaggcaggagaatcacttgaacctgggaggcggaggttgcagtgagccgagatcatcgcaactgtactccagcctgggcgacagagcaagactctgtgtcaaaagacaaacaaacaaacaaacaaacaaacaaacaaacaaaaaacactagtcttatgcaatgcttcatagaagaaaagctcagtagtagtgaaacatatttggaaaacttatattcttcttctggagatttaagaaaaatacaaattgttataataaaggttctaataagtcatgcaacccatacatacaggcttgtagaattttttaaaatatgacattggttaattctataaaaagctggcataagggaagagatcatttcatttggggagaggaattatttaggtaaaaatgtaaaagcatgatccttaccttctcagaactagaatttgattcccttctgcaaattagtacaagagtttccactttgtcctggctgcagattcctgtgatattagagctggcagagaccttaaagatgatgtagaagtgagaaaattttgaatcagagaaaatatattatttgttccaggtgacatactggatggttactggtgactgagacagagctcaaagaacacacatctcctagctcctgagccagcatcttttcttttctttctttctgtttgtttgtttgtttgtttgtttttgagatggagtctcactctatcgcccaggctggagtagtgcagtggcacgatttcggctcactgcaacctctgcagcccaggttcaagcaattctcctgcctcagcctcccgagtagctgggattatcggcacttgccactgcggctaaattttgtatttttagtagagatggggtttcatcatcttggccaggtgaccaaacatcttttctgtccttcatcaccaaatcagacattagacgtgacctttcatggggcaggaagagcctgggttctatgttagacttagctttgagatgcctgcacctggttacagaatcagaggcagacaacagatacaggaatattggaacaagtctctcattatacttaagcactttcttgatgaaatgaagccattcactagaatcaggtagggctgctagagctaaaacctgcttgcttttcatgaaagatgttcaactagacacccggacttgtaatttgtcaagaataaagttgacattgagtttcaagtgatgagccccaagaaagatagaaacagctgacatctttgagcgttttgctgggtgttgggcactgtgcggagtgatttctccggatcccctcatttcctcctcatagcaaccctatgaggctgactctgttaacatttcttatcactgtgcccaggggaagccgtccatctcacagctgctgggggaactcagaaagaaagcggggtgggcatttcgactcctatactggatgctcctgcttcagaaaatggaaaacaaaacacaaaaacaacttgtggaatttgtccagaattccttctattttactttcattgtacctgttttactgtagataaccaacaaccagactggacaaatggtcttttcagagacagttatcacatctgtgggagacgaagaaggcagaaggagccacgtaagttgtcatttcccctgtacttgcaccccgacacactcactttcattttcattcagtttgccaacggtgactcagatgcagaccatgggcaggagggagtggagtctcctgactcatttctaccgagattcctcaattcctacatttctgaccagacagatgtagtccagtaataggttacgcctccatgcacttggcatcagaaacaacagataaattaaattgagtggtcatttgcatggcccatctcagctttgaaaggggtacaagcaagtaccagacatgttgactgggactttggtgacagacctggtatatcaggtggtgaaatccccagagcctctgggatggctaccccttttgtaatcccacctctggtcaggcagtttgagaacaagaacaccttatgtggagcccaatggcctaaagggaaaaaggctgtccgtccatttcagggctaggctctggtcccctgtgattgcttctgttagttgcctgttgcttagtccagaggcagaatggatttcacagaattatagagtcataaatttggaaggggtgtgatttcacagaaagaaaacctgggcacaggtcgggggatgacctggttggagtcactggtctcctaactcccagaccagaggtggctcaactgcacttcatcttcccaaagatgtgctggcttcggatgcacacgcctgctgaggagtggccagtagggaaagtgtgccttttttatgaagaccgcaggaagccagcccccctgtatccagatggcttctgcatcctcagccttcccagggcactgaggattttccccacgtcttttggtctgatggctggaagggaaccagtgtatggatgacagttaggaaggtggtgttgtcttggttagtagctgatggattttttcccttgtttttggcacagtgctcaaatgtcgggagctggccgacttttacagcaggctgggggtccagttggctgtgtgcaatggtagtgacccaccattcaagggagcctgggggtggggggaggaactgtgcagtgaagtggaaagggcactggctgtggagtctagaagccccactttgtcacctaccagctagggcacctcagtttccccatcttcaagtgaggtaacaatgtccatcatctctcccagccctggcagcacagaagcctctgaaacgaagacaaggttaactaaggcagggatggaagagaggccagcttccaaaggtgggaagagacagaagaaagcgaaacaaaaaccagccagccataggatatgatcatggtcctagagggaagtggtttagagtgttccagatctcaggctgtgtttggggtttgatgaaggattgaggcctgagcagagttgtagaatgaaaagggcaggggaagcagaactcacagggttgtgaattaggaaaaaagcctttgttctcaagtcaaaaaaaaaacttaatctatcattgcacagtggtacagccgtgctctggggagggcagcagccgtgcctgtgagcacatctgcacctgctggaggaccaggatacatgaggctgccacatgtgcatcccatgctgccccctccaccctttcaacgaggcagctgtgtccagttggtgccttttagtcaggggaattgagactctgagagtgggatggggaagagacaagatcttgaacatgccaacggcatgcttgggcagaaactggttgcctgcacttttgtgctgtgcgtcacttttcccaagcatgcatggccttgtgtgcccctgtgtactcttcttcagatctcatctgggaggcccagaatctccacacctgcccatgcagtctcctgtggccattgtgtgatggaggacacaccttggcccccttgtgcagggcagaatccgaacccccatatatgacagtcctgagaatgcaggtggttgaggggagcggtagatctaagtaccccacgtgctggaggcttgccaaggttgtcttgatgcctgctcagaccctcaggatatgagcatattgggtttctatattagactaaattcccgtttgattaactagaagggagaccgggggcatctgatgcttgactggccagtgtctggacgatcccacagggctttggagaacagattggagacttttcaagccacctgtgagagggatgtcatatggcagagaatgtggcatgtgtgcctcactacagagctgcactcattgtcgcagtggcttgcccagagtcagggaagtgagatctagtttcccatgtccacagaattctttcattcaaccaccttcctattcctgggcacagttgacctagggcttcagcatcgtctttacagagacacggagctctttttctgaatagaaagcgataaagactagtttactatcaagggaatgcaggggactgtgctttgtcaccactgtctcattctatcattttgcaatttaatgatttttacggttggctctgaaatgcattacacactgcagaaactttctctcagagggaagagggagatttgccatggcaaaggacaaatcatatgctgtgtaaaccttaaaatactatacacaggagctaaattttcaggctttaaaatttccagatgaattcaattaaaagtaatcaccacacaccctatactttcctttcttcaaatgctggaatgtgtattaatatgtatggtaacccaaggaggctcacagaaagttacagagagtaacactatatgcctgtctagaaattgcacgcagtatgtgcaaggccctggtctgtttttacactcaaatgtgaaaggggaaaaggacaccgcagcatgttattgcacctgagcacatcggctgatggggatgtggtctgacgtctttgttgtgaggcttttgtgctgcacttgccgcctgccccacttcacaggtcagtggcagacgcactgatgctgtgctgcttttgtgctgggggtgaggaggaaagcagcatgtagaagctagagcatgggcaagccattgtgcattaataggacacttttatttatggaactgtgtccccacataggaagagtctggcccaattagccaaggcacccttttgatggcacacatcctctttaaaatccaactcgcagctacaaggcttagcatgtcctgcatgtgttgtctttccggtttcacattagaatttgatgttaaaaagtgagctggtttgtatctaggtgaacacacctagtttgaagctgtaagttcaatcatgtacaagcaactccaagatactggccaagacttctggaaggctgggtacagtggcccacacctgtagtcccagcactttggagggctgaggtgggaggatcacttgaagacaggagttcaagaccaaccggggtaagaaattgagacccctctacaaaaaataaaaaataaaaaaaattagccgggcctggtggcacatgcctgtggttccagccactcaggaggctgaggcaggaggatcgcttgagcccaggcggtcgaggctgcagtgagctatgattgcatcactgcactccagcctgggtgacaggaataccctgtctctagaaacaaacaaacaacagacttctgaggccacaggtggatggattttcctgccaaaagcacccagcttgtagagatttgagtgacccagtgacttccttgttccagtgctggtggtggctttttgactgggacagcagactgaggacagtgatcatggagttcccgacaagtgtgagaccgcatgttgtgaggatactttgcctgttaaatgtattggagcctggggagaatggggtgttaagccgtgaccgtcttttcccatggagcagtgagcacccatcacctccaagcccagagagaccaagcgagaaagtgggagaggaaagtgtatcgaacaagcgctttctccctcaggtctcaagttcttccctgaccccaacttgttcatacactctcgagtggggtgctggctttgttttctccctgcgccctggtttttgatgctggactcaatccatttaatggagtgtcagaaggtaacatgatgaggaatcgctgggggcttatgattttaacagaagtgcaccaggggagggtgcggcacctctagagggactcaatcagttcccagaggatctgcctcctggggagacctgcaaggtccagggaggctagggtggtggctgagtcccaggaaatgcagcccttcccttctgtccattttgaggcagaatgaagaagtttgaagaaggtgagatgcagacctcggttcgagccctgcattgccttttacaagctctgccctttgtgactcggtttcttcagctatcaaatggggctaataatccccctttcacaagactgagtgagaatctagtgtggcaaggtttataaaggctctttgtgtgaggttcattattactgaagagtaattaaaactgggttctaatttgctggttcccagcaactttacagaaaaaagaatggcatgagactggggggagatgcgaaaggtctccacaggcacaggcgtctttcctctgacatttgtagcctcgggctgctttcattctgcagcagcctgcctcgctctctgagtgatgtgctctgccaggagctctgtgttcctggccacaaggctgactcatcccgctgttgttcctaaccgtgcctgtcctatatgtctaggttgaggattggggatacagacaaagggaaggataggtcaaaatgaacgaccaggggactaggcgatggttgggtactgataagttccaagttggggccccaagttggcaaggggtgatactggtttctgcagaaagaaacagacttattgtcctaaggttgatagcaaaggcttgtgtgaatgttcagttccatagtctgacaaccacacagagtttgggtacatttgtgtttcgagatttatattttgcgttgacttcgtgatttatgtctaaatataaggcccacttgcattattcagtaggaaaagatatataagaaaaattgaagagctctgtatcattctgagaaatgggtaaataattcccaaataaataaagttgatgtgggtgagcaatttttatggggtaggcatttctttttgtgctgctacctggtatattaagttgtactctcctcaacctcaatatcttccaagaaagaattcattaaatagaagcgattccacatctaaaatcaaaatactttggagttaatactgtggagatggtataaaaggttgtcttcaatcaaacattaagtgaaaaaaaattgcagaacagtatatataatatttaaagtatataaaatatacatatatggtatatgaaatctcttagttttagaaaaaagtatgcataaaaaatcctggtaagacatatattaaatcattagtagatctttccagaggattttaagcttgcagagaccctttatagatttctttattttcaaaagagtttgtgaatttacaattttggtctaaacatctctatatttttgaatggttttgcaaatactttcagtgtaaatgctagaaattaaattgctaagtcaaagggtatgcatatctaaaattttgagagatactgacaaattttcctctaggaaggctacacccattttatttttagcatcaacttctgaggctgtgtttcaccagccctcacctacagtgggtgttaacagtgcgtgatcatatgataggcaaagaaaaaagatatcttcgttttgtttatatttctttgattattagatcaaagaaatataaagatcatttgcattgctataaaggagtacacaagcctgggtaatttacaaagaaaagaggtttatttggcttacagttctgcaggctatacgagcatggcaccttgtttatatttctttgattattagatcaaagaaatataaacaagggggatggctgtttgagaactgtaaattttatcaaatgtagagtctgcaaatttatcttatcccttcttttctttgtcagggagaaaggtcagttttgcattccaggccatgcccaagagcaaataccaagagcaaataccatctattccagtgtgaggtgattagggaggtgggaagtcctagcaggaacatttgagtgctcaatgtctatgtgaggcggctgatgggctgagtcacagagggtgggtggtggggacatgcaggctactgcctccacccctgcgaatacagacaaggtttagatgactgctgatagaagcagcacttcagagggggtggttaacagctcgggcacaggcagatccagttcaaatggcaattctattgcttattagctgtgtgcctttggttaagttcctgaactgctctaagccttagttttcccatatgtaaaatgggcttaataacagtaccttccatatagtattgtcatgaagataaaataaaataacccaggtcaaaatattatacaatacctggaacataaagagtaagaagtcagtaaatagcaggcatttgttatgatttgattattttggtagcccaatccttggctatcaaaattatcagtattaattcattcatttatttgcacattccttgagtacctgctacgtttttggcagagaagtgtaaaagacagtctctaacatcggagaagcatccaggctatagtggacaaaaaaaataaacaagtcattacaatatggatgcataattttgaaaggcaaaggttgcacagggcattgtgggggcatggtgcaggggaaaaccaggtagccatggaagacttgcttgggagacagttctctacgggtctctgtttctgctcattttataagcaaaggcacttctcagtccatttgcattgctataaagtagtacacaagcctgggtaatttacaaagaaaggtttatttggcttgccgttctgcgggctgtacgagcatggcaccagtgtctgcacctggtgacggcttcggaaagccctcactcatggcagaagatgaaggtgcacaggcatcacattgtgagaggaagtgaggggagggaggagagagacagagagagagagaggagaggtgccaggcttttttctgtttttttgtttttgtagagacagtgtctcactatattgcccaagctggttttgaactcctggccccaggagatcctcccacctcggcctcccaaagtgctgggactataggcatgagccactatgtccagcctctttttaacaatcagaacacatgggaactaatagagcgagaacagcagcaagccactcataagggatctgcccccatgacccagctaccttctgctaggtcccacctccaacactagagatcaaatttcaacatgagatttaaagaggacaaatatccaaactatatctgacactaattgatctcttgttccaggccatcttttctaggcggtggccttgaaaaacagagctagctctccctccttggcagagggcaggtttgcttgcagtccattatcaaaggtttgggttctctgagcttgagatcccttaggtgtgatgtaaacccaatgcatgtgcagcatccgtctggacccctccatggggcagtgtggaacctgcaggcaaggagaactgatacagacaagaggcttatgctgtttccgtgttgctgaaataaagtcctttgtctctgacccagaagtctcatgtcttctgctagcagccatgaaaccgtggcaggaacatgtatcatcttgcaagtagaatagaatcttagacccttcacacttcttgacaggctccctggaagaggtggcagttgagctgtattttgaatgttgtctaggaattctcagttgtggggaaaaagggtattcgttgaacaagtatttcttgttcaaagtcaaggaggcatgtggaaataagaatatgttggaggaacgctaaacaatttagaatgccagagctggagatgtgcgtgggggagcagcaagtaaagctgggggagaggcagggatgagatcaggcaggcctttgagagccatgccaaggagttaggaatacatgctgagttaggaacatatcctgcatctgcagtgctttaccatgtcctgtactgtatactgtaatgagacttcatgcaatccctagaggaaagagccaggaagatgtggtttggaagacagacattcgtggcgatggagctttgcttaatcctgctgaagctgaaggcttgagcccctttgggctgcaaagcctgtaccctgcaaaaagcctggcttctggccttgaaatctggaaaccgttacttagaaatggagcactttgcttttgcttggtgccagtagacaggacagataagtgacagtaattgaacttgaactctcattaggttgatggtgtcggctgcagaacaagctgatttctgtggtctctgagtagcctgggcatgtcaggggcccaacagctcctccatgcaggtgtgtggctgtccactgctctcaggacctggggattcttccagacaagcctggataactttcaccatagggtctttgtatcctggctgccaaatttgtggccctgtccttctttacctgttggcatcattccaaaaaactcattgagtccattttgttttgtttttaaaataacatcaagggctacaacatgtcccagtattcccttatttagtcaggcgctgtgccaggcatctgacttgcattccttcacacgatccacatgacaatgatacaaggcagacacccagttgaccccattttacagatgaagtaactgaggctcagagaaaattataaaacagaacttgtaggtggctgagccagtactaaaaaagagaaataaaatgaagcacttaggtcttgtggattccaaaacttccaagactcatgttcttaatgcaacatacaaaaaattgtgataaaatgtatataatataaaatatcatcttaacaatgttgacacatataattcagcagggttaattatactggagaaaagaattctccagaattcttctcatcttgcaaatcagagatgctatacccattaaacaatgcccccctcctgcaatcccctggcaacctccattcttctttctgtctgtatgattctgaccactcaaggtacctcatatgagtggaatcatactgtatttgtatttttgtgactggtgaatttctcttagtgtaatgtcctcagggttcatccatgctgtagcaggtatcagagtctcattcctttttaaggctgaatgataatacatggtttgtgtatatacatagatatattcatatattcataccatgttttgtttctccattcatttgtcaatgcacccttgggttgcttccaccttttggctattgtgaataatgctgctatgaacacaggtatgcaaatatctctttgatattctttcatatcaaatgctttcacttcttttggatatatacccagaagtggaattgctagatcataaggtcattctatttttaatgttctgaggaaacaccatactgttttccatagtggctgcgccattttgcattcccaccagcagggcacaaggtagaagtttttttttcaacctttcagtcttcatgactgtaggcactagaggacataagtgcccaatgtaagctgaaggactgtctcaaaattcctggcccctgctgtccttggataaggcagtgcgttccccaactctgtttccagcggttgcctctgcagtgtggcagccatagtctcagggagtgtttttaaagcttaactgatgccactgacctgagtttctcacccctcaccctggtctgtagccaacatgctgaaaactttccctaggcctgggcgtatgcaggctcaggctgcatcgtggagattgtggggatccagagatgtgatttccttgaccattcaggaattaacacccactccacaccctcctttatgagccccacccttacccctccatggtgtcctcaaagactccccagaggcatgaggggcctcccacttccctgtaaaggggctccagactcccaagaggtcctatgggggactcaggcctccaaggaggttttgtggtgatgatggttgtttatcaattcccacctgtggtagcgagggcttcccgggaggtaggccaggggacagtgccaacagaggccccagtcacaccgtctcctcttccagggtcagagcccggagcagtggaagggaagtgggtcaggatgggaagcggggaatgcagaaggacatgtttaatgctcccagggaattcacagtcatgcccccgaatctaataaatgagctggtctctccaatcaggcaggaaacctctactcttggtcacatccccagcagactatgggaaaaatgatggatggagattgagtcatctaaatgtttgttcagatctcattgctctgtctactgtcagtttcatttttcacctccacctcctggaagagaaagaataaacaagatatttgggtacgttttaggggagcatagtggtagaatttggaatccaaactgctgcaagttgaaatccctgcttctggggaaacttccctcatggctctgagcattggttgctgctctgtgaaaagaggatttaatgactgcccgaggagggtattttacaagtaggaggccatgtctggagaatggtgtttaatagatgctgaataagtgtaaattctcctttctgacctaatttcctggaccccttgtggcaggaagcagtagtttactgaatttgagtgtgatgaatcagtaaatatgtttattttgttgtaaggttgctgttgctttgaaagagtaactgagaaggcttctgaaagatgatggtggctaaggtgctagaccaaacagatgaaaaagctatttgtgtaaagacaggcctcatgccaaagataaagtaaaacagtatatcactgagtcacacaattataaatggtagaattcacagggtcccctgaactcctctgaaccaggaaggaacacatgtggcccatccactgccataccccacctccgggcacatggcagacattactaatcaattgcagagttgtttccttatgagcccagatagcctcagcacttgaggcagcacagcacttccaagcagcaactgacagttgggaaaggactatccttgaaacctgtgttccacccctgcttcagaccaaacctcctgttttacagatgagaaatcagagatgggagggatgtagttttctccaaatcatgcagccatcagatctggaaacttatttccagttcagttcagtttttagtgcatggtggacatggaatttcctttttcaggaagcagggtcttggtgcccttgtttttatcatatctcaaaaaattaataattgagaggatgggccacctaatgctgagaaagatggtgaagaccagctgggaaagggtgttctcaggcccagggaaaaaatttagaagttcataaaggattgtctgaagactgaactctggggaggcagggatttcacctgttgtgtgccacctccgtatccctgtgtctgtgctggacatggataggggttgagtagttgaatacatacttagtagatgaaagctgtgtgacctagttgcaaattggggaatagaaacggaagtaaaattccttgaaggtaagattctgtaaagagctgtaagtatgtaaatgagtctgatttgtttaaaaaatgaacctctgtttttcttgcctttgttcattcatctacattgttggacacctactgtttgctgggctgtatacccagtgttttacgtgttttctaattcttaaaacactatgaagtagatataatattattttatagatgagggcactggagtttaaagaagttaaattccgcaagtcatggcagacggtaaaatggtagaactggaatatgaacccagttgtaaattttggccatttcaattaaaagatatatttctgataaagtcatggtggtttgcagccataatgttgagttgttttgatccccagccttccattcccgggttacagcttgtgtcattaacatcaagagtcattgagcccctcccccttccaaaggcctcagatggaaaaccaacatcacaaaaggacaactgtatggttttcctctcccagggatggcagagctccttgggctcaggggagaagatatcagtggaagatggttaggaaactgtggaatctcacacctactttcttttgttctcaccactgatggggtgtcagacttgctgctgctgaaaaggaacattctaaaccagtagaggggcattttaagtgggtggcatgctcccgtgtctgaagaggttggccattgacacatttcagtgatgcgatgtggaaaatacagccacagggaaaacagcctgaattttccatagtctcataattcagggcctcccagaaaggaggcaggaacaaaagagtagtggctaggatagaaaaacaccctggcttgaagatggcggaggggcctgccctccaggccaggggtacccgggtggctggggtgggcagaggccagcagattccatccttctcatgcctggcaagcagaacttaggctcagccccacgagcaggagattcctagtagcctttgctttttccattgtttccagggtcctccctttttgattaaatctatggggacctccttccccagaaagaacatacatcctgtagcagaaagttcaaatcaaaggccagaagtcatactcagtgcttgccttgtgcagagctgctctcctctccccgcatccccatggttttgctgggatttggaaggtgagaggaaggaaagagaacaaatattcattaagcacatacacagatgctgtgtgaccatttcatatgagctactttccttcactcttaccaaacccacctacaacacagtgtactagccctgagttaaagataaggagtgaaaagctcagagtgacttgccaaggtcacccagctagtcagtggcagagttgggatttacaattatttccaaataagtctgtcttactccaaagcctagactccttctagtgcactgaacactgccttgcaaaatgatcagatggtgggaaggtcactaatagtaatggaatgtctggtacatgccatgaaatgtggtcatacttatcacccttaatctttctgacaacataactggttaggttttatcatgcccattttacagatgaggaaactgcaacccaatgaagttaaatgacttacccaggcttgcccagcaagaactgaggaagagagcttggggagctcactgtcgggggagcgggtcattttagagccttttgtctgagtcttggcttggagagccggggcaaccctggtggtgtggccgggctccttggtgctggagcacaaaggaatctcctagccccagccggaagcaccaagaccattatgaggatgggcggctccagggtttctggggcaggaaacttgggtgtgcccagaccaccttccctagaccatctgcacatggcctcctccttggagctggagttccacgtttcttgccatcccacaaaagtgaagcaaaatttgacgtggcctcttgtgagcaaaatgaggtcaaagcatatgtttttccaccactgaaacattaaagtttttcccaggctcattagcataaacgattcaacttgaaaagttaaaaaattctgggagacccctttccgtcctcactgtggaagaactttgtgggtagtgttgggggcaaaagaaagaataattcctcagggcagggaagagactggaaggcaggagattggacgctccttagaggctcagcagggaatcccaggcgccgtcccccacccagcagccctgccagggggctggggaagtgactttttttctgcccaggggaaaacaaactggtttctgttttgttctgctttagattttcttcactttttctttttttttttttttttaaaggaaattgagcaaattctttgaattgaatttataaagagggcaatggattagggacactgaagcagtggttgttcagcttgggcatacagcagaattattttcttaatctggatacaactcatgggaaaagtaatgcgtttttattttcacttacttttaaattaaattgagcacttcctttaatctgaaatgtggacaacaaaccacaatatttgcagtacttcgtaccaatagcaatcacaaatatttttattttctcttactgttgttatacatatcttaaaatagcatttatgctcagcacttagagatgaagagagttgtcagagttgccgataggtcttgctatccagtgtgttcataagaagcccataaaatactgtctctcaaaatattttgataactcgacttcaacacaaccatttttctttgtaatcctgtatgtttacctttattcatctaactctgttatactgagaacaggagaacaggcttcatctaggtgttaaaggggtccctagtacaaaaaaagttaagaccccttattttaaaaaggccagtgtccacactgggacctcctagtcactcctcgtcacagagacagacatggcctagtgggcagcagggaggctgtagaaggatctgtctgttgccttcattggagtgacatccccaccattgtagataagacttaaccttgaggttcctcgaatcatgccagcttccccattcaggtggtttgaatcctaaagactatgaagagccattttgaagaaactgaaggttgagaagattctgattaccagcattgttgtataggcattgggtcgggggttggtctggaaaatgctgggcctgggctctgtctcagatgtaggagtgcccagctcatcctggggcatctcccagatggaccatttgacagcagcgtagcccagataggggcctgcactgactcctgctgcccacaactgcagccaaggctgatcttcggtggagaaggcctctgtcctgtggctgcagcttggcagcctgaactgctgcgtgaagcatcctctgactcccttctccctctgcagcctgtcttacccatggcatagctggaggatgcagacatgacatccagtggagacttgtgatatgtcaggagggattacaggtcacagcccctggaaccttgttcttcttgagagatttcacctgccccaccgaaggctccagccctaagcctttgggatggacagagaaaatacaaaatatgatgcagtttttgtcacctcccagttctctcaagtccatgtgcctagggactgtgtctcagaagcactgtctcctgaggaaccagctcttgcataggtgctatctccaagtgctgagagtgtggagggacttggcacatttattactttcttcccaaggcaaaggaaaaccaaatttaagagactgagctaggccaagtcagctcactgactcatctaaaaagggcaaacaagaaaccaattgagtcaatctggagaaactctatccatccccaaggacggggtagtgtcctgaatgtgatcaaaatgaggctgggcagtgaggacactatcagagcctgcttggctttttgtaattactgaaaaacagaagcatgcgcttccaccctgtccctgaatcctgcccaattcctagccctcatcccctgcatcattccttcccttgcatgaatgaaggaatagcacaaccaatcccgtgaacagtcctaggcttatctgggtgcaggtaaatcatgagattcactctaaacttaatcccattaattgccgtgtttgagagaaaggggatttcattagggcctccagaggagttttctgagggaagagatacaagctctggccaccccaggaggccctgtatggaccctgctcaccatggttgtggcgggacatcgtcctcacttgtggcccgaggactggctgtgctctccctggcccatggaagcgggaaggcccagaactctgtggccacggccgggcgctgctaccctccacggctgaacactattagcctggggcagatgtcagctctgagaggtccgccaattctggtgtgtcccaaaaagtggctgagactggagactaggagatgcaggatatggatgaagcatgagccagagtgctatttgcaccctgaagccagaaaaggaggaaaagatgatggagatttgtggaggtagctgagtgtctggagaggctggggtagagcaggtaccacccttcagacagcgccacggggaagctggtgggacatgtttctgccaacttgccaactcctaggagacctgacgtgtcacccagaccctttacccagcagggcctgtcatctcccctaggagggcttgttatgattccccagacctctctcctccagtgtttctttcaggaggactgtccccacgcccctgacacatggtgattagggagcccccgtgactccgactaccctggagcgcccacagcactccccagaggcagctccagatgtctgctgttcattgcccagaacgcttattttttaaaagaggccctcaccatggacttccagcatcaccgggggcaatgctgggaatgggggtggtgctttcctcagagaccaaccaggaccatggggagcacctgcagcagctgatccagagaccaggacatccacaaggacagatatcttatgaaaagtcctcaggttcataggaatgctaactctgctgggggtgggggagctgcctagccatggatgataatataaacctgtttggcctggagagcaaccaagaaggcccaggggtcctagccaaggccaggcagggtcaaagtagagatggaaaagttgctgacatcagtcatggggctataaagtggaggcatagagagaaggctaaggcagagggatatgagacaggccttttttctctagacggctgtgtgtgattgctgagggcacaaaccccaccatgattatgcttctggttagccttgctgcaggggagcagccccacccccagccccgtaagcattggtgatacctgccaagctctgagatcatcaccttcaaagtgcccagcaggaaggctggcaaggcagagggtgagtttggatgcaccgtgttctgggcatctgttacccaaacttagcagtataaaacaaccgtttattatgttcctggattctgtgggttaggaacttggacaggtaccatggggatggtttgtctctgctccgtaatgcctgagacctctgacttgaagccagggtactcaatgaccagcgctggagccatctagaggctcttttcacccaagctcctggctgttgcctggaaccctaggcagtgctgttggcctccccatgtagcctggacttcctcacaatatggtggcttggttcaaagggcaggcacctgacaagggaaagagccaaatggaagctatgttgcctcttagaacccagctgtgaagttatgcagcattacttcctccacagttagttcattagaagtgagtcattagagccaagtgctctgctaggatgaggacggtatgattgagggctgggcatgctgccttccagccccctgctattttctgtttctggaagcagtcccttggtcgaagaagctgtgagtgctctgggtggagaagaggccagtgatttcagtgcaggtcttgggggctttagggactgaggcatttccctccttgggttgcctggaaacaccagtgaccaaccagccatgggtcgcctggacaggaccacccctcagagagaaaagccaactgtgggcacttacagccctcccatctgaatcttgcctttcccagtatgagtcttggcatgtcttataaccacctgttggtccttgaaccctgaactattcctctcttcatcactccagccctgagtacccaactggggtgggtactcaggactggggagcacccaggagagaggcgctagttgcccagtgggagagtctgggaaggcttccttgaggaggagacatctgtgctgctccctaaagattgattgacagataagggaggtaagggcattctaaaagcatgggccaaaaatctgggtcctagggaggtcagaaaaatcaggctggaaaacaggttgggagctgaccaataagagctctgtataccatgcagtttggactccaggtcatggttgctggagtaggtggagacagtcagttgtgaggtagaatgtgctcagggtgacagtcttacaggaactcatgaccttggtcagtctgtgagagtccagaacccgtaagccctgcagattcagagaccggacctgctcagcaatcttgctaactaaattctgacctcactaatgtgtaaaccaaaagcacaggctattaatttgcagggttgaggaacatctctttccatgtggggacccccatccgggatgctccctatgtggtgtcagggtcctggggggcaagtttggttttctgtaggttgctgggtgagtgagaattagagccgagggagcttgagattgttgaagggaagtcatgggttcccgggtgcctggtgtagtcagagcagagagctgccacagagctccaggcctccctctccccgggtcactgggacacaccttttgttcactccctctctccttgtcacattcttttatgatgtcagaatcacagatgcgggctgactgttcccagggcctggaaggcaggctgtctcctccgattatgtgttgactgaatttgtgcaaccctcagccttctccagggcccctcggctggagcagctttctgaacaattatgatcagggacgtgcataatcaagtttgtgttttaggcagataactggagctgcagaaaggagtctggtggagagggaggcaggctggtggctggacgctggcctccttgctgccacattgtgcataggatgaggtatgacttggtgggagcatctgtgagggtagcaaaggcccttctctgcctgtgaggaaaccccaggacagtgagccccaaaccaccagagtccctcctcaccaacttcctggccttagcaggagctgggcaggaatagagacttctcaggagggtagagttaggagtgaagccagcttcctttctctctggcactcatctcctgggatccacatccggattcagttcctgagaacctggtgagaacttggctacccgcctgtgaccggaagcatttctcccggagtcacatgggggacttcacactgacctgggctggctctcctgctctgcatccagacgctgtaggtcccgcggggtttgcagcctggagtttggagcagctgaaaggcctgtgggccctgagcagatacagcagcagctgtcagggggctgctcctgccaaggcttccccacccagcctccatttcctgacacaagggtaggacagttggagctccctgcgggttgggaaacaaaggccaaggcccctgaatggatgggaaaagtcaggctggggagagtctgaggttctcgctgttgtgattcatgcctttccttgcgtcggtgaacctgttccccacctctgtagctgctcttgttaccgtgggatactcagcctggccatctttttggatcccggaccccatctgctgcctgacctagcaggagagccagctgctgcttcacatcccagctccagcactcactagctgtgtgactttggcaagttactcagcctttctgtgcctccatttcctcatctgtaaaatagaaaggaatagtaacagccctctctcagtggagtgttttggagatcatgtgagttaatgcttaggatgcaggacagctctgggaataatatctaggaagcaatataaatatcggccattatggctatgattgtttcatgacaacccctgttatcatacacaatccagaggcttttctccaagtacagaagctgcacctgagcatggttgctcacacctataatcccatcactttgggaggccaaggtgggaggatcacttgaagccaggaattcaaggccagcttgggcaacatatagagagaccccatctctacaaaaaaaagttaaaaacaaaaccaaacaaaacgataaaaaaaagaagaaagaagaaagaagaagaagaagaggaagaaaaagaagaagtggaggaaggagaggaagaagaagaggaagaggaagaagaagaggaagaggaagaagaagaggaagaggaagaagaagaagaaaagctgcacatgctcacaaagcccctgaagcacaggccagaatctggggtcgtgagtgggtacggggaggaagggcagtgcttcccagcctcctccctggagtggggtcaggagcaggcaccctgatgtccttgttggcttatcttcatggatgtctttgaggccacctctctttctgtggccaccagcccttccttctcaaccttctcctgctcaaggccaaccccactttctctcttccaagaaatgcacctgttgaatcttcacattgatcggattggcacataaaatacaagacaccctatagaatctaaaataatttttggtatgagtgtgtcccatgtaataattgaggcatactgtatgaaaatattattcattgtttatctgagattcaactatggctgggcatcctataattttatttgctaaatctgacaaataaaattcagctaaattatttgctaaatttggctaaatctcctttaatctgtccaataacctcatgaggttccccactttgaggcccctaaacaaagaggtcccatgcaagtggaataaggagccatggaggaggcagcgggtctgggagacctggaagtgctgctggacttgtcagtgcatttgggcctgaaatgcccatcagcctcctgatcttctgcatatggagtgctaactgtggactcggtgtgtctggggaatagaccccggccaggctcagtggctccacccacacagcgtgcctttggataggtggtcggggctgtggagaccctaagtccccggagaagtgttggggggagtgggtagagagggctctcccaacggctgccaacccaggtgggatgacaggcacttggatgagtagagacaagctgcttcctttggagttaaatatgcgtctaacttctccagaggaaatgccactcaggctgaaagaatgttgggaggctctgtgtgtggagggctggctctcggtggcctggcagcaggacaagattcctggaggaaggaacaagcttttccagggaccgacaaagagagaaggctcccagaggagctctggaggtgggagctgtctgtatatattggaaggagaagagggaggataggaggagagagagaactccaggactctttcctgattaaggaaggcatgacaggcactaaagggttaggagcagtgttctccataccctggggtgccaagctctgctcgggggtgcattttcctctttcctgggcagtgtgacttgggggaagaaaattggtgggagcagccccaggcgagccaggcctttgcagacattggcactttagaataataatagctggcactgatgggctcctggctcctgcctgggtttttccacagggcagtctctgcagcgggtcaggctagagcccctcagtgaggtttggggcccccaccccctgagctggctgagagtttccagtgtagcatccaggaaagactggaggcgccctgctgcgttccagacaaatgtgcatcttacaggctcctgcgactggcctggttttaaggtcaaaaaaggactctcaggaatggggaaaacctgacttgggaatcctgtaggataaaagggaagcttcctgctgctcttcctcagggcactgttgctaatcctccagtcaccttgtgccagggccagccttgtggaccctgccctcctgcagcaggcacagctggcagtgctccacctccctgagagttccagagttccctcctgcctcacactgccacctcctgccccctggctggggccccgacccagcccaaccactcccagagagagctccacagagcactgggttgcagttgagcagaacttggcttgagtgtagctctgccacttctgattttggcaagtgacttcattgtactgtctcagtttcctcatctgtcaaatggggcttctcttgcttactgtggaagacaggatagtgtgaggacgagctgaggtgatggatgctcaggggtctagcccccaggggtgatcgaattgtgtctgttttttcttgttccgtgcagcctccttgtccttgttggtagttggcccatcctgggccctctcttggttccattgcaactgtcctccttcttcttgtcttcccctccagagcagagggctctaggatgaagcaggaagttgtgctgttggtaatgggaagggcactggctcaagcctgatgttctgggccttttcagtagaaatgtattcattaacaaacaagacccattggcccacacttaagctcaggagaggccatcctttgagctcctgccgtgagttaagcactgcaaatagagatccacgctaggggtagagtgggtggaggccactaagcactgttgcatctgttatctcctttaatctgtccagtaacttcatgaggttccccactttacagataagacccagagagactcagtaattaggccaagatcacctagcttgtaagtgaacgtgtattagaaccgaggtgtgggcgcaaaagcctgtctcagccctacatggccccagatgcacttgtgccatatggtcttgacttgtgacccagcattatggcaagtgcagcgacagagcctgtagaggggagtgtgggggcccagtggggaatggggaactgtgcctggactctcccagtgttggcactgcaagtcctgcatcccaggatacccctagccctgggtgaaccaggaccttggccacttcacccacactgctgactctttaccagaggaccacctctgctcaggagggtgcctgggccaagctgcctccccacccgtgggttctgggaacagccccacatccaggagaggattatttgtttatctcacaaattataccatctgttcatcctgggagcactcagggcctggcatgaccacaccacccccagggtgccaggaaatggtaatccacagataacatgccccacccaaaccttcagtgactagaatgtgtacggggctggagtgccagagcctggctcagccaagagacgctgttctggtccctgtggctccacatcctttggaatgtaccagcacctccccactgaccacccctctgtcaccttctagcaataagatgctgaaggcttaggaacagagctgactgtgcgtggaagatccgaaacagaggagactggggctgctggcttgtatcgggggaaggtgcatgtattagtttgctagggctgccatcacaaagtaccccaaacaggacgacttaacaggaatctattctgtcacggttctggaggctggaagtctgaaatcaagatgtcaacaggattgtttccttctgagagctgtgagggaaggatgtgtgctcttatgaatgtgtgtgtaaatctgagcttttcttccatcaacaccattaggctctaaggctctatgaccagtggttcatctactggtcagttcgttctttctgttattcttttttttttcaagatggggtccactgtctgactcaggttggagtgcagtggtgcgatcttggctcactgcaacctctgcctcccaggctcaagcgatcctcccacctcagcctcccaagtggctggaatcacaggtgcatgtcaccatgcccagctaactttctgttattcttttagtgaatggcagctgcgagtcaagcacgtgctgggggaattagagtcagagactgctccagaactcatgttgaaattcaatttccattttaacagtattaagaggtgagacctttaaggggtatttagatcctgagggctccacagtcataaatggattaatgccattattgtgggagttggtttcttataaaagggcaagtttggtccccttttctcttgccctttcttgtggccctttcactttctgccaggggatgatgtagcaagaaggccctcaccagatgctggctcctcaatcttggacttgccagcctgcagaaccatgagccaataaatttctgttcattataaattacccagtctcaggtattctgctatagcagcaaaaatggactaagatggtgactgacctcaaagggtggctgtgaggatccgagaggcatactatacttaaagcctgaaggatgtgcaggcaactggttggcgctttctaaacttcactcttgtcctctcctcctgcacagtgtgcagagctctgaggacaagtgcatcctattggtggaggtcctgggcctccattctgcatgcagttgaccctcacttcttgccctgaagatgttctctccagagccatgggcttgagaggagcttggggaaggccctggccctggaggcatccatccccagcagcctcttcctttgggcctccggtgaacaagaatgtctgggattcctgagaagtgtgggaaatccaagtgcccagccagtatgaggaatgagatgcagcatcagaagggtcccaaagaagcggtgcctctgcgggccccacacagactctgggaaagcctccagggactcattgttgtcctctccctcctccaagttttgacttctgctcactcagagcctctctcctctgatcaactctaaactggaaaatcaaagactctgaatggctcctttgccattttccactatttcatgatagtgtcaaagcaccggggctgcttccagcctgacattcctgccaaatctatgctgtgttcccggtcagccctcgctcccgccagcttctgagctttctaaatatagttccctcctcgggacaacaaagaagccatcctctgaatgactgcattccccatggccagcttctgggctgtttgtcagattcccccagcaggatgggagggaggagtgggggcaaacaggagtggccaggactggagaggagctgctgaagtccatgcagcagggtgctgtcttccagccatatgacatttgggcccagacgctcagtggctatggccttgaccgtgagttcctgccttctgtctctggggatgcatggggcccagagccctgtcccgggcaggtgctactaagttgtgactgaagaagaggagagagaaatggtgatctccccagcaggaaatgaaaagtgtctgtcggctccagtccagtcaagctgggtgacctctgggcagattctatccttaagtctcagtttccacatctgtgaagtagggataaggactatgtcaaggagactagagagaaattgtgccaggtggcgggcactagtggtcctatctggccagggctctgtgcctgcatgtgatggattgcaggcatagcctttgaagtgctttttgatgtgcctttcacttcaggatggagtccctcttctggtcccagggctaagaggtagatagaggccctgcaaggtactcattccttactaaaacaagaccccaagcccagagcccctgccttccctcccaggcctcttatttctgatctcagcttctcagccatccagagcccagttgggtgctgaggcccctttaaaaagcccagagcccccgccttccctcccaggcctcttatttctgatttcagcttctcagccatccagagcccagttgggtgctgaggcccctttaacaccttggctcaaatgtggacagaacccttgagcacagctaagagcaattagaattatggaaaagaaaaaaacctggatttctcagctcagggcctgtctgtgcttggagggcactgacacatgtcctctccacccacccactcagttctactaagggtagagggcctgacctcttcctcaggtctaacaaacactgggaaaggtgaggccagcccctactgctagcggtcttcaggagagactcaatacaaacagctttactggatggagagcctggcctttgtacaacaaaaggtcactctgccccaggacttgcctggggtggacatacaggccacttcccacctgtttgacaccctcaggatgtagataagtcaggactagatgtttgatccccgagtgctgaccaggacagagatgtcaagctttggtggatgccttaaggccctgttgatttagaccttcctttctgctcacagactggccccctggcaggggtgcaccatagcgggatcaggcattggatgtgtggaggagcagatgcatagctatctgttgctatggccaccgttcaccaagcatgaactctgtacaacagccctgcaaaacagctcctgccttcatctttgtttttaatagaggtagagtcagcagcccaaggtttcacagctgttaagtggcaaaactaggattcagtttgtgcaccttggagtccggaagtctctagtatgaccacaattcttaaagagtgtgttcctgctgggaatggcagttgcacatccaactagacaagctggtgggctcgattataacaaaagcctcaagctttcttgaggggagtcatgtggaactaacctaccagcactccttgctgataccccaaaggaaaccagtagctttggtatatttaggtttttcaaaggtttttggcaaagttccatgccaaaattttttttccgtacctagaaaaacaattaagtttgaagggaatatgctttgtcatgcataggagcctgtttagggaaaggaagatattcctaaggatgaaaatgcacccgtcttgatggataattgtaaacagcagggtcttataggaattgatgctagaagaatcttagctcatatttttaattaaagatctgggagaggaaatgtatagtgaaaatcgcaagtctacgaaggcctttcgggggaatgagaagccaaattaatggaatgtatgttttttgctctagttctcaaaccattgctaatgatctgcattttgttggcctgtttgccacagtaagatgcaagtgctttcacccactcaacacatatttattgtgcgcccatgatgttccagccacagtactgggcacaggcatgagtgtggtattattctgctttacagaagggctttacaaaagcttatggtttcaaaatttccctgcttttgtttatggttctaacccttgcttgttttagaaatcattatgcaaagaacaactgcattctttttaatgtctgcatggagggatttttctgtgaaatgactgtacaataatcagttccctctggttggacatttttgttatttctggattataaataatataacgatatagccttaaacacacttgttctcagatatttacatatatggacaagtgtttctgagggtagtcaccaggaagggaaatgattgggtcaaaggacatatacatttaactatttgatagatgctgatggattgcctgcaaaaaaaaaaaaaaaaaatcttcaattttaattaccccaaagcatttggcaatgcctatttcctgaaactaacattgaatattttattagtttcctattgatgctgtaacaaattaccacacatttactggattaaaacaacacaaatttactgttttccagttctggaggtcagaagtccaacacaagtcccactgggctaaaagcaaagagtgggcagggctgcattcctctctggaggctctaagagagattctgctccttggcccctggccccccttccatctacaaagccagggatggccaatggagtgtctgtgacacctggcatgatatcactctgacactgtctcttcctctattcccttttccatttttaaagtcccttgtgattccgtcaggtaggtgctcctggataatccagagtgcgctccctaccttcaggtcagctgattagcaacctgcattccctctgcctctaatttccccttcctatgtaatataacatacccacaggttccggggaataggatgtgaacatctttgggggtgctgttattccacccaccatggagacattcaacctttctaatttcttccattctaagtgaaaaaaatggtgttatgctcttttaagttgcatttcttgattgatttcattggtgaggttgaacgcctttctatttgaagaggcaaatttctgttattctaagttgtccgttcataccctttgtctcctttgccactgggttgctctttctctctctctttttccaattgaattacgaatttcttaagggcagaggcctcctcacattcacctttgtgtccccagtccctcaaaatatggctggttcagagaagggattctgtgcctgttggcccttcctttctcccaaatgtcgtccctcccactccattttcttgccattctgctttggaaagaacgtcgggaggcttccggctgagcagcctgagttgtgtctgtgcacaagagcgtgtgctgggctgagacaaagcgcgtctgtgatttgttcccagccctgttgggacttctctggccgctggggctctggctcagactcagtcccttcacttgggcggccgttcaccctactcggagcctcggttttcttatccgtaaaaacagcgatggtatcatgcctgacatttaaggggtgctgggaaagtaactgaaacaaaagcatcaatgcttggcaagggagcaccctggttgctgggccgccagcacttgcagtgttgatcagagcagcagagcccctggaaggggactggaggcagctgccggaggtccaggcctgcccggccaggctcttccaggtggggctccacacctgcattcaggatggggaggatgctctgggtcagaggggagagccggtccttcccttcctcaagacccttccagaaggtctgctgggccccagaataccaggcctcaggagggtccttctcaccactggctgctacatgtggagccctgaacccccttggctcaagggctggtggtggaaagagaccctccaccctgaactagtcacattatcttggagggacctctctgcctccatttcccggctggcaatatagagaaggcagtccctacctgcctcctgctgggaggagtcactgaacaagatcagggccgtcaagcctgatacctcaaaagggcgatcaatggccattcctgtcatcatgttccctcctcccctgccctccttcccctgctgtaaagctgccggttcgtaggcctgagcctgacagcaggtccaggagctgaagcagccctgcttctgccagtgaccggcgaccatggcaggtcacagtgccctcggccatggctccctgttctgtgactcaggccttggggtggacagattcccctcactccttctctccctgtttctccagccaggcagagctggcagccatgaggagacagcacctgggctgggagggctggagtccagccaccctcctctaattcatttccaagctggcagctgcctttccctcttgcagggaccctagacccaggaccctgagggcgctctctgtgggcagggctgtggctttctggcagggtccctagcgatgccccctctgctgcctcccagtcttcacagtcagcagagcccttggggcctgtcttccagcctttcctgtgcagtcgggcgggcctggacctcattagcactttttattaaatccatatgttctgtgtggaagaccagccctgagtccctgtgctcccgccctgggtgtgggtgggggagaactgtgcacagatggcgattgtgtgaatttggtgtgggatcctccaggctctgggctgccaagcctcctaggcatggagatgctgaagggcagtgcagccaggcagggatcaggagcgactagagtctggaggcctttcctgaccctgctgagcctgtggggtcaagaatggggaatggaagcgggcctggcccttcctgggcactgtgggcctgctgctctgctctccattgacacatctgctccctgtgcccttccccaggagtgcatcatcgacgaggactgtgggcccagcatgtactgccagtttgccagcttccagtacacctgccagccatgccggggccagaggatggtgagtatgccagggcctctggggctgtggcaccagggtctcaggcacctgggggagaaagccaggggccccagcgttctcagctgggcttcccagaagagcctcaccatgatggggaggacccaagagggctccccagagggctgactcctggaggacaaggaactcattccagtttgggatgacaggaagccatctgcagacccagggccactcccatccaccccatgtcctctggtcatgttgtttgtgtcattgatggtagagaaggggagggacggccaggcaccgtggctacacctgtaatcccagcactttggggagaccaaggcagaaggatctattgaggccgggagttcgagaaggggagggaagggagaggaggtgtccctacacctgttgcttcccctggggatgacccatcctaatagacaaacagagacattccggcagcccccaggcagggagagcggcagctgctctccttctggacctgcaccccacccaccagatctttctccaatctgccaataagagagggcagagggacagggcaagaagaggccagggcactgccccagtgcaggttagattgggaaatgtggagccagggcaaaggagactcttcacccaacaggcattttggacgaagccacatggactcacagacttttcatagtcatttttccttattcagacaataacacagcatgctaataagcttggaaagtcaagcagttcttattaccttacccgactgtctgtggtgaggccactgctgttgcacctcgcagccaaccccactcggtaccgtcactgggcacagccgtggggacctcactttgctctctaactgccatgccctgtgtggctgcaggaccctggcacccacaggccatcctcatcttgggctggcttgggccttagtttaatcggctcatcattgggccttgcctctttgggcctggacctagggacctaaggaaaaagggaacagcacaagtctgtggggaccacaaagaccccctgctgttctttgcaaaatcttaagctgtggagaaagactcagatccatgagtcctcccggtgccatttttccagcgttctgacccccatgtctcgccagccaagctcccacctctgtcccactgactttcactgaaatctcagcctggtctgcctgtctctacaatgggaggatgcaggttggcctatctgtggtatcttcaggctgggctctcagcaggcccccagtccctaagccgctggctctaggctctttccacctgtctgcagctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggtgagtggcctcccctcagatgcaggaaaaaccctgtcccaagctccaccacactggacctcctggagccacgtccatgccaaccacatggtttcgcgtcccacctcttggataggctcccaaatgctcatcagtgtgtgctgcactcccacagcctctgcccggagtgggaagaccacctcttttttttcccctgttgatgctcagaaaagttaaatgacttcaggatgcaaaagcccagtctggaatggggtgggactagcagccccctccctcccaccactccttatttcccaggttcctctacctgtgaatcacccgcttccactcccatcttccgtcctgcctctcccaggtgaggtctgctcaggctctctccgcccccactagggttttgaaaaattctcatttgccgcctccccagctctgcatccccagcccactagtcctccctgtacctgccgcctccgtgatcttcctaaagggctgctttttgggtgttgctcccctgggacctgcagcagctcctgttgtctcccacgatgttcagactccttaggctgtcttgtgaggcctcatgcagctccaacttacttgccctccttttctctccactacttcttggcctatttgggaatttcaccggccctgacattttccactgagctcaaccccaggcctttgctggtgctgtccctgtgcctgaatgcctttgcctccctcttaatttctccagactttctggccctcaaaatccagcagaagcccacctcttccaggcagtcctccctgcttcagccctaccaatcattccctcctgagcccaggctgctattcttgtttcctgtcattccgtatcttcaaaactagcctgcactttggggttgagggtgggaggtgggaggttatgctccatttctttgcccctccctttggagcccttctaccctacacggggcacacaggggtgactctgggctggttccaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacaggtgaggccccctaaccctcactctcagggagccaagggctgaggaggtgccatccagcaggggcgtaggagcaggagcaggttttccctgggggaggtgtagattccctttaggattggtttgagaggtcgttgggtcatgcagatggaagggtccaatcagcagtcggttctaggggtctggagcccaggctgcccaggaggcacagatctggggctcatctagctggtggctgaagcttcatgagtggatggtccatggagaggacatggagggagaaaagcctgggctccctccccagacctgtcacaatgacagataagcagagaaaaaggagctggcagagaggccacggggaggccaggagtggccaccaaggtggagggtgcagcccacactgtctgaggctgctgagactccatgaggcatgaggctcaagcctggccagcttctcagggcacatctccctgtcctccccgcagcctctactcagtcttctctcccaacagaatccagggctgctgggcagacaggcagaactcccattccccacggctctgtgcagtggctcacacctgtaatcccagagctttgggaggccaatgcaggaggattgcttgaggccaagagttcaagaccagcctgggcaacatagggagatcccgtctctaccaaacacattaattttttttaaaaaaaggaattcttcctccctattcccacagaggtccatggctccctgcatgtggctagactacaccccagagtcaggctgactcctgcctggaggcccgaatgggccacagtctttgaggggctgtggtgctgctacatagcactcaggtcctgcccctgggctgcggggcctgagagtcacaggaggtcaggcctgcgctggaggaggggaagctgccccccaccagcacattctcccaaagtgagcctccctcagccatcattttaagatagatgttgacgggaagtgaagtgtctctgttgaagagacaggagaggagggggcatgaaggtgaggctgggagccccacagagtcagggcgccttagctttcggcctgggcaggctcccacgtttagagcctggctttgtcccatctctccccagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 36112 - DNA, 17977 bp, Homo sapiens
gggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggcatgagccggggcgggcggggcatgtcacgggacagacgggcagaactttaggaaggggcaccatggggtcgggccgaggctgattggggccatgagcgccccagccaggtgtatgaggactcaggggccaaagcaagtggccacgggggcagaaatggggaaagatgtgagatccaagtttatgtgagtccaagccagagaggaattggccccgggagccccgggaggactccactggcacagtcgtgtgtaagtccagggctcttatgcaatgcggttgtcattattgtggttgtggtggtggttgttcgcactcccagagaggatttactaagccaagcttgctctgtcgtctcttcacatgagagctttcaaaatggggtgggaactagtatcaccctacttgacagatgagaaaactgagacccagagagtgacttgcccaatatcacacagctgttaactgacaggactgggatttgaactcagctcatgctcttaaccaccacaagtccccaggctggaaactgaaaaagttggggggtcaggttgctgcgagtacctaatgggaaggagtcacagagagacatgagtgaagacttggggacagcagtcctgggaaagtcaatgagggctgaaaatttggagttgccccaggagagagggcagaaaaggggataaccatcccccagcactccctgcccccacagcccagacttgaccaactcccagctgggcctgggacttccagatatggggccccacccttgcaggccttggggacgctgaagatattgactatctgcgtgccccaaaagggtggaggccaacaggaccccactctgctgtctcccttggagggactctgaaagttcttctctaggtccataactctccccttccccagggagaccacgtgaggatcttgacttgtggagaatggggagctgtgggcctctcagtaaaaaccagtttgctgataagcatttattcgggagtaatggagaaggaagtaagagagagaagttgagaggcgctgagtcacctggaaatccactaattccaccgaattccactcgcccaccctgctggtcatagctgggactgcactcagagggttaagaactggagcctagggagcttcagagctgtggctctgaaaaatctcttcccagctctcagctttgctgtccccctcagcaaagggaagggctggccaggcacggtggatcatgcctataatcccagcactttgggaggccaaggcgggaggatggcttgaggccaggagtttgagactagcctgggcaacgtagcaagaccccatctctacaaaaatacaaaaaaaaaataaattagctgggcgtggtgatgcatgcctgtagtcccagctactcagaaggctcaggtgggaggattgcttgagctcaggagttcaaggctacagtgagctgtgtttgcaccactgcactccagcctgggtgacagggtgagaccctgtctctcaaatttaaaaaaatacataaaaagaaagaaaaagaggctgggtgcggtggctcacgcctgtaatctcagcactttgggaggctgaggcaggtggatcacgaggtcaggagttcgagaccagcctggccaatatagtgaaaccccgtctctactaaaaatacgaaaaattagccgggcatggtggctggtgcctgtaatcgcagttacttggcagactgaggcaggagaatagcttgaatccgggaggcagaggttgtggtgagccgagattacgccactgcattccagcctgggcgacaagagtgaaactctgtctcaaaaaaaaaaaaattagctgggcacagtggtacgtgcctgtaattccaggtacttgggaggctgaggcacaagaatcgcttgaacctgggaggttgcagtgagctaagattgcatcactgcaccactgcactccagcctgggtgacacagcaagatgaaaggaaagaaggaaggaagaaaaggagggagggatggagggagggagggagggaaggaaagaagggagggaaggagggagggagggagggagggagggagaaggggcttggattaactggagttcacaatggttctgtagggccaagagtcttaacaggcatgaactctggtgccagcctgcccacattcaagtcaccagctctgcggcttacagcctttgtgaccaaatgccttgtcatctgtgtacctagatatgtgtaagatcatgacaaaactggtagtacttgccctagggctcttgggataattaaatgagatcttatataggaggtacttagactagcattgaattttgcagtctctggatcagacttacttaggtaaaaattcaaccttctctacctactagctgtgtgatcctggcccggttgcctaaaattgcctcagtttccccatcaatgtggacaggataatgatacctaccttgcagggttgttgcaacctgatgcttctcaaactgtgagttacaatgagatctgaaacatatggtcacaacgtgtatcaacaatatagggtaacaaatgatgacatagtatcaaaatgtatcacatgttaagtattagttttgtgaaactcattttaattatatatgtatgcgtttgtgtacaccaggttaggcaatgaaattttttgtattgatggctgatttttttttttttttttttttttttttgagacaagagtctcactctgccgcccaggctggagtgcagtggcacaatcttagctcactgcaagctccgcctcccgagttcagccattctcctgcttcagcctcccaagtagctgggactacaggcgcctgccaccatgcccagctaattttttttgtatttttagtaaagatggggtttcaccatgttaaccaggatggtctccatctcctgacctcatgatccgcccgcctcagcctcccaaagtgctgggattacaggcgtgagccaccacgcccggccaatggctgagattttcaaaaagcttaaaaagaggccaggcaccatggctcacgcctgtaatcccagcactttgggaggccaaggtgggcggatcacaaggtcaggagatcgagaccaccctggctaacaccgtgaaaccccatctctactaaaaatacaaaaaattcgccgggtgttgtggtgcacacctataatcccagctactctggaggctgaggtgggagaatcgcttgaacctgggaggcggaggttgcagtgagctgagattgcgccactgcactccagcctgggcaagagagtgagacttcatctcaaaaaaaaaaaaaaaaagaatgcccatattggcccatgcaagcccctgctgctcccccatgtgtgagggcagcacagatcttgtgtcattcccctatgaaaggtggtcacatagcacggggaggctggtgctgtgatcctcacttcagagatgaggaagctgaggtccaatcacggaagaggttgcatgaggttcctcagctggtaagtggcagagctggagtttggatcaaggtccctggggcagtaatgcctgtgcttttgtgtttacaaaggttcagggagatggcagaaaacatgacacagtccctggacccacagggtgcttggtttgctgcaggtcagcataaagagggctgtgacagaggaagtacaagttactggggggaccgggtaaagagggtaaagggtgttccaggcagagggcacagcacgtgcaaagtccaggaggcaggaagcagcaccatgcatttgaggaactgaaagaagagcagttggggccgggtgcagtggctcatgcctgtaatcccaacactttggggggctgaggcaggtggatcacacagtcaggagttcgagaccagcctggctaacatcgtgaaaccccatctctactaaaaatacaaaaaaattagccaggcatggtggcaggcgcctgtaatcacagctactcaggaggctgaggcaggagaatcgcttgaacccatgagacggaggttgcagtgagccgagactgcaccactgcactccagactgggcaacagagcgagactccgtctcagaaaaaaaaaaaaaaaaatgtgctgtgggtgaagagggcagaggcttcagcagagcctggagaggagaagccagatcccgaggggcctggaaggctggcatgaggagcatgggttttatcacagggcatttcaggcttgcgggaggcaactgagcagagaggcacttaaatattactgtggagaactctgtctggctgctgtgtggaatatggattggagagggcaggactgggtccaggagcccagggaggacccaggaaagggaccaggaaggagacgtaggcctggatcaggccaggagataaagttgcaaaatggttacaaggtgtaataggccacgctcggtagctcatgcctgtaatcccagcactttgggaggccatgccaggcagattacttgagtccaggagttcgagaccagcctggccaacatgcaaaaccccatctctttttttaatttttttattgtgtctttttgggttttttggttttttatgtttattgttgttgttgttgtttgttttgttttgttttgttttgtttgagacggagtttcgctcttgttgcccaggctggcgtgcaatggcacaatctcagctgactgcaatctctacctcctgggttcaagcgattcttctgcctcagcctcccaagtagctgggattacaggcatgcaccaccatgcctggctaattttgtatttttagtagaggcggggtttccctgtgttggtcaggctggtcttggacttccaacttcaggtgatccacctgccttggcctcccaaagtgctgggattacaggcgtgagccatcgcgcccagcaccaggtaactcttatttctgtgccaggtagtagcctaaactttttgttaatttaatttaatttaatttaatttaatttatttatttatttttgagacagagtcttgttctgtagcccaggctggagtgcagtggtacaatcatagctcactacagcctcagccacctgagtagctgagactacaggttgcgccagcacacctggctagattttttttattttttttgcagagacggggtttcactatgttgcccagtctggtctcaaactcctggcctcaaacaatcttcctgtcttggcctcccaaagcactgggattataataggcatcagcccaggaatttgaggttacagtgagctatgattggcgcccctgcactccagcctgggcaacagagcaagaccctgtctctaaatatatatatatatatatatatatatatgttgctattacagtatacccaaatgttaacatcctttgccaatgtttaaaacaaaggaagaaatatgttagttgtgaactttaaaatgtgtgtgtatgtgtgtgtgtgttgaagagaaacaaaattatccaaaattattttgggaaggaacatactaagacaatattaaaaatctttaatgaccactaaaggagggctgggcttcccagcagtaaggctgggcagcaggggctgggaccaatcccagcactggtcagtctgtaggcaacccatgtccccctcagaacctcagtttcttccaggaccatggatgggagacagagaccagtgcaatgcctgcattaaccctttagttgttagagggtagggaagttgctggctgggtacagtggcttacgcctgtaatcctagcactttgggaggccaaggtgggtggatcacctgaggttaggagttcaagaccagcctggccaacatggtaaaaccctatctctactagaaacacaaaaattagttggatgtggtggcatgcgcctgtagtcccagctactcgggaggctgaggcaaaagaatcgcttgaacttgggaggcggaggttgcagtgagctgagatcatgccactgtgctccagcctgggcaacagagggagactctatctcaaaaaaaataataatgatagccaggtgtggtggcacgtgcctgaacccgggaggcggaggttgcagtgagccgagattgtgccactgcactctagcctgggttacagagtgagattccgtctcaaaaaataataataataataaatagaaggtaaggaatttacagggtgtggtgcttggaggcttcagttcagattatttatgaattatcatgaaggtatggtcttttttttttttttttttttttttttttttttttttgagatagagtctcgctttgtcatccaggctggagtgcactggtgcaatctctgctcactgcaacctccgcctgtcgggtcaagtgattcttttgcctcagcttcccaagtacttgggattacaggtatgtgccaccatgcctggctaattttgtatttttagtggcaatggggtttcatcatgttgtccaggctggtctcaaactcctgacctcaggtgatctgcccgcctcagcctcccaaagtgttgagattacaggcgtgagccaccatgcctggccaaggtatggtctattttaataatcagcccaatactaagcatcaactgtaggtatgccagcaaaaatgtttgaaggccacggcgcagtggctcatggggaggctgaggcaggcagatcacctgagcccaggagttcaagaccagcctgggcaacatggcaaaaccccttctctacaaaagattgcaaaattagctgggtgtggtggtgcacactgtggtcccagctacttggggtgctgagatgggaggatcagttgaaccccggaggttgaggctgcagtgagctgtgactgcaccattgcacagcagcctgggcaagtgagcaagaccctgtctcaaaaacaaaacaaacaaaaagaaaaaaccaaaaatgtttgaagaccacttccccagaacagaggaggggatggatttgagagttcatggtggcttctaggacccagctcctggagcccaagagtgccagcccactgaccaggctctctgctcctctttgcccacaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtactgagccccccctctgcccacggccctcccctacacctcggcccccagcgccacccccgcccccggccccgcccctgccacccctgccgccgccgccgcccaccagtgacagccactctctgtcccctctaaggtcccacgacagtgatgtccgagggcgcccggaacattgtggcagccatgaaggctcatggtgtggacaaggtcgtggcctgcacctcgggtgggtggtgggatcatggaggtggggctgaactggggggtactggggaggcagcccaggggcctctgaaaggtgacgctgaagccattccatgttactgtgcatttactgaacaccagctgtgtgcctgaaccttactgggtgatgctggggacacagtggtgacctgtacagccctgggccctgctcacacaaggctcacagagagaggtggtaaacagatccatgatcaaactgacatccagatcatcggagctgggatcgggaggcaggcagaggggatagggccacaatgggagaaactacaggactatgggagcccagaggaggcgtccgacttaggctgagagaggtcagggtaggcctcccagaggaagtgatagagctgtggatagacactaggtctctgccctcacagagctcccgattatggggacacagacattaagcaaatagttgccctgtataatcatttatttatttatttatttatttatagttattttgaggtttgtttgagatagagtcttgctctgatgcccaggctggagtgcagtggcgtgatcttggctccctgcaacctccgcctcccggaggtggttctcctgcctcaagtgattctcctgcctctgcctcccaggtagctgggactacaggtgtgcaccaccatgcccagctaatttttgtatttttagtagagacagggtttcgccatgttggccaggctagtctcgaactcctgacctcaagtgtgtttcatgacacaaattgcctccctggaaagggaagtggcatgagggagggctgcctgatgattgtaattacactccaggcagaggacaaagcaagcaaagaggcctggaggccagacctagttggagggtaggaagcaaaatcatttatggcttttttcctcaagctctgaaatggaaaagtaatacacgagtaaacttgcgatttcagaatggttcactttttttttttttttttgagactttctgtcacccaggctggagtgcagtggtgcaaccatggctcactgcagcctcagtctgggttcaagtgatcctccccactgcagcctcccaagcggctgggactacaggcatgcaccaccacacctggctaattttttgatatttttgtagagacaaggtcttacttttgttcgcagattggaatggtctgctgttaattttagttttgtttttttctcccatgtctttttttctttgagatgaagtctgactccattgcccaggctggagtgcagtggcgtggtatcagctcactgcaaccgccactccacctcccgggttcatggtgcctgggaccaagatcgtggcccacagtgattctcctgccccagcctcctgagtagctgggattaccggcgcctgccaccatgccctgctaatttttgtatttttggtagagacaaggttttgccatgttggccaggctgatgttgaactcctggcctcaagcagtcctcccacctcagccttccaaagtgctgagattacaggtataagccaccacgtccagactctcccatgtcttaaaaaccaatttaactggttaagttttgcttccatgaaaaagacaaacctgtaaaattgatttaatttgctttcttttttctcatttttttttgtttagattgttttctaaatattaaagtcttaggtgtgccaggattttttttttcattaaaaaaaaaacaaacatagagacaaggtctcgctctgtcacccaggctggagtgcagtggcctgatcatagctcattgtacccttgaacccctgggctcaaggaatcccctcactttagcccctcaaatagctggggcaacaggtatgagccattgagtccagcttaactttttatctggaaatgatcttaaacttacagaaaaattgaaaggacaccagtacacctaccgtcctctgttcacagacacacaatgttttttttctgacccatttgaagttagcttacatacatcatggctgcttacttcaatgtgtaggtcctcaatatactttttaactttttattataaaaatttttaaacagaaaagttaatagtcgtgtgaacaaccatattccttttctttttttatttttaagtttgtagctatctatctatttatttatttattttgagaccgggttataaggctggctaatttttgtatttttggtagagatagagtttcgccatgttgcccaggctggtcccgaactcccggactcaagcgatccaccagcctcagcctcccaaagtgctgggattacacctgagccactgcacctggccaacagccatattcctgattttaaaattgtgattgtgttttgtaattggtttatctatgcacatacacatacacaaatagattttgtttttgttctcctaaactatttgggttttttgtttgtttgtttttatttgagacagagtctcattctgtcacccaggccggaatacagtggcgtgatcttggctcactgcaacatccacctcctgggttcaagggattctcctgcctcagcctcctgagtagctgggattacaggtgcctgccaccacatctggttaattttgtgtgtgtgtatttttagtatagatggggtttcaccatattgggcaggctggtctgacctcaagtgatctggcctcccaaagtgctggattacaggcatgagccactgcgcccagacttcctaaactatttgaaatggagttgcacacccacagacaccttcggcaagtcccaagaaaaaggacttttctcttccagcaccacagtgctattgtcacactttaattatcttccagcctctaattattagagtttaatcttccctccatattcaaatgtcaaggtaaaagattagaaagatttttgtcatctaaggagcttggagtttatccattagggcttggggaggattgttttttatggaggcatctgagaggattagaaagaaacccagagtaaggccaggcacagtggctcacgcctgtaatcctagcactttgagaggccaaggtgggcggattgcttgcgtccaggagtgcaggaccagtctgggcaacacagcaaaactccatctctacaaaaaaaaaatacaaaaaattagctgggtgtggtggtacacacctgtggtccccaatacttgggaagcttaggtaggaggatcctttgagcctagaaggcagaggttgcagtgagccgtgatggcaccactgcactccagccttggctgcagagcaagaccctgtctcaaaacacaacaaaacagccgggtgctgtggctcacgcctgtaatcccagcactttgggaggccaaggtgggtggatcacgaggtcaggagattgagaccatcctggctaacacagtgaaacaccgtctctactaaaaatacaaaaaattagccaggcgtggcggcgggtgcctatagtcccagctactcgggaggctgaggcaggagaatggcgtaaacccgggaggaggagcttgcagtgagctgagatcgtgccactgcactccagcctgggtgacagagcgagactgcctcaaaaaaaaaaagaaaaaagaaactaggggtaagttagagactggatttgagattgtgaactggagactggaggctgcagacaaaaacccacttcacactctgcaccgcagttttctcatctgtaaagaggaaatcctagaccaggcgcagtggctcacgctgtaatcccagcactttaggaggctaaggcaggtggatcgcttgaggtcaggagttcgagaccagcctggccaacatggtgaaaccccgtctctaccaaaaatacaaaaactagccaggtgtggtggcacacgcctgtaatcccagctactcaggaggcttaggcaggagaatcacttgaaacttgtaggtggaggttgcagtgagaatgatgtcatcatagctcgctaccgcctccaactcctaggctcaagggatcctcctgagtagctgagaccacaggcatgtgccaccatgcccatctaatttttaaaatttttttgttgcgacagagtctggctttgttgcccaggctggtctctgtgacacacctttttataaccactaacattactcaaactatttatttatttctttttgttgagacaaggtcttgctctgttgtccaggctggagtgcagcggtgcaatcacagctcactgcagcctcgaactcctgagctcaagcgatcctctcgcctcagccttctaagcagctaagaccacaggtccccacgcctggctaattttttaattttctgtagagacaggtctcaccatcgtacccaggtgagtctagaactgctgggctcaactgatcctcctacctcagcctcccaaagtgctgggattacaggtgtgagccactctgcccagcctttgaacaatttatatcatcccagtttgcacatgaggaaacaagaagctggccagtggtcgatccagtacttgactttaggcaaaacccaagctctttaactattcaccaaactgctcctaaaaatatttagcatagttcttggcttgaggtaaaagttctataaatgtcagctggtgtagcttggccaagttatagcttgttgaaagctaattcctgaacaaatatttagtaagtacctacaatgttccagatgcttctaagggctgggattggagcaggaaatgtgatagagtcacaggataactctagcgtgtggtggcaggggaagggtcctagggagaaaacaaggccccaagaaaagggattggtaaactgggctgggggagacaggattttgcaattttaaacaggacagtcaagaaaagctgcatggaaaggtgacctttgagcaaagtctgcaaagaaaacagggagccatgtggctacgagagggaaatggcaaagggtcctgggtcacacctgtaatcgcagcattttaggaggtcgagatggaaggatcgcttaagcccgggagttcaaaactagcctgggcaacttggtaagacctccatcgctacaaaaaaaatgtttttttctttttcttttgagacggagtcttgctctgtcacccaggctggagtgcaatggcacgatctcggctcactgcaacctctgcctcccaggttcaagggattctcctgcctcagcttcctgagaatagctgggattacaggcatgcaccacgacacctggctaatttttgtgttttttttgttttgttttgttttgttctgctttgtttttgagatggagtcttgctctgtctcccaagctggagtgccgtggcgcgatctcagctcactgcaacctccgcctcaagggttccagcaattctccagcttcagcctcctgagtagctaggactacaggcatgcaccaccatgcccagctaacttttgtatttttactagagatggggtttcaccatgttggccaggctggtctcgaactcctaacctcaggcgatctggcctcctcagtctcccaaagtgctgggattacaggggttagccaccagacccggcctaaaaaaattttttaaattagccaggcttggccggtatcatgccattgcactgcagcctgggtggcaagagggaaggaaactctgtctcaaaaaaaaaaaaaaatagtggggtttggtggctcacccctgtggtcccagctcctcaggaggctaaggcaggaggatcacttcagcccagaaagtcaaggctgcagtgagccgtgttcacgccactgtcctccagcctggacaacagaatgagaccctgtctcagagaaaataaaaaagagagggaaatgcatcaggggcagaggaatcagacattgccaaggctgggaggcagaacctggctggagcagaggcgtgtaagagagagtggtaggcagagtaggcaaggacgtcagagggctgatggggccatatcaggtggggccttgagggctggccatggggactttgcttctaccctgagtgagatggagctatggatgtgaactgataggggtgttcacgggctccttgggaggagggaaggaggggctgagagaccagggagtaggctgctgggctggtccaggcaagaggtaacagtggacaggaccaggcggagtgagaagaggtcagatttggaattattgtgatcagcagacagctcttacctggggtgtgagggaaagaggagccccagaggactcccctgtttttgcaactggaaagcaatggtcagccatggcagggttttgtcctggcatcaagacaagcgagcccttggctgggcacaatggctcatgcctgtaattccagcactttgggaggtggaggagggtggatcacctgaggtcaggagtttgagaccagcctggccaacatggcaaaaccctgtctgtactaaaaatacaaaaattagtcaggcctggtggtgtgcacctgtaatcccagctactggggaggctgaggcaggagaattgcttgaacccgggaggcagaggttgcagtgagccgagattgcgccactgcactcagcctgggtgacaaagcgacactctgtctcaaaaaaaaaaaaaaaaagacaagagagcccaggctgatcctgccctgtgttccctccagctttcctgctctgggaccctaccaaggtgcccccacgactgcaggctgtgactgatgaccacatccggatgcacaaggtgctgcgggaatcaggcctgaagtacgtggctgtgatgccgccacacataggtaagcagggcagggacctggtggcaccaatgccatctgcctgttccctcctgccctctggggagatctgcaaggccttccctgaccaccctaaaattgcaaaccttcctatgatattgtgacatatatatttggcctttgtccctgtttcctggcatacaactcctaaaatccttggaatctccaaaatggtaaatgtctttttctatgctaatgagttcactgagagctggcagcccctaggcagcttcaggtctggtcaccagaaagactaaggctggattacagggttgggactttcacctctggggagtggtgagggattgaaggttgaggggattaccactggctaatggtttaatccattatgtctatggattctggggcttcagcctcctgagtagctgggattacaggcctgcatcaccatgccccgccatggcttacatttctagtatgggagatagagattagatagatagatagatagatagatagatagatagatagatagatagatacataggccaggcatggtggttcacacctgtaatctcatcactttgggaagccaagacgggaggatttcttcagcccaggagtttgagaccagcctgggcaacatagacttatctctacaaaaaaaaaaaaaaattagctgggcgtcgtggcacacacctgtggtcccagctactgggaggcgggaggatggcttgagcccaggagatcaaggctgcaataaactgttgcccaggctgctgtactccagcctgggtaatagagtgagaccctgtctaaaaaaaaaaagaaaaagacaagaaaagatagatattaatggccgggtgcggtggctcacgcctgtaatcccagcactttgagaggccgaggcgggcagatcacaaggtcaggagatcgagaccatcctggctaacatggtgaaaccccattctcctgcccagcctcccgagtagctgggactacaggcgcccgccaccacacctggctaattttttgtattttttaatacagacggggtttcacagtgttagccaggatggtctcaatctcctgaccttgtgatccgcccgcctcggcctcccaaagtgctgggattacaggcgtgagccactgcgcctggctttttttttttttttttttttttttttgagacagagtcttgctctgccgccaggctggagtacagtggtgcgatcttggctcactgcaaccttttgcctcctgggttcaagtgattctcctgcctcagccccccgaatagctgggactacaggcgcgtgccaccacgcccagctaatttttgtatttttagtagagacggggtttcaccatattggccaagatggtctcgatctcttgacctcgtgatctgcccaccttggcctcccaaagtgctgggattacaggcgtgagccaccacgcccagccaagtgtgtgaaaacttccacacctcccgatttgaaagcattaaaggtttatgaatacacataagccctttgtttaggttcaatgcttagcattttatcctgttgtctctccctctctcctcctctctctctctccatgaatatatagttagattttgctgaatatattgtgaaaacatatatgcatatgtatatttggcttaatcatttgagaggaattgcaacattgtcgcacttaactcctaaatacctagacagccatctcctaaaagaaagatatttgcacacaaaacatgctcacacctaaggaaagtgacatttactctgtcatatcatttagtatccactccgtagtaaaatttccccaactgtcaggccagcgtggtggctcacatctgtaatcccagcactttgggaggctgaggcgggtggatctcttgaggtcaggagttcaaaaccagcctggccaacgtggtgagaccccgtctctactaaaaatacaaaaattagccaggtgtggtggcggacacctgtaatcccagatactcgggaggctgaggcacaagaattgcttgaacctgggaggtggaggttgcagtgagccaagattgcaccactgtactccagcctgggtgacagagcaagactctatccaaaaaagaaaaaaaaaaattcaacccactctgccctttttctttaagtttctcataacattaaccaggccaggtgactttaaaggcccacattctggatttttctagctgttttgtcacagattcagattaaacatgttgggcaggaatgccacatgggtgaaggtgtgtgttccttttttttttttgagacagggtctccctctgtagcccaggctggagcgcaatggcacaatcttggctcactgcaacctccgccttctgggctcaagtgattctcctgcccaagtagctgggactacaggcataagccaccacactcagcgaatttttgcattttttgtagagatgtggttttgccatgttggctggtctcaaactcctgagctcaagtgatcctcccaccttggcctcccgaagtgctgagattacaggcgtgagccactgtgcccagccagggcaggagcttcctgtctgctttgtcccaagcaaacacacagccaagggtgtgtgttccatactgtgcataattccagcctgtctctgtttgggtgatggtacattgtatccctaagtttagttggttactgtcagatagacagatatatatctatctgacaaatatatatatatatatatatatatatatatatatatttgttgttgttgttgttagagacaaggtcttgctctgtcgtcccggctggagtgcagtgtcacgatcatggctcactgtagcttcaacttccctggctcaagcaattctccagcctcagcctcctgagtagttgggactacaggggcatgccactgcacccggctgatttttgtatttttagtggactcagggtctccctgtgttgcccaggatagtttcaaactcctgggcttgagtgatactcctgtctcagcctcccaaagtgccaggattacaggcatgagccaccgccactggccagggcaggggattcctgtctgctttgtcccttgcttgggtgcccagcacctggccacacaataggtaatcaataaggatttatcgaatgaatgaagcaaaggatatagatgagcacctgcatatggaaagtccattcttggctgtgacaccacccaggctggacacacagtaggcaccctgggaaggtctttctgggggtcgaattttgggggaagggaaaggtgtctgctttatccagcccctcttgtctttacttcataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctag

SEQ ID NO: 36113 - DNA, 145845 bp, Homo sapiens
ttcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttgcatttggatgttgagagttgaaagttgaggcttcggaatgtgtctgctcaaaggggtgagagtgcatgtgttggtgctctgagttcatccgctagactctcaccggggactgcagcagcacatcggtgacttctgccacttgcgtgtcccagtagtcattttgtcaagccacggcacttaacgtgtgtgccctgtcactggcttcctgctcctctgtgctgttaggacagtgggaacactactgcaggatctttttgtctcatattagacaagaagtcttctgcagcagggaaggtgagggggtgagtgagagtggctggtcatgaaaggagctgttagacaactgctgagagggtatcttaagtagaaacgagccattgtattccagaaacaagatgtttccattaaaatcaagcctcaggatatgctattgataatatgtttattcaaagagctgctgtttgaataccttacaatagcttttaagttggaaacaaaaccagaatgtagaggtctggtaaaggagaatgaatccagaacaagtgatttaagaacccctgaactgaaacagacaacagcatgcccattgcatgggacatgctaagagggaggaaaataaagtcacctaagttcatgggaaaggaaggagcaattgacctagcaaaacaaacaccacactctatagctatggttacagcaactgtacaactaaaacagttatgtggattgacaccatttctaacatcactgatgcatggattattgctatgaattctgttaattgttagtacaattatagttattaattattgatgattaaaaataaggtgcatgaacatggtccttcttcagagtaagccctacccacattgccccaaaaaagagagtggacagggtcagaatatgccaacctctcactgtggtataaaatgtagcctccatgaaaaagagggagcatggcttctggtcaacttcatacccagaaacttggggagaagccagaccaggagggacttcatgcaatgggaaggctttgcttctctacaggcttggaattaaccccagggaagcattatctccacctgttgctttgagcacgtaaagtccctgaatgaaatgcttaattttacttaagagtaaaattggcagataaattgcaggacactcaaatgtgaatttcagataaataatgaatgaattttgatcacatcccaaatactgcagaggacatatttatattaaaatttgttttcattgttcatctgaaattcaaatttatccgggcatcctgtatttgtatctgttaggtctaaagagacaagccatatacaactgttttttgtaactctcatcccacaaaaaaaataggaaagtaattttttgagttttagagaaccttaaaattaatgctaagaccctaggaaatttcttatgtgctcatatgtttggtgaaataataggaaggcagcacagcaaagtgtttcagattgcaggttttcagtctgatggtcccaagttgaaatttcaagctctttgaccttggtcaagttacagatccccagactgcagataaactgatactgacagaatttattgatgcctgcttcatacctcatacttttattgtaatgaaattagataaaatagagtgcttagcatagtgcttgacatagtataaatgccctatatatgccaagagttgttacaattgttactataaaaaatgtggatgatgatcagattaaaagaaacccttatttgagaatattccttagaaccttatgtttatggttttcttttacttaatattattatatctgtttatctatattcttccagctggaaaaaaaatgtcacgtagtgaattaaatttgtagtaatgtcagagtctaataggttcagaatgccagtggaggccttcagttttgaaaaacagaaagaagatattagtcattccaggaaggtcaaagtatatggtgtagaaagggtgagattgaggtaattatgttcccactgcatagtttcacataatgcctccagttagcctgcggtcccatggcgatcccaacgccccaccatcaggtttcccatgctctttatagcagtaaccagaccttaaaccaaatacattccggagacttaataacatggtacaaacactttactgggttggctcaggagactgtatttgtgtatatgtggagagagaaagagaacacggacacattattcatgggagaggttcaatgtgtggatgggaagatattctaaaaatacattctctttacttggatttatatgaatggttattctgcaattctccttcagagggaatgaagaaaaatattaaggcaagcatggagcagtgggaggtgcttggctgaaggccttcctgaggttctcctaagctcttcaatagcccagcttgtggactctccatccctgagtacttggcccaagacacaaactctggcatgctgtattgctccatgtgagctggggaacaaatacatgaaatatgcacggaataaaaggatagagattgttggctgaccaaaaaggaagtctcctcttttccttgtaaaacaagccaaagcttccccccagatgcaaagtatttgaaaagaagagcacctgtgggtaactccgtactagttgtggggaggattttcccacctttgcttcttgacacttaatctactgagtcctttattgctgagtttatggtgagaacagtgattctcaacaggtgattctcaaaagggaagactgggcagtttcaataatgataatcagtattctaatatttcacattaaggaaaagaaagtctattcattccaccacacacactatagcaggaaaaactaggccaaactcttcttgaccaatatagatatggtagatatggaaaagaactggtgtgggggcaggaatgaagatgggaacacccccacaagaagccagtaacagaatgtccttaggaagaatgagattcttgtccatcaaaaagaagtaggaactaaacaaggtcaagaacatgaggttggaggttacattgtgtggctggaaagaagccacacagagactgagaaactgagaaggcaaggactcttctgacagggcaaggtggaaggtggtggaggaggtgacggtgctattactggctttcacagataaatgatagaataagggatacaattgacaacattgagttgtcaatgagttgcccctcagaggggaaaagaggaatttctctcctagaaacctcagttttgctattgttgtcattattgttgtgttaacttcactccaagaagatcagtgcccatgaacataccttacactggaaaaactgacttgctaaaaagaaactctataaagcagactaactctgagggacttttcctcttgacttttttccttgttgatacgtgaccccatgtcccagcacattgttagggtcctgccattaaaagattgcagaatgtttaataaaaacattttagatctctttaaccatctgctttcttttttcttatcttggtcacttgctttgaaaaaggtcccttgagatcacactaagacctccagttgctagcctgggttatcactctacattgctgttccaacaattcaattaggtaatctgaaccccttacatgcagtcattatttcattcatttattcacccaacaagctggtttggagccttacctcgaaagagcaataaaataggtacaaggagcaatagaaagaaggtatagtctcatctttgccctcaggggtgagcaattgaagagagaaaaaaaataagtggccattatatacagaacaatgtactaacattctataagagtggctacaaggtaagtgccatggaggtaatgtgaaaaaagtattattcctgtgctagaccagtagggcacaaaacttacttgccaaacaccaaaataggcttcaaaaaccttattttagaagaactggaatatagcagtggtggtaatagcaataatagtatggctcatagctgatactcgttgagtacttaccacatgccgatactgatgtaaacacttcccatgagtaatttccagtaactttcatgacaaatcaatgtgactggtatcgttattatctcatttgatacacatagaaaccgaggcacagagcatttgcccaggcccctgcttgtaagcagcacagctaggaaggagtttataaaagcagttcaactgtgcaaaagtagctaggaagaggtgattaggtaaatagaaatatatataggaatacttctagtcaaagttttgggaattccttttttttttttttttttttttttttgaaacagagtcttgctctattgcctgtctggagtgcagtggcttgatctcagctcactgcaacccctgcctcctgagttaaagcgattcccctgcctcagcctcccaagtagctgggattacaggcacatgccacaacgcccaactaatttttcgtattttagtagagacagggtttcaccatgttggccaagatagtctctatcacctgaccttatgatccacccgcctcggcctcccaaagtgctgggattacaggcgtgagccaccgcaccctgctgggaatttctttaaatgaagaaatataaaatgcaatttaaagaccatttttgcagtgcttgttagatgagtagcataagttacaaaaagttgagataacttcccttctccgtctagcctaatgactactttttaaaactactcacgtaagaaagaaaaaaactaatacttgttgacttctactatgtcccatcaacctccatgaattgtcttaatactaaatagtgaaaattatacccattttacagatgagttcattgacatttaagagtggtaattaccttaaccaaattttcatattcctttctctgctttctgtataccagggagtcttcctgatagagcactttttttttcaactatagagtctccttatcctattttctctttataatgatattctagggtgtgtcctccacgtgatgctacagtctatcttaaaagctgttgatttagattaataagtaggaaattcataacagtattacctatggaatacctggtctatgttatggaatttattataacattgctaaaaagtaaagaattccattccctagtgttccagggttctctgatttaaccagaggaagtcttttcttttaacatgataaaataaaaataacagaaactttgccatttgaactttttttttttttttttttgagacagagtctccctctgtcacccaggctggagtacagtggtgctatcttggctcgctgcaacctctgcctcccgggttcaagcaattctcctgcatcagcctcccgagtagctgggactacaagcgtgtgccaccatgcctggctaattttttgtatttttagtagagacgggtttcaccgtgttagccaggatggtctcaatctcctgaccttgtgatctgcctgcctcggcctcccaaagtgctgggattacaggcatgagccactgcacctggccatttgaactatttttaagggcacagttcagtggcattgactatattcacattgttataaaaccatcaccatcaatctccagaactttttcattttcccaaactgaaacccattaaatgataacttccgattaactccttcctccagcccctggcaacaacaattctactttgtctctatgaatttaactactctaaatactccatatacataatcatgcagtacttatccttttgtgcctagcttatttcatttggcataatgtctttgaggctcacccatgttgtagcatgtgtcagaattgcattcctttttaaaactgaataatactctgtttatatgtacactatgttttgtccattcattttgttgatggacatttgggtcgtttctaccttttggctactgtgagtaatgctgctatgaatattgctgtacaagcctctgtttgagttcttgctttcagttttttgggagtgtatacctagaagtggaattgctggatcatatggtacagagaaagttttaagacttggagtcttataggggccaggtaaaaaagaattgagtgaatctagctcggtaaagaaacgcatcctgtgagtggtgggcctcgataacaggaaatggaagaatccctcttccagagtggcagccacctctcagcattgccaggtcttctggttttgttttgttttgttgtgtctttttcaaaagaagacagaatttggattcataagtgaaattgctgactcaaattttttttaatgccctgtaggctgagtacatctgagggccagattcagcctaaagatcatttatttgcagcctctgctttacaatattttgaagttcacctttcgttacaggcagaatatgggcttacaaccagacagatgcgctgtgaatccagctccacaactttctagctgtttgactttgggcaaattggaccatcttttagatactcagttcctttgattgtaaaataaatagaaatacacctgccttgcaaaattcttgtgaaatttaaatgaaataatatatgtaagctgcccaacacaaagttagccctcatttctctcagtctgtccctccttcctttccctcatttttccactctctgcctctgtctatcttcaggtaaagctctacactatcttgttaaaagtattttgttatcaaactctttacttattccataaattcgagtacttttaacttttgcttaaaatttgctgattatccaacattggagaagaaggctgtcatttagtttttataatcattgtgtcttttatggttctttaaacagcctttccccagcaataggaggatctgagcagttaagagaaatgaatgctaaatccctagaaaagctaaagaaaaaagccaacagcagctgggcacggtggctcacgcctgtaatcccaacactttgggaggccaagatgggtggatcacaaagtcaggagttcaagaccagcctggccaagatggtgagaccccgcctctactaaaaatacaaaaaaattagctggacatggtggcaggtgcctgtaatcccagctacttgggaggctgaagcagagaattccttgaactcgggaggcggaggttgcagtgagcggagattgtgccattgcactccagcctgggcgacagagcgagactctatctcaaaaaaaaaaaaaaaaaagcagctttgatatgacaaggataataccttttttcctctcataattaaatactaaatctgacttgtcacagtttcttgaattaaaatgccaaaaacactcccctactttagagttttttctggcttatagtaaccacataaatataatgatggccagacataattttgagaactttgattggttaaaagccattaaaaccagattgctagtatatgctttgagtccaaaccttagcatttccaaacaatcatttttttctaaaataagtaaacctagtctattgatgtatagtgaccatacagaagaatatttaaatacctactcatatttgcaaaagagcagcattcttttttcaactgtttttctttttggctcttggtgtggtaaagttaaattctgggaaatggtttactaaagggaagtttaaccacagatgtttgtaattccaacttaagtttcccatcaaagtcttaatgaaattcagctgccagcagttcggctctgaatctgagtctttttatcatgagaaacttgggggaaacaacattctgaagctgaatggtaatgggaaaatttccatattcagcccaaatcctctccataaagaaaaaaatacataaacaaattctgttaaaagcgggaggagagacgggtgaatataatttgagtaatatgcaaaatgaccttcttttcactcccaggactttcttagtttttatgttgtgttttggtggaggctagagatccgtgtttacctaaatggagtgaagtatacacattttttacttcatgagaactgatgagttagagaaatcccgtaacattaacagctgcattagcacaagtctttgcagagtagaccagtcatccaggctgtactctacagctaaaagggcccctgagcatgatgaagactttgcatattaatatttattttgaaattatgccattttggagtggcatgattgcttcaaaggaaatcaaggactctaggaatcaaaagtaccttcactaaaacttccctcacacacacaactattacatggaacactgttgtctatgtacaaagtgaaatgcaacatggcatgctgaaccaagcagctctagaaagccaaatgtcagtccaaagaaacacataacatagacaccagccaaagggaagagaaatgtctagtaagcctcaggccctgggatgctaggactatagaaccctctagaatcacaacacagagccacagcacaaattcgggttctgaaaaccctggcaagcctcttcttccacagcagaggtagtccaggatgcctttcaaacttcatggctacatgtgtgtgtttccctttgatgaacagtgatacaatttgacaagctgaaggtgttacctaagtgttacctcttttcctgctatctgtcctgagtcctaggtggttctgtcaacccccaggtcacagatgaggtgttaaatgcctgctatttggagattaaatggtctgaatatctggagatgggctgcggtttaattgtagtacatgaataattgcctcattttatattgttcctttgaaattgttgtctgccaccattaatgccaatagacaccctgaaattccattcataagagacctgaagcttctcctgcagcacagaattcagcataaaggagacctgtttgaaagcagagtcagtgggtggttattattggttacataaatctatcataccttgcaatatgagccatgaaatcaaaggaatcatagaatgtcagacttaggaagtttagagattcaactctctcattttgtacgtgagaagagaggggaggtgtgggtgcttgaccccgggacacaatgcccattagcagtagtacacgtgtcacagggtaaacccccaaattggagttcagcctgggaggccatgtgggttcttggcttcacacagggaggaactcaagaaccagccgacagagtaaaatgaaagcaagtttattaagaaagtaaaggaataaaagggtgcgtactctatagacaagcagtcctgagggctgctggttgtctgtgtttatggttatttcttgatcatatgctacacaagggatggattatttatgagttttccaggaaagggatggggaagtctcagaaccgtgagtttctccacctttcaggccttatagggtaacttccagacatttcatggcatttgtaaactgtcacggtgctggtgggagtttcttttggtatgctaatgtattataattagcatgtaatgagcagtgacagagaccagaggtggcttttattaccatcttggttttggcgtggtttggccagcttctttactgcggggtctttgtgacctgttaccttgtgaaaccagtcctgctggttctcactttttgccttatgttcttttcaattgttttaatggactgaatcatcctagctttattttgtttatttatttatttttgaggcagagctctgttgcccaggctggggtgcagtggtgcaatcttggctcactgccacatccgcctcccaggttcaagtgattctcctgcctcagcctcctgaatagcagggattacaggcacccgccaccatgcccagctaatttttgtacttttggtagagacagggtttcaccatgttggccaggctggtcttgaactcccgacctcaggcaatccccctgcctgggcctcccaaagtgctgggattgcatgcatgagccaccatgcccagcctcatcctagctttagaactagtgattattacctgagcatatctagatatcttgtaaaagatatctacttctaatatattattactcttttactctttattgtttctgtttatccttaagttgagtcatcagtaggagattctcatggagctgagtagagctagactatgagtctgtaactttctgattcttggctccatcactaacaaccagatcacccttgccaggtaaagaaacctggtcaattcctctacccagcagttttagtataactgctggggcctcaattatactaaaaaaaaattaaaactgattacttctagcaacaaaattctacaattatttaataaataagttaaaatttacgccagttaaagggaacctggcttaagatactgaatcacatagtcatagctgttgccctagttagaacccaagactttaagagtccagagcctgaaagaaacacagggccctggcctgtggtagggggtggggaggggtggttcctaacaactccagatgtggggctggggctgatctgcagcacaggttaccaacccagccacagacatgagcctctccaaggtgacacaacaatgaggcttcccagacagcctaagtgtgtctccatgtggtcaatgaatgttcatgggtctcccatgccagggtccaagggtgctaccccctactctatctggaccctccagaatgaccctaaacctatccccactgcagagagacagcaaagtagacaatggaagagatcagggactggagacctactgagcagagactcatgtcaacacataacagttcagtgccaaatggcagagggtccagagaggagaaggtatttttactcaatgagaaaggaagggaaagccagtgacagattattaatcattataaacatcaacatgaaatactcacattatattatacagagtagagctgtccactaaatcttaataacaatgtaaagaagaatcttgcagaacacaacatgtggaagcaaatatgttcaaggaactgtctcgaagtcagaattgttggtgtgtgaggggtgtgcactagtgtctaaatgcgctgattgtcgctggctatggggaagaggggtctaaaacattgctactgaaagtgtggtccaaagatggcagcatcagcatcacctgggaatgtgttagagatgcagaacctcaggttccaccccagaatcagaatctacattttcaccatatccccaggctgtttatctgcacattaaaatatgagaaatgctaggctctcaaatacaggtgggcttgaattttgaatggatgtaggggaaattgcaaatgcagaaaatggcaaaaatgtttgatataattatggaggaagacccaaaaaacataaattatggctaagtctagtaagggggttcacaagctcacccatactacctgaaaatgtgtacttcagaataaaacacaagcctcaaagcaaactgctactttgaggcatctaaaggaagctgataagataaagtcacttcctgaaaccatggcacacacacactgggtgctcagaacatattttttgagaaaagacatgaaatgacatggcaggtttttttactcccacctaactcttctcagcacccatagcccagataccaaaacactgaagactctgtgtccttgaaggaagtagagcagaggcaggggaagaatttacttggggaatctgctcaaaaataggatgttgctcacacttttcagggaatagtgggattgtgatgtttttcttggtaacaagggagtcattctgattcaggatgtgtcttcagggagtgaggagtgcagtctgtgtcctagactagaaagataatgttaggagacagggaagacccagttccccaaaatgaaaattgccaattgctcttcctccagctggtccttttctatagggattgaaatctgcaggaaagtgcttttgagtcaggtctgtgtctccttctctatcagagccgacgtccccattctccctgcagactccagctatccttgatgcagcattttagctataattactaagcacttgattagcacttgctgtgttgcaagtactgttctaagtacttatgtgtattataaattcatttattcttcataacaaccccaagaggaaggcattaatattaaccccattttactgatgacaaaaatgagccagatagcagttaagtaactcatggtcatagctaggaaatctgacctcaagctcctaaccttcacattataatgaccctctaacatctgtttctaagtctcagagtgccttagcaataccccagctaataaaggtttcccgtactactgcagtagtcttagcagttgacaagtctgtaaagaacatttaaataagtggtatatttggtctttggccttgtttttaagttatagagtaagtatcatctcagtaacaatggggagtccttcccttaaacatgaggaggagtaacagtcgttgagatttctgaatgtgtatatatatacacattcatatatatatcatatatatacattcatatatatcatatatattcatatatattcatatatattcatatatattcatatatatattcatatatatattcctatatattcatatatatattcatatatatatatatattcatgtgactccagctatgctgagcattggtttttcaatagagtcctgagtctactttgtggacctacaacttaaaagatcttgaaaaggatatggaaagagctgacacagtagtaaaaacatgacctcagttcctaaaaaaaataaaaaataaaaattgagctacaatatgatccagcaattccactgctgggtatataacctgaaaaaaagaaaatcagtatatagaagaaatatctgcactcctatatttgtcacagcactgtttacaatagcaaagatttggaggcaacctaagtgtccatcaacagatgaatggataaagaaaatgtggtacatatacacaatagagtactatttaaccataaaaaaatgagatccagccatctgcaaaaacatggatgaaactttatgttaagttaaataagccaggcacagaaagatgaatgtcgcatgttctcacttatttgtgggatctaaaaatcaagtcaattgaactcatggacatagagaatagaaagatggctaccagaagctgggaagggtagtagggggttggtggagaggtgggaattgttaatgggcacacaaaaaatagaaagcatgagtaagacctactatttgatagcacaatgggatgactatagtcaataataacttaattgtacattttaaaataacttgatgtaattggattgtttgtgactcaaaggataaatgaggggatggatacaccattctctatggtgtgcttatttcccattgcatacctgtatcaaaacatctcacataccacataaatatatacacctactatttacccacaacaattttaaaaaaaatacaaagattaaaaataaaacaattaaacaaaaaaatgacctcaggagaaatgattagacagagtatgtcaatcaggacaactaacgaaggtttagaaacagtttaccttttaaaatgtttctttacaaatgacaatagaaaaagaaaggaaatttaacaatgaaaaggattcaaaagtcagactttttttttgtttttttgagacagagtctcgctctgtcgcccaggctggggtgcagtggcgcgacctaggctcactgcaagctccgcctcccgggttcacgccatcctcctgcctcagcctcccgggactacaggtgcccgccaccatgcctgcctaatttttttgtgtttttagtagagacggggtttcactgtgttagccagggtgttctcaatctcatgacctcgtgatccgcccgcctcggcctcccaaagtgctgagattacaggcatgagccaccgcacccggcctcaaaagtcagacttaaagaaacataggctgctaactcctttaagcactatataaaacaatttgtctgaaatagtgagttattcattcagcaccccaaggaatacaagtgtagtgctgaaaggtaccattcaaggtagtagtgacttgatctggaacagacccaggtagtcttccggccttctgaactaagagaaggactgtagcagcagtcacttgtgaaatgcattgtaacctgaatgggggaatgtgtgagaataatgttaccccaacttttaatgtgcaggcatctctttgctatttctcctcctcctctagcctcatgttttaaaatgtttttccttctttattagtctgctggggctgccataaaaaataatccagactgagtggcttaaggtcaataaaaaatgccataaaaaatactccagactcaggtctcttttttttttttttttttttgagatggagtctcactctgtcacctggctggagtgcagtagcacatgatctctgcttgctgcaacctccaccttctgggttcaagctattctcatgcctcagcctcccaagtagctgggactacaggtgcctgccaccacacccagctaatttttgtatttttcatagaaacagggtttcaccatgttggccaggctggtcttgtacttctgacctcaagtgatccacctgcctcgatctcccaaaatgctgggattacaggcatgagccaccgcacccagcccatttaatctttattatctgtatttattacctctttataggcactatctccaaatacagtcacattaggggttaggtttcaacatgaattttgaggggacacaattcagttcatcacacctacgaagtgaaatgtattaagtagtaactcatttcttaataaggcaaagtaatttataaccacaaaagaaatcttctgagaaaataagatagtgcgtgtaattgccctgttttaactttaagcaaaagccatatttagcacttcattttaattatacatttttaataaatatgtcactattacttttatttatttgtttatttatttatttgtagacagagtcttgctctgccgcccaggctggagtgcagtggtgtgatctcggctcactgcaatctctgcctcctgggttcaagctattctcctgcctcagcctctggagtagctgggactacaggtgcccagtacgcctgactaatttttgtatttttaggagagacagggtttcaccatgttggccaggctggtctcgaactcctgacctcaagtgatccaaccgtctcggcctcccaaagtgctggaattacaggcatgagccaccatgcctggccaacttttaattcaatattttgaaatatggaaaatagtgtgtcaggctctgtactgccacattgtatttcttaggtatccagggacactcgattgatcagtatcaatatcttcactctcttttttagcaaaaaggtgcacactacctcagcaagtgccaagtatcctacaaagatgagtaaaacacagacgaaacaagcacactaataatgcaatacaactaatttcttatgttacaaaaactcttcaaggatatagaaggaacattcactcctggtggaacattcccaggtgacttcatgggcaaggtggcatttgagttgaatctttgagattgaggaaaagaatacaagctgaggggacaggatgagtaaataaaaagacacagagtttcttctggaaagggaagtagtctcagtttgttgggctgaaccacagggatccatcaaagacttcatagcagaagaaagagaaacacagtgagaatcatgatttgtcaacattaatcgggaaacagtctcctggctagattgggcaataggtggcagagagcctggaatcaggataacccatgtcgtgcattggtaaccatccaggagggcctaaggaggcctggatttggatgctagctgtggtctggaaaggagagaacagatgctgggatcatcgccaaggttctgtcaagatggtttgtcatatgtttgaagagtaaggatgaaggagaagtcaaagttgctgctgatgtgtgtagaaatgtattaaatcatgggagagaagtctctgcagagacctttcaacataaaacctactaaatcagtggctctcagactgaggctccatggaaatgcctgagggttcaagtcctccggagcagcgggaggttgctccctacctccttcaatcacagcagcctcttttttatctgttttatagatgaatttcacatgaaattttactggtttttaaaaaagggattctctgctctaaaatatttgagaaccactatgctggggcctcccaagctgatattctacatcaagactagtctccaaaatgttactcaaaatcttattcaaatcagtgcctcctaggcagtttcccagcagtacacacgtctgccttgggccagtacttgtcactggttgcattgagcagctgatgctcagagcacccctgtaatagctccaaacatgagctagaaatctttaaacaattggtgctctcctgagagatatttttatgcttcctgttccctgtctgacggtatttttggcccttttcaaggaaattaggaaattccacttttgtctcggtcattaacctgggagtactgaggacaacaacaaaggagcttcggagagaggataggatggtagtgggtagaccagataaccactatcatttgatcttcataggaaggaccagatgttcattcagtttttattcttctaaaccaattattccatcgcaatgaatatcatcttattctgaaacataaaccacagtttcttacctgcaccctgagctaaaaagatagctctcaagtcttactctctcctttctcgatacagtagttcaccccatttgtggtccagaagctgtttccagtgatctccaaaggggaaaagtacttccatgatgaacattatgtctataaaaatcaagaaaataagcatcaaaaactttagttttccatgcgaattaaaaaagcagcaacctaagcatttcatagtgtcatgaaggcaaactgcagcttgttttaatttgccttataacatatctgcagtatacctggggagaactgatgttctaatgaattaggaaagcttcttttatctccttctacctgtagcttgaagacctcagcttttaaaaagctgttgatattgaacaactgttaaattggcagttattcacaactgccaaatattggaatttccaatgactactgactcaggtagaaaatagtgttgatacttattaagctttcatgatttacaaagtgttttcctatatatttccacctttaatcttcacaaccatcttacaaaccaggcagtccggaggttattcatctaatttatgaaagcatggaaatgttaaatgataagcccaaagtctcctagcgtggaaacttgttgagacagcaggaagtttcacagagttctagactgttagaatgtgaagagcctggaaatcatcatgctgctaacatcattgaagaggaagaaaccagagctagaagttgagtcacttccccaagttcccacacagggtttctagaactggaaccacaaccaagtttcctggctctgaggtcagttgtctttctctactgcatcacagagcagggacgccgtcacgggggtgttgagacattaagtgagctggatcagacaagaatatatccatgtttaccttcgccttataacttatgtagtcatctgtgtcctggaactaagtaattcaattgctaaaacgttgaaagttctcttcgcctttggtcattatatttatctcaattttgaatttaatttataaccaaatcatgcatcccatttctttcatttcaagcattttttgccttggccccatatgctatcaaccccttaaaccatgctctcagcacctatacttagaaagtaagcattcaagtgcattaaaatttcagaatttccggctagagttttctggtggtcacataaaaataaacaaaacatccttgatcttaaaaggaagaaagaaagatctatttcaaaaatgaacaataacatttttgttttaaaagtttaagaattaatttttaaaattcctagaccatatcatgtctggtattcctcctgtacacagtgatcggtcaggtttccacatgaccttaagaaacttccctatcatgtaccaaaacaattgaaatgtgagaaattaatgaagaaaatgaaacgttgatagcaccaaagtggtccactctggcacttgtacccctccatgaccttgtcaacctgatttataacaattctgagtttcagcagctccatttttatatgtagaatttttctactgttaatgtcacagggaaatcaccctagtcttctaacagcaaaaaaatatatataatacctgtttctcgagaaaatctgccaattcccagcagaactacagaactttatgatataatccagggactttgctatgaacagcatctgctgagatatgccctgaacctaatagaggacaaggaaaaaggggtatttcaggggtttggggcagccccacatggtctgcaaaataggaaggtttttgggaggcaggacagttctaaccctgcccattccatggtccattttcaaaatggtgggcactttcacgcctcattctcaccctagtctttgatgtcaggaggatcctcagtatggtgagaataatactgtatttaagatgaagctgatgtctgtgtaaggtcagagtaatcatctttatgagtattatccgaagatatttggatatccgaagatatttggatatccaaagatatttgtaaggttctccaaacttctaggtttttattaaagggctgggctcttcctggtctcaaacagtatttgtggttactttggcagatgaagcacatttttcctgtgccctatgtttttggacatgcagtatatcaaagtgttcggtggaaataagcattctgttatttttttcttagcacattttttgtcttctcttccattcagttatgttgaaagctacgtgttggatctgttttttagttatgacattagatcttcatctgagattatctaaactacgttggttttcttttgattacaatctctttttttttttaatctgctaacacaagctcatgtttatctagaaaatgcgctttctcctcaaagtcatgaatcagcatgaatttcctttgagttagttcaaatcatccagaaattaacaaatttcaaaaaagaaaaaatatactaaaatgtagtcaaagctttataagaatactttatgtgctatatctcagctagtcactgagtagctgtcataaacctatgacataaacctactgtcatataccgatgacagtagagtattgaaaaaccaggtgcaccaggttcttgttttcattcttgataggttctaagttcattaaaccagtctcgcagttactcagagaatcacaaaaccaagtgttcctcttattatcttgcttagctcattttgggtaaaatgcatcaaacggcagaatgaaaaataaaaaaaaaaatttgtttttatagttgaatgacgttcttcctatgtataagttataacttgaaaattattactgcttccaagattcctaactttcaagccacatgagagtgactcatgggatcctggtggccccaaaggattaacaaggcttccagatgtgcctaacacttatttcaggaactagggcaagcctccaatattatctacaatgtgtggagagagggtggcgtgtccatgtgagtatactgtaagccagaaggttgctgaagatgtcacaaaatttaattgctgatattaaactaatccttccaaagaaattcccagcaagtagaaaaaaagtaaattcattggtgtttttattgagagagattaccaggagtgaaagatgcctgcttgaagcaatgaaacaacagacagaatataagtttagcctctctaccttatgaggagtaaactaaaaattgccctatgctttctttcagcctcagctttcctcctttcagaaaatcctccacaaaccgcacatctaccaaagaaccatttttgattcccgctcttccctatgttaaaagtaatctcttgctcttcttagctcactcagcatttctttgtacctctcatgatattatagctcttagcactttcttccagatattctagtaagttacagatacagcttaaatttcccccattgaacccctgaaggccagaagggtccatgattcatcttctgattccccaaattgcctgtgcaagttccttttaaaattcgtgctcaaaaaaaattgtttatgcattccacaattatttgttgaaaacgcattttgtgccagcccctgggctgggccctggatagccagtggtacatgaagcagagacaaaatgaataaatgaccataccaaatactgaaatccaaaacagtgcctacttttctgctcatggtatgtgtatgctctgatacgattctgttgtgtaattctgaagaacaagtcaagatagcatttggcgtgacatcaatagtcaaccacggtgtccctggctgctcattccaggagctccgtgctgcgagtgagaatgccttttaagctaaaagctttgtctttcccactgtatatggaaaaattgactatgcactttcatggagaaggtctagctaagaaatgtttatattggaacaagtcccatctctaaatctgggctgttgctgaatggtattttgtttccttggatcagggaaggggtctggaaacatctgtaatgaaagtattgttttaaaatcagcacaatttttttcttcaaatgacagataacagaattgctttaaatcaaatactctcagccttccccattcatttcctttcataaatgtgtattattttgttgtcattaaaatggcagtgtgaatactagatttgttgcaccccagacattgccattccctttgcagtcattttcttttcactttagtttgtgttctttaccttcacttttagaaacgtgctgtaacagaatagctatctcgatcacaacagttatctgggggcaaaatttcaaagctacaaaatgatggtatattgtaaagcaattctgaaactatcctccaaaatttttactcaaaagaaatgtacacattatgctatttataaatgaaaagttaaagaaaatacatatttacattaaatagtatttcacaaaaatctaaaaatgaaatcttagggaagggaaattaggggaagaaataatacaaaatacccttaaataacatgaaaaggatggaaattctgtagcaattttgaataccattcatgctttaaaaggaatagaagtagcttatgaatggtttgtgatactgtagttaaaattatattcctgtatatttaccacttgttgcaaaatctgttttttaaataagctccccaaattaaggagctgagtgttcaggatggtaattcatctgccttgctttctgtaagcagttggtgcttggtgtatttgtttattaatgaactatttggaaatggccttgttaccagtgtccctgagccgactgccactctgaaatacttggattttagcctaaagatccattcttctgaggctttttaggtgtttgacacatagcagagttgtaaaatatttgctaaatgggttctactgctcacattttacaaataagagcacttggagtcgaatttcattatcatttgtctcataaaatttgactcataaaacacatgacagagtgggagttcaacacacaatcctaagtttggaacgggttacaaacactctgtggggtatagccttccttagtgttgaaggatgaaggtgttggtttcatggctcagtcagaattgcagtgatggtattttattagtacaatttatgggccacagttttcctgttaggtggggccagacatatgtcaagctgccacatattctgcctgagcagacatctgcctctgattcatgagggaaacacctgcacacatgctggtgtatattacacaaagaggcatccttttccagggcccattgtcagatccctcaaatggaacaaaggaggtgtcagggatacagctggatgtcatacgactggcttctattgaggttgactttgctaatgagggatctgcattatttgcttcgtggtctatttctatctacactatataaaaactgttaaaaactaaaacatcagttataaattattgtatttaaattgagaataattgccatatgtcaaaccaagtaataagagaggcctaatgggctgtctctgaggactatctgatagtctgggtgtccatatggactcagccacacacactcatggagcaaacctgagtttgcttaagagaggtcactccaccttaccccatccatcacctgcattctcccctccaagatgactggggagtggtattaagaccttttgatgacaatggcactttcctgagaaaaaagggagacatactaatgggatatcttctatgagactcttgataaatttgataaacttgaacagagatgacttttatcccgggtattccagggaaaggcagagatggacagcataagtttgtttgcaggcccaaaagaggtgtgagcttcagcaataacgccacagttttccagcatcattttcttcttcatcatcatcctcatcaagaagcgtggttgagtgactagagcactaatggtgcatcaccttgctctatgtaaacagctttcaacaagttgcttcttcgctaggcctcagttttcccaaatttaaaattaagaattagatacagtccttcccagctctggcattctgtgtttctgtaatgccaagacacatccaatacatattgattaagcatctgctctatgaaggcactgaggattcagcaacaaatcaggtgaatccagtttctgtgctcagggagttaagtcttccaaggaagaaagacaaggaactactaacttaaacattgctaagctgtgtgccctaaagaaaaaaagaatggcagctcactcaggagaaccagttaaaacaaataaccctggtacagacaagtccaaaaagaagagaagaaactaatagttacagaacaatttctatgcctttatattgaacattaaatgcattaaatattagttgatcctcacaaccattctagaaggtaataaggtgagcagccccattttttcagaaagggaaaccaaagcctagagttaaataatctgggcaaggtcacccaggtagagctggaactgaaatactgatgatctcagactttctgctgcctcaggctgtctccaaaggacttaactataggaaattacatccactgcaaggaacagattgcagtgtgtcatgtcatgcccatggcagatcaatcagttaggtctagaggctgtgctatcttaaatgtaagcacatttggaggagaaattcattcattcactcaacaagcatttactgcacagctgccaggtgcatggtgaacaaatggggactgaacacagacatacatggacatttcttaaaatggcaaaaagtagatttatcatatcctagccattttgtatgtaaatgctaaagaagtaatacctaaatgtgcatgttcctggggaaatagaagtagttacagagctattagaagcataagaaaaaaaaaaggacaaagaattttaaagaaatttgttccccacatatgaaacgttcttgattctttcatttaacatttaattcactacaattgtattgagaaacctatcaaaattgactagttgacatggatcccacctttgaatacaaacccttatctattttgattctctgaaaatatgctccatcaattgaacaggggaaaatgtcattttgctcaagttgttataaattatgatagaggaattatgatacgcggagtgaaatccatctttctttagatagtgcaatcatctttctttagatagtgcaacttcaatccccagatggatagaattccatttgttagctctgttcagtcttctactagctattccagaaatatgccttgtaagaagcacttatgtccatgccgtttcctacctatggcccccagtgagaccatgcgaaattttgttgtcaccactaaatgaaggcttagaatagttacagctaaaaagacctttccatttcaacaaagaacaattatcttgcaagagatgacttcaaagagttgaactcaactttttgaaatggaaagttgagttcaggatgttggaggagataatgggtgttggtatggttttggctgttttcagagactttgcctgaagaaggctgaggaggattagggttatttaaagaggaggagaggaaagcaagggagatgggctgctctccaccaacaaagaaagtgagaaatggggccatgaggaagacatgattgaaagaagctgaatataagtaagcctaaacttttggcctatttctagctcagtctatgagccacagggatttctggtgtcgtatttaataattttctaacaaaagctgactgtgcttttattttaggatttaaaaccatcctagttggtaaattaacatttttcaatgagcctttgaaatttggtaaaggcaacttgattatttgaaagagtccttgaccttggactgtctgagaaagaaagtgaatcaggtatcacttcgcacatctgctggaccactgaatagtccccagatcaagagccagctggtctttcctaccactgcttgagcaccctgagaacgagggtgtgctggtgactctgcacctgtccccccagatccagaatctgcccctgcctcaagagactgatgcccaaaggctacagcacacaagctcccttgcatttcagggaaagtaataggagaagggaaagttggggccattctgctccacttcctctctgcctcagcacggctgttcaggcagaagccatgactcccaagatggcagctcccgccggcaagctcccctcctccacagttccagctttccctggctttgtgtaacaggctttctttatccccttgggccctagagggagcagatctttgcaaattttactgtttctagcttttatggcctctccattccttgctcccttaacctgcccacaattcggtaaactctaattctcttctttctcttcatttacactctcttaggtgaattttgattattcctgctgggcctgactacctcagtgacaagccccctcctgaaattcatggctttttccatttccttttgtctagaggaagccttcccaaaagcatctactaccatctgctttaattgacaaattattttaccttcacataaaggaagagattatataaaaaatttttagcaaactataagaacataatctaaattccgtagttcagcttcatttgaattattgcacaatcttctcctggttcccccatttcaactccaggccagctggacagggcaacctttggcctgagcttgtgggttactcttgtcatgttctgccaatctaaggccacagatagttagggctcccattattagctctcttgatccctaaggaagcaagactgtctgagtttgggtcatagatcctttcttaggacagaaaactggcctctaaaccctcttacttaaattttaatattgtaatttctcagtcaactggaaaatgagagtattgtgcactattttgaggatcttttacctctgccttaaatagtaaggcccaactagaataaataagcaccgtaaaagtcctttgagttgcacatgtagcctcggacatgtagctttactgctagcataaaataattagtggaaatcagatttagtagccactcaaatattatagaagaacctaaaggctgatgtatgctttaactaagacagatatgtgtgaaatgtgccacatgggatgaggcagctgctagctgtaaggtgaaaaacaaaggaaggacaaattaagtaaggaatgttattttgcttatttttaaactgtgttaataataatgatacataaagtgaataaccaggaagttggggaaattatacacaagcgtctcaatctattgtcaagaccacattagtcacttcctagagatgatgttttagagatctcaccgggtatagacatggaaatcctatatccagacaacctaagtaggatcttttgttttcctttcttttctttttctttcctcatttgctccttttcctctttctttcattctttcatgagaacgtgtatgtcctccatggattttaagaaataacatagtcaggcggggcacggtggttcacccctgtaatcccagcactttgggaggccgaggcgggtggatcacgaggtcaggagttcaagaccagcctggccaagatggtgaaactctgtctctactaaaaatacaaaaattagcctggcatggtggcaggtgcctgtaatcccagctactcaggaggctgagacagacaattgcttgaatctggaaggcagaggttgcggtgagctgagatcatgccactgcactccagcctgggcaacagagcgagactccgtctcaatataaataaataaataaataaataaataaataaataaataaataaaatagtcgaagccctgagactctttctcagtctcatccccactcctttacccttaactggcctgatttctcagattcctatttctttcttcatacttttctttatatatgtgtatccctacacaatatattattacatcatattattttgcatgttttaaaatacagtataaacatcatactgtttctcctttgcaactgactttttcctcaatattgtatttaaaagattcatttgtagttagagatatcttcacttgtgaaatttgcctaattgctctccaaagtgttggcacaatttgccctcacttgcctcattctttaccaattcaaacccatttttctgctagcatatttttggcattgacttgctatttgcgaatgactatgataggtgatgaggacacaaaaatgagtaagacactatccctgttctgaaggagttcacagtgatttcagggaggcaagagtataaattaaaatttataatgtcatgttccgtgtgctctgatgaagtctgtgcaaggtgccatgtgagtgactgagtctgaaagtctagggaaatagttcccaggtgagatgaagtagggaaagacatcccaggcctctgtagcgtatgtaatagtatatgcaaaggcaaggcgggccaaagcatgatattcatgagggttgtggggtatgtgattgcattagagcagagggagccaaggttgatcctaaagaaatagtttaaggttggatccttgtatgtcatgctaaggaattttacatattcatgtaggtaatgaatgaagagccactgagaggttcaaagtagaaaagtagtacgataagagtttttaattaattctggtaatgaagaatgaactggaaggaagaacttctggtgatggagagagtagagtggagagaattataattatccgagagagaaacaccaagatcctgaactaaatagtggtattgggaacaaggaggaagaatctccttggtagtatttcagaggcagagcataaactctacaaggcagcagcctacaaagggaggcaggaggtaggaacagcctaacccaggaggacgcaagggcatgcattatgtgtagagaatttaaaaacaacaataaaacttactaaaactcagtctgctttttattatcaccatgtgccagcaattctaaacaatgtcaatgacaaaattatcctccctgagaactcttttgttgtttaaggtctaagcagttgctgtggttactgttgagttttgataatataacaaatatgtaaacttcaaattagcacattccaatttcttaacctttagtaaacattgtttactacatttggagaactcctagtcctacagcccaccccagcataggtaggggtatcagtttagagagtaagtttataacagttcagaactgtgtaaggtcaatctcacttgagactctaatctctgtggtacttcatatatctgcatttaaacctcagattcgaaataaacgataatagcacagtgactctgaaaggtaagataacttgagtgcttacattgtgtcattctatgtgcaaaccatcctctgatccttgaggaattccctcttctggaagtatttccaaaaattactttaatgcaaaatacattaatgtaatttaaaagtgttagcccattaccttttctttttatgttatatattctttatctttaactgagacataatataaacataatataaggagaaaaagagatttgggagaggctatgataaagtcagtgtgggacacactcaacttcaggtgcctataaaattggagatgggcttgtctaacaagcacttagaaacaagggggtggcataaaaaactaagatcagggatatgtagagagacttaggaattaccaaaatatagctggaggataaaattgggggagggattaacatcatccacaaatttcatccatacataaaagtgtatagatagaaaagagggctaaggaggttaccctggagaacaccagcaatgtagaagcagcagaagatgaaccacttgcttctgccccttccccgtcccctgccaaaaaaaaattaaattaaaaaaaaaaaaactgagaaagaaaggtaggcaggggaaaagccagaagaaagagttgtcctggaaatcaggagaagagagaacttcaaggagggaagaaatttcaaaaatgtttgctttttttttttttttttttttgagacagtcttgctctgtcgcccaggctggagtgcaatggcgcaaactcggctcactgcaacctccgcctcccggattcaagtgattcccctgcctcagcctcccaagtagctgggattacaggcaaacacctctaccactggctaatttttatatttttaatagagttggggtttcaccatgttggccaggctggtctcaaactccttacctcaagtgatctacctgcctcagcctcccaaagtgctgggattacaggcgtgagccaccgcacccagccatcaacaatgttaagtactggaattccatctttgtgagggcaatttcagtgtgcaatggaagcagagccagacgatggatggaggcatggatcagcatagcatgaaggaagcagagccagtgcgattaagttctcactcaagatctgctggacaagaagaaggaaataaaggggaggcagacaataaaggggagggaggatattcttggatatatacccaagggagggatatatgtataaaagggagggaggatattcttggataataaaggggagggaggatattcttggaggataataaaggggagggaggatattcttggatctgagcccaggtaaagatgtcaaggctcatccaacacaggttgaagcacctaagtgttctctttgcctcccctcatccctgtggatgtgaaagtgcatggtatgtgagaggaaggccagatgatggggccaggtgtgatggccagagatgcgtggatcccagagcacagatagaaggcttctctttcctatagtgaaaagagtactgcttctgagatgggcagaggacacaaggatgagtcaagacaaaggggaatttagaaaaaaaagacagtatgagatttcccacccaatagcctctgtgttttcactaaagaagcaggattagctgctgagagtaagagggtacaatagaagtttgggatacatttattttttcctattaattcacaatagcatttcttcagtgatgcaaaaacctgtgaggaagagcaaaaggaaggaaagacatgtcctgccagtcactttcactttgtgccttgcatcttgagaaatctagggtgagaatagcactgaaatacccacaggacctcaagacagaagcagggtcatctaccagcaatggacgctgatgaaacaacccaactgccttccctgagtacactgaagagaagctgttgtcatttatagacagttcatcctccaaacttcttataaaaagaaaagtaatttaggcagacttttgcaagactgtaggtcattaaatggtaatgatcaaactggatcatccataaaaagcacttagctcagtgcttggtgtctgtcagtaaattattagctgtgatttataaaaaccagatgaagatgacagagatgtctttcacctcacaacattgattccttctaagtagctaaggagtcaaatcaaaatcccctaaatgcctataattctgaagtcctttctctctactcattcttattgctaacccttgtgtgccgcatctcttcctttcttggaaatgtgtccaaggcatttgccccagtaaattaaataaaactgagtcagttttcagatgtaaaaaaaaaaatctggcagcatcagaggctatgttgtgtaaccatagcttggaaggcgaggagtgaaaagaacaagccagttacaggaggtgatgtgagatgaacccagagcagaaagccagatgttagcaggagatttatttctagaaaaaccaaaggaaaaaaggcagcactgaagcctcgttatgttatataagcaacaatctctactataaacaagtgacttgacaattactttaaataattttcaagaagcaaattaaagaaatgttcattagtattaataaatacaatcatcctcaaacccaacatttctaaaagaaaacctgtacggctgtaggggctgtggattttcttagtttattgtttcaattagacaaataaagagggctatttattagcaagcgtagcaagtacttcaacacacgccaaggctgttggtatctacagtccaaatagttgatgaacagggttcagggactgttatttgagagctgtgagtggagcactggtttccacccatgaagcccatgaagagtgctgaggagtagccacagaaatgtgatgtaaacatgtgataaccctgtctccactctttacaaaattaaaggacttggcttaagagtggttaggatggctctgtgctccttggaattcctcaggctctaagtcacagtctctattttattgatggttaaattgagaactggagtgttttgtaagctgagcaaggcatggcggatatggggcctgagcagtaagcacaaaggtaactctctaggccaagtaggggaaaccagcaccatagtctgtgtttggtttttggcctagctttattatgccaacctaagaaaaaaatgcctttgaactgcataaacctccgaagaatgttgaaaccactttcctaattgagttatggtgaaatcgctgtcaaaatctaaaaattaactttgcctattaaaatgtggggaatttcaattatgcaaacaagagcttagagatacccaagggaggatgcgtgagtaattgtcttcagattcaagtaaaatcaatcaagaagccaacttcttggtaactgcaacacataatccatttagctcattttggcactttataggtttgtgcactaaaaatcaggacatgttaagcctgatctgaaaaacatatggagccaaaagttagcaaaagcttaaattcagaactgcttgccatttcagatattccatattttatttttactgacacagaaaaaaatggcttgtgaaatacctactcatttaatatattcatatgttctcagaagtcattcctccttagaaaagggtggaatattttggaaatttttgaatagattaaatcatgtttttctccactagaaaatccttgaatactatctgattcttaagtctgcccaagttttaggcagatggaagtcagcattgtgcagaaaccacagactcttaagtaagggcacacagttttagctcctaactgagcataacattctatcttaagctgacttttattatttgctaaaacaaaacatggaactcactataactaaactggaactaaaaatcattgttgtctggaaacaagagaaaagtggattcatcaaatacatacaaaaacctaagcagaaagataatgtaatgtgggctgttaaatttgaagaagactaatttggatggtagcaatgattctgaacaccagtgaatgaatttagagggattttgggtttgtttttgtttttatcctttctatttggagcctcaataaactgaagcaaaagttgttgaatcaaattctaagtctaattcagaaaggaagatgagttgagtcaatatatgtcatatgttcgtagatctttggttggaaacacaatgcaaataactattccaatcagctcctatgagaatagacactagggctgtagagtgtgttctttctgatggaattttgttataattaattcttcatcattcgctggagctggagacttgggtctgatcctctttgggactcagaaacctcagaatttatctcatactctccgatgacaacttcaaactcttcctaaatcccatcaagttttgccattgttggtttgtttaaatgggtaattagggaccttagatccctagaagatctattcgagtatgtaagtgatttaataaatcaggcttctcaacagaaattctgaagttctctgagattctgtatctatgcaaaagtagtggcttgtgggcaattaattagctcctctgtgatagtgtttgggaaacggtgagatttttgtgaaaattttttaactaaaattttgttacttagattggtacccactttatttaataactgcaaatgacttaaaagtttgccatagccaaagcatgcatactggactatccttcaaaagaaagtgatttaaatatttttagaaaatgtttaaaatgttatatccaatgacagtattgttggtatgactctagtgctctcaaggggctcttcaaatgaagacaaaaataatcagatactcgtataaaggtcattcacttggtcctctttgttaaacaatcttaattcattataactatatcttatgaaataaataatattatgatcatatgataaacctctggaaataattccttctgcagtgataacaacatgtcctgtcatcccagttcctttaaatgtaattgacacatgtagatacaccacactcatttcctcataaagttacatctagttctcatttccataaatgtaaaattaggcaagtacacatacaatgattttactccaagccagacctcatactaaatataacaaagtaagcaaatgggaattttcactcttatttttcaaaggcagaagtaaatggtatggattaattcagtcttaatggtagagcaggaggcaagctgtgataataggagtctcttaataataaagagctgtaaaagatctacaagtaacttagtggaaggtaattggtcaaagagaaaatttggctaaaataaatatttttaaaagtcaatatcccattcaatggttttcatatattaataactatgtatttttaagtattgtgtctattagcaaagatttttttctgggatttaaaggaggcattttacattttttatccatttcagcctgctttgaaatgttaatagcagcaaaaatttggaaataacctaaatgtccaacaagaaatgtttggttcaatatattaatggcacgcaagatggttaagagctaaaacttgagggaaaaaatgaaggatctaaatcctgggtccaccatttcttatctgtattagccggcttcagtaatacatctctgtaagtcacaaagtcctcaccagtaaaacaaagacaagggaacctacctcatagggctactgtggtgtcaagtgagagaattgtgcaacataactgacacagtgacttaaacatggtagatattcatgttcaattaaataaactttaggtatgtatttatttatgaggggcagcaagttatagcaaagaaagaacaagatttggatcagtctgaactcttggagttgtatgacattgctggccactatattataattatcatcatcattatccttgttattactatcaatttttaaaaaggccatggcaccccagaaggtacagatcctctgaatgctaagattgtgtttttacagttgtctagtataggacaggcttctcatgtggaaaagaggattcagtgtggtatcaaaaaattgattggaaggcttcctctcttactctctcatacatagacattcacaaacaccatctttgtttagtaaactgtggagactcttccaaaagaaaatagacactaatttttggagaatccattcagctttcacaggcctctaaatagcacaggtgttagaattactaaggataacgattacattaaccaggagcaaaactaaaaatacatcgttctactttcatacttggaaatatcggccttttgatattacaaaaaggccaattttgccaggtccttcgaaatttcaaagaaagattcagtaaaaataaataaataacaggactcactggagccatgatgaaatatttccacctaaaggaaacaatctttaacagctcatccttcagtacactcaaacttctcttgaaccacttaaaaactccattccagggagtcctccaaagttccacaacaccagacgcaagctacccaggacatgtgctctagcagggcatgcccagggcccccagatagatgactgaaaaatataattctttcaggtggacaaggcccagcaggaacgtagtgtgccaggtttccctgccagccctcctcgccctctcggcggggggccaaatgactcaacacagccctgttcgtacctcccttttcttcccatctcccacattataagagatcagagccaagttatccttcacccaaggtcataatctcagattggggagtggtaagtggataatgacaggctctcacagtgaactctcctcctaaacttggcacatcacaaagatttcatcttgcatgctgtccaacctaggcactggctgctggactgttgacaaagagttgagatgaaatccacccttaggagagagcagtggatggattatcagtatattctgtgggctcccaatagtatatatgtctccagtttgctgtccttgtccaaaccacccaaatcaccaagagttcattgagcaattaatatatacaaggcattgtgagagatgcttccaaacctggccaaatatcagagtctttggggagctttttaaaaatgcagatccttcacaatttttctgtaaatctaaagttattctaaaacacaaaagttattttttaaaatgcagatcctttggtttcactgaatcagaagctccccagaagactgtaatatggtcatttagagagctcagaaaccaccatttaagaggctactaagataactaatattaagaccgtcactactcttacccactactcttataaagaaaaccctgcagtcatgcaaaactgcaacacattcatgggtcatcagatcaattttatgggtcatgaccaggatatactcttaaatacaatagagaagttttaggtacattattactttgtgaatcttttctctgagacacatatatatggatatctatatctatctccatatctacaccaatatagatatagataccaatctgtgtactgcatcacaatgaaaacatgtatgttttactttgcggcaaagactaaaaatgtgaaattaaatggtctaaattaaatgcttcctactgcaatcttagtgtcttccctctcttgttttctagtggaaactaagaagcttaccatcaaccacaactctccattaaaaaattataaattgatcttctcttagccttatttctctaacttggaaatgtggaatttccttgcctttttttcatagacaaatgttgttattctttattaaacttcctccaaatggggtttattaaattttagttttaaagtgtgaactgatgtgtgtgtttttttttaaatactgtgaatggtgtttagtgactctttctttacagagtaaaaagcaaggggaaataggtttgcatagcaatcagagggacttcagccagatataatgaaaatttcctggtcgccagggaagtgcaaactacaatgggtcaatgggggtgtatgatgtgaaatcttggactctgtaagtctgtggaaacaaagcagattcttatctgtctggaattctttagacataaacttgtctgatgggcggggagcggatttccaggcccataatgccatttctgcccttcatcactgagacattccaaagaaatatcaaatgcatatccacagcctaatcacataaaccaggaacaatctcataatgtgtctcaaatggcacactaatgatatctggggagggcagctgatgattgtgcaggtcaattggtgcatgacaggatagtttaacatccccaaaagccacttagcacctctcaatctcatgagctcatcactaggataagggaaagtcatgtgttcctcgcagcattctgaagacaaatgaaatacatatatgaacagcacccacacaggacttgacaagtgtaagaactcattaacttccttatccctccctttaacatgttagcatctgaagaaacagatgcttttaagaactgaagttcatgaaagactcagttgctatcctatagctaagttgctctcctatagctagtgattgctgaaacgagaagtctttctttatttatagggagcatgacctcaccctgactaatacttaattgtggtcttgttttgttttgcttatactggaagaaaacattagcatttttttctcccttactgttacgtaataccttcttattcttccttgcaatgataagacagtgttaaaggcatttctgttctcctgaaaagtgaaaggagggaaaaagttatgtaacaaagaagattatatatacatcatctatcactgaatggtagtataaatagtttattttagtatgttttgtatgtatcatttagtatattcattttagaaatgtttagattgtttaataatcactttctctgatttcttctcagaaaatattgaccaaaatcaatcttttcaataatcaaaatggtttggtgtgtctgttgcagaaatgcaatgctggattctttcacaccctgtcgggagaatgtgtgccctgcgactgtaatggcaattccaacgagtgtttggacggctcaggatactgtgtggtaagttggggcacctataacacttcacgtacttcactgggcatttgcatcttgggtgaagataaaatatttttcggatgtttgagccacataggagcaaactgctaatcaagtgcttttgttcacccttcagcttttcctgtgaaacaactcatataaactacttctgattttaagggtccaccaaggcatatgcatgagtgtgcacgtgcacccggaggctcctgccccaccaccctcagcagctggttgcctgctgtagaccaatggcggtgggattgaaaatgatacatagaggaggaacccatacatccaaattcctctgtaatcgtatagtttgccatatgtttggcttcgttccacataaaccaggagaatgaaacagttgttgcctagcctattttagaacctaaaataaccaggtctatagatcaaaattagtttttaaaaaagaaatttaagtttgaacccaatagctgatgaaaatgaaagctttgcccttgtggtctttgcaagtctgtgtttaagcccccaggagactatttttttccttaactgaaatgaattctccaatagactgttcttcattgaagcatgatagagccttgtgcgaaagattgagaagtcttccagcagaaaagtacttgctacatatttcccatttttaatgaatggactgacaacttaagtgaaaatgggtgttgaaatatttaccagaagtggcttcagtggaagtcatagagggcatttataagaacttatgctcaaatagcatgttttccttcgtgagctgtgtgatacagcagaaaaattcttcaagttcccatctggcaaaaagaggttttccaaaactacaagagtatttttgcataaactataagaatacttatttaaatgcactcaacatttgcataattgtccctattagataatttttattttaaatggcctcttaggtgtgtacatgaaagtgatattttattcacacattaagatgcaaatgcaaatgtttttattgatctttaaccctagaagttgccatttttctagggacagagaattaagtgacaaaatactaatgttgctatctctttgtagtgtttatttagtcctgatatttgttttcccttcccccatcttcttaaataagcattacaaccaggatgtcctctgtcacagtgtaggcttctgcagctgccaaagtctactcctttctaatgcttccatctccggtttcctgttattttaatcccagtgacatttggggggaaaaatcccatggatacacttgaactaataacgtacatctctgataatttgaccaattaaaggttgtttgttatctgatttattaaaatataaagcagtggagactgtcaagcacatcagctgctgttaggcagtcaatattatgcaagactgagataaattaaagagggaagaagtccctcctgctagagtctattgaaagaaatgactaagccactctttttacaatgacattgtcagaatgggagcaatcatggctttatctctgacctagtggtgagaggaacaaacatcatgtgattccctccaaggtcctgtgacataacaggttctaataaatgtttagggatgggctagcatatacacatttacatgtgcactcagtgaagctgccaacattcctccaactactttgttccaacgcagaaaatgaatacaaaaagaaatagccattttattcatcttaatgatggtttctccacctcatcctgtccggagaaaaatatcttttttccctcattaatgtaatatatgttcagtgtaagaaaacagaccaaaaatatagatacattagtataattttcctattaaacagattattttaattataaatggcttgaagtacaaagtaaaaatcacccacattcctatcccccagagcgacacatatagatatattcttataaatttaatttagaaagaaagaagatatagtggctagggatggtggctcacacctgtaatcccagcactttgggaggccaaggcaggaggatcacttgagtttaggagttcaagaccagcctgggcaacataatgagatcccatctgtacaataaacaaacaaaagaaaaaaagaaaaaagatatatttatatttaattaaatgtaagtgaaggggcagaaaatgcttgcacatgaatataaaaagaattttttatttcacttagttgcaaatatgttaagtctgtggtgtcacactggaatcaaactcatttttttctgtttcctttggtgccgctatcccagactactgacggagaagacccaggtttttcagcttctgccctatcgttcattctcagctctcagggagccagagaagccagggctccaacatgaacacttcttgtagctcactgtcatgaccagtgtttcagtcagttcttgcaggttgcctgacttacctcatttctctcatttcctgtaagcaaccaaaaataaaaggctttcttttatttcattttgtcttattttgcttttatcttgaaggcatataagacctctgtatctgccttgttcaccttcaactgcttctaattcttcctcaattccagtgtccaatgtcaatttgaaattaaaatttacagactgattttaactaagctgttggtaaagctgacctaagccattcagccacaaaatatagagtatacaaaattatgctaccattttacacatatcaagcaagcaaagagatttttttttactggtggaacactaatctttcaaatatagaatagtggctaaatgaaaataaaacagcttagaaatctactatgttttgagtgtctttccaatgggccactttgcatcttatgagaactggaacacattggacaggattctcagctgagtcagctcggtggggccccaaaggcaggcaactctggtggatatggctggctctctataaaggtactagaaggaggcacaagataaaaattgaggggaaaaaacaagtggaagcagataggtggctggtggcagaaatgcctggtcacagataatccatatttcatcccagccctagaggcttaagtacatagaacccagaaggagctctaactaaggttagttaccatctaaagaatgggtgctttgtcattaggagaaagccaggagcccaatgaccagaactagaatgggacaaacctgacctgaagttcaccacaggcacagggctcctcattttccttttgattaagcattaatttgtccattaatttaattcacccagatgaacttccagcctaccctaggcacaatgagaagggaagcaatccaatatattgaaggctaatttgtttcttattagtctcagagcttaattaaaaccctattcaggaaaacaaaggtattacatctcagtttctgcagacactagcattttcatgatttttgaactctattttattactgtgtaaggcagaaatcaaccatataagtccctgtaagactaaggatgtgtgatcaataaaccagcatattcatcaggtgtcgaagaacaggaagaaactgattatagagacttcttgttcctgtttttcttgcaactgtaaattggtatctagatcaagtgcataatcctttcatgaaaactttgacaatttttccatctgttgcaaacctggaaaaatttgaaattttggaaagcatcatcagtttggttccatgataactgaagttctgaaagaaagtcagaaagtttcgtgtccaaaggattctaaggttggacagctcaatggagtcccctgttgctgtgtgcccatcaacataagaatatgacagaaactggccgggcacggtggctcaagccaataatcccagcactttgggaggccgaggtgggaggatcacctgaggtcaggtgttcgagaccatcctggccaacagggcaaaaccccatctctactaaaaatacaaaaattaaccaggtattgtggcgggcgcctgtaatcccagctacttgggaagctgaggcatgagaatcacttgaacccaggaagtggaggttgcagtaagccaagatcacaccaccgcattctagcctgggcaacagagcaagactctgttaaaaaaaaaaaaaaaaatgacagaaactgaatgcaagtaatgagttatctatacattgttcatcctttctctcccaacctgaacttggtcctccccatatactcctcacctgagttggtgacagcattactctgctggtcccccatgctccatcgacctccttttttacctccccaaccatcagtttcacatcatatcctaccaattcaaactaggagagagctctcttctatcccttcccactgccttaattcacagccacaacctccctgaccactgacacagcttcccaacaactcatcatccatcccctgctccagactctccttcctctactctgtctcccacacagcaatggagacgtctttcaaaaacacaacccaatcaaggcatcccactttccaaaatcctccaggagtttctcctccagccacactgagcacactgccacctaaacatactttgttctttcactctcttgtgcctgaacttgttcccctgttttctacctgagatttcttgaaagacaactttaaggcttagttcaaatgtcaccacctccattaagccttctccaactttctcaggaagagctaaaagctgcctttccctcatctttgtcccataacaggtatgtactttctgcatacctcagacatagccttcacacactgtattgttctttgttgacctgtctcttttcttcacaagtctgtgagttactcaaaggcaggaaccaggtcttcttcattttaataacagatatggctcattgtctattatatctgcttaattcaggtttgttaagtgaatgaatgaataggttactaaaataacaagctaccctaaatgcaaaaatctttaattttgtaatttatgagatacttgggtcacttctttatggtactgttatgagatacttgggtcacttctttaagatgtactgtcttatgctagaaactgaggctcaggcccaaccctgtatgtaactagcaaacagtgctgccaatattaggtatttttatttagacccttgcttgtcagagtgtaatccagaccagctgcatggatgatatttgggagcttgttagaaatgcagaccctcaggatgcagacatcctgactcataatctgcattttcaccagatctccaggggattcacgtgcacattgaagttggctaagtattgatctacacagagagcagtttgcagaccttatgatctcataaacctttacactgttaaggattattaaagataccagagagctttttttaatgtggactatatataccaatatttacggcatttgaaatttaaactgaaaaattttctaatccttataaattcatttgaaaatagcaataatataccaattccatgttaagacaatatgtttttatcaaacaaacatattttacaacttgaaaatatgtttaatatctggcttaatagaagaagatggattctgccatctgcttctgcatcaatctgtgtgatatcttgtgttgtgtagcctctacacaatttcaccttacacatatgagaaaatgagaatgcaaaatataagaaacatcttagtattatttagaaacagttttgacctccctgggcatacttagagatccatggatctagtcttgcataaagcacactgacaaacacaggaaggctaaccagattcttttgagccttcttcctacattattctggtcctgtgaccaagcacatgagagatatcatttctcatgttggggagacacagttggtgtccaaatggcaatcccaacacttatctgcaatcgattatctagatatagctttcttaaccactggctaaaagttcagaatgctaatttcatttttaagtggagtcagttttattaaaaaatgaacttttcctcctgtattaatccattctaacactgctataaagtcatacctaactgctgtgtctatggagtggccattctttattcctatgctttgccaataaacttgctttcactttactcttttgattaaaaaaaaaaaaaagacgtacctgagaatgggtaatttataaagaaaagaggcataattggctcactcttctgtgggctgtacaggcttctgcttctgaggaggcctcaggaaacttacaatcatgatggaagacaaaggggaagcaggcacatcttcacatggcctgcagtgggaggtgggggagagagagagagagagggagagcacaaagggggaggtgctacacactttcaaacaaccagatctcagaactctattacaagacagcactaggggaatcacgctaagccattagaaacaaccctcatgatccaatcgcctcccaccaggccccacctccaacactggggattaaaattcaatatgagatttggatgggaacccagagccaaaccattcacctcacaacaacataccttttttattgttgtcatatttgttttctgttttttaaatgccagagcactgaaggtaaaacagaagacattttgcaatctcaaagtaaaaaattatcagagctagaagaaacctgaaaggccatctagtctaaatcatcactttgcagataagggaatagaaaaccaggaaggtcaagagacttgttcaaagttgaccagctagaaagtggaagagctagggaccttttctccctgcctccagcactctgtctgccaatctcccagaatgtgcattgaagccttttagggagtttcataataaaccttttgaaagaaggcagatgaggaaagttcatacttgcattctgagcagttagagggcaaaagaaatttggtggctttgcttttgagggtcactgcttcccatggctgccatggcagaattaaagccctgacaaggaatctaaagcatctatcgagccataaggggacagaattgggaattagctcatttttgcaacacagtagtcactttgggcacaaagaatggcctaacatcttacaatgggcctgttttcttctgcagagaggggcttcatccgtccagcaagaactcagacaaatttaaccccagcctacaagcagccctgccagattgtttatggcttagtttcatggtagttgggtaaggctcattggtttttcctgggatgagagattgctgcaactttgtattagctttgggttcatgttaatttcctttatttgctccagacacaaattcattaatccatgcttttcccttttccttcatttttccccaataaatatttccaaagactgacttagcacaagacacagtattaagaactgtaagggaaatatgttaacatcctgttgtctgcatatcatactttatttttcagagtttctcattgatctgtcaggcaatctgaactagcccctaaattctactttgcagacataattttaatcagggactaaagattgctcatacctaatggctgatcaaatgcctgaagaacattcaaccgggatagctagttgcccttattaagattcttcccctttgactaatgtattaatattatatttcaattgaagctcaaagtgttagtaacactgatgccttctaatgcattcattttactactgtttgttaagccttttcttcaacattactggagaagcagtataatatggaaactaacaagttcacttctggagccagatttcctgaatttgaatctcacttttgacacctactatccgtgtgacctcgggcaatttgcttaatctttctgcacctccatctcttcagatgtaaaatggcaggggtgagggtggcaggggaaataggaacctacttcaggattgttgtgagaattaagtcagttaatccatacaaaatgtttagagcagggccttgctattcttttattctgaacctcaaataaagcataaaggccaaaataaggacctcagagttcagtctactgctactccatcttgctttcccaaggctcctccactgttttaaaaaagttgtcctgttgaagctcttatgcatcggtgtgactaaggcaattgctcaaataggagggtgcttcttcaatgacattctaacagtataatttttcactgcaaccccaattcaacctttatacactctgatgaatgtaaagatgaaaaaaatagagctaatggctttgccttgtaccactagtatagtcccatagaagaaagctgtttgtgtgttagctcactgccccttatagaaattaatccatcagtttgacagttactgagtgcctactccgttcgagttaatggcaatacagtgctgaaagacacagagttggggaggggtgatgaggctgagaatagataatagcactacaatatgggtagtggaaaagaaggaaggatcctgaaagggagaattaggatgtactttcaagagattttgcagcctagtgtgatcttgaatgatgaatggcattccagacagaagggtcagcctgctttgtgcttttactcctataatctttactacaagtgggaaaatcatacaaaaaaaaaacctccttactgattcttctatgtcactatccaagataccaacccatgagcagaatgctctttatctaccttctactccatttatactacagtctgacacattttatccttccaagaccataaatccttattgttcccattgccatggataagtaccagggggatgtttgtttgtttggttggttggttggttggtttctcatttcatattcattcgaagtcaataagccaatatttctggaacatccagggtttgatcattctgattatcactctgaactgaaataagtaactgatgaataatctcctctgcacacaaactctagagtccccaggctactagcacacacacacaaaagcccaggaaaaattaattcaccacttacccacactttctggcattgactggggccagtgtgactcctcatgctaatctgtactgccgcatacagtctgtgctgtctgatctgatgtcccttttgcttgaaaaagtattgcatgatgcttagatgtgctgtctctaaaatttctttcgcatccttgtcaatcttcttgtcttttgtctcatagcactgccagcggaacacaacaggagagcactgtgaaaagtgtctggatggttatatcggagattccatcaggggagcaccccaattctgccagccgtgcccctgtcccctgccccacttggccaagtaagtcctaaaggaggatggtctcttctaatgatcagtctatgtattgttttgttttgttttgttttgttttgccttatcccagagttctgaggtttctccacaggcaaaacctcatattgagatgagactggaaaagatatagaaaaagtttctagtccaaatacaccacctggaatgcttaagcacttacaatatagatgatgactgtgttcccgaaatattggggtgcatcatgaggtcaataaagtctcctaagttttataagcaaggatagtctcatcttttcttgactttctcttgacctagagcaatcacaactggtaatcccaacagactcattataatatcatattttcagtaatattgcctcttctgactttcacaaaggaaacatttccctacatatggcttttcagtcagaattagaacacagatcaacagaatgcatgctttaggccaatcagctcacagaagatttacaggaacactttctggctacgttttgacctgaatgagtagttaaaggaaagagacatacattttaatggaaataatggaatatgtgtaaatccagtaattaagtcatcaatggccattttattctctttaaaatgacagaatatggaatttaagaggtatagtgatatatggttttccaaatgaccaactctctgacaccaactgggtgtcctacaatcaattcagttctgacactaagtttccacagtcagtgcagatcccacagattaagagatcagttccacaagaatgcccccactacaaatgccagccaaaaatggggtccccaggctagtcacacttcttcccagaagactgtaaatttgagaaggatccctcaacctctcctcaggtttgacagttcattaagatgactcacagagtttagaaaagtgctatgcttatgactgtcagtttgttaaaaggttacaactccaaaagagctacatggaagtgatgcatagagcaggatatggagaagtgggagtgaagaaggagtgcgtgcagagactccaggctctctgctggagcaccatgctctcagcacctccacgtgtcaccaaccggaagccccccaagccttgttgctcaggagtttttatcaaagtttcatgttgtaggtatgattggtcaaatcattggccattggtaactgaactcaatctccagcctctcctccctggaggttgggggtggggagggttgaaattcacaacgtccaattacatgtttggttcctcggtggtgcctctggtcataggctcccactctcaaggtatccaggggtccactgtgagtcacttcattagcataaactcagatatggttgaaaggtgcctgttatgaataacaaaagacagtcttttccctcaggaaattccaagaattacaggagtctgtgccaggaaccaaaggctaaatactgttttttttattatgccacaagtagaaagagtagccaatctaggttcatattcaaatttggacacataatacctgtgtgatctcagaaaagttactttctccctagatctcactttccatgggatttgaagtcaagaagcctgggttcagatcttggctctactccttgattcatttaccagcccagtatttcagattttctccttagtacagtaaatcaaactaggaagtaaggatctgcatcatagagttgtgaggactggactaggataatatgtgtggaggatttgggtttgtaccctaaacatggaaaggcataaggtagatgttgcctttactgaacacataccgctatattttttctaacacttggatttttcttactctatgcctggcattgttctaagtgtttcgatgtaatatttacgtaattgatagctgttgtaaagattaaatgatacacataaaatgactttttaaaatctgaatgcttactacacacacgcactcactcatactcacacacttactgataaacagaaaagaaaaagacagatggcaatcagattcccccgatgttttttccttaattgaacaccaatatcaactaacatttcacctaatagcttgtgatgtattcaaatactacaagtctaacagtcagagtagtcagacgagtttcagtcccatccttcttcagaaactgttaaactgcctcagaccttgctctgtaatttttcatgtatgatagtattaataacatgtgcaaaagggatggtactcacagtgagggtagaaaacgcaaacattaactgttctgttattttcactcaagtatgtcctgatttatgagctcccttcactccgtcttggtatactttttcattgttcattaatattctgctctcaagcattcgttttaatcacgtctggtgagatatttagcacagttctcttgccatggtatatattgttaaatatattacctccaacttcctcatagctggtttcactcattctctcataaacatgttgtgtagcctcatctgctcagaaaaggtttataggcgtcgagctgcagtgtttgtttttttttttttggcagtagcagatgaattaggcaggcaatctcagatggttctttctaattatgctgttccacttttgcacttttcaccccatttgcatgacaagactttcttatctaaattacctggtcttgggatatgagacctttagaacatcattccctatggactgagaagccttgtctacatgcaatcagatatttatcgagcacttattatacactggtataaaaactggtagtcagtacttattatgtgccagtcatgcactagtcactggtgacacagcagtgagtaaaacagtcaaaaatctcacctttattaagataggtcaaaatacagcagtgttttgaaactcctagagcaaatgaccctttaccttttgaatcacagtatccggtatgttagttgagcaagaagcgtttctgaatgctgttaactctttaagaaatgaagtcaaaagttgccaactgtggaatgagtctcctttcctgaaagaggaaacagtttccaaaggcatcaaggcaccatgtctgcccatgttttttctctgtgtaagtggatccagggttcaaaggagcactgaagggacttagagaatgtgctctaaatctagatgcatattcacagacacgaaaactcaagtctctaatagtacagattcgaggttgaaaaacctactgaaaacgaaaatgaagtaaaaagtgtgtcacctataagtaaatatcatgtaggagtagggaggaattggtaagggtgtgagagaccaagggattttacagatttttctctgtagtgacaacagctctacttcttgaatcccttgctggggaaactggctgcaaaaaaggagaggaggggttcatctgtggtcatggaacagaacaaatattcttgggtcctaaaaagttctaacctttgatctggacttattattaacttagttagctaatctcaaatactaatcaaatatcttatcaaaaatcaaatgcccattgcctctttcagctttttaagaaattcatattgctactttctataaaatgaaagttccaggacttttcagaaaggcgtctagtttagactctgaattacattttgaaacattgatgaagctgagcccacagacgcaggatttggatttccagttacaagaaagcaaggaaataatgcttcaggggattaagcaaacaaagggccgagtctatttttctctaagttcctaaggattttctaagagcaaaaggcacccttccacttgaaatgggcaccacagtggttacagtgggctgagagagacgcagtgttttcacttccctagccaaaaccagacaaaacataaacagttaatgctgatgagaaacaaaaacgaacccttgagggctggccctgccaccgagtctgccttcgccacagagaccagtggtcatgcagttgttcccagggaccatttgcataatgttcatgtatttatttgggggttggccagacgtcctccatctctaccagtagctatggaaatcgctccagttaaggaaaatgtcatctgtttgaaacagcaggacaccagctacaggcggatgactccagatgcccctagcagatgttgcatgcttcaagcgtgggcaggctgctgggtggaacaccttcaaagaaagatggaagcgcgggttcctgttctggactcttaactgacagtggttctttaagtaggctaagaaatcagaacaagcaaaataaagggtaaaaggccaaagaaatgtaattctgttggaatgtttttacccaactgtttgcgaaaataaattgtgggtgttgcctttcactgagaagcacatattgttttctgactgattttttaagtgtcttcaaacaaataaacacatctatttgctttcctccaaacaccattagggtaagaaatgctgatacataaaggaacaagagagcagcgggtcacactttattggttgtatagtaccaaagccaaagctaatttaaaagtccttaaaattttacatacacacacacacacacacacacccctatgccccacacaattcatgtgtctatgaagaattttccaaacacgtggagaccataaccccatttcccttgccttaatagtgaggagacttatgtattccactaaaccaatatttttattacttttttgtcctgtgtcctaatttttattatctttaaaaaaggaagaagaagaaagagagagggttccatgggataaaatccttttatggtgggtcctatgttttgctgcagtacttgactgggactttcatcgacgcagccagtctcagcaaccttatttccaatatttaaagtacacatgaaagaaattataattctgtggagattatatagtttagaactggttccttccctttaaaactggacaagttctagtgcagaaaaaaaggggaaacttttaaatgactacatagacagtgatggaaataaaaggggattctcttataaatccaaaattgcaggtagaatttgatcattttatttccagctttgggatacatgttttggactagtgcttgaaatatatatataggacctgggaaatggtcccaccaacaagtggcattttcttttggggcctgctagcctaacctttcctgcaaggtaaatgtgtacaagtttaaataaagaaaatgattgcacccattagaactttaatgggaccaacatagaggtaatctgataaaaagttaagacagtctctttggtgatgtatggaattgacttccaatatttgcttccaattttagttttgcagaatcctgctataggaaaaatggagctgttcggtgcatttgtaacgaaaattatgctggacctaactgtgaaaggtaagccaataaaattctctattttctgtgtgggtcaaaggaagctttctgtttctcacactcaacagctctgccatactcccattcagtgggtcctgaaggagatgcttaagagtggttgagggactgcatttcaaaaccccttagggaagttttcctaaatcccatcccccagatacagcaaataacaatatgcttcctagggcttcaggccaaggccacatctcaggataagcacacagggaaaaaggaaattgaggatgtgtattttgaaaagattctctagatggttttggtagtactcttttctctctccatcaatgagaaatagtactaaaattagtgttccccagaaaagagtgaggtttcctcagtaaataaaatgtgaatcaccttttgtcaatagagcaataaattagaaaaaaacaacccacaaagctgttatttcgcccattctttataccagctttataccatactaaaaagtaaacaaattccacaggagtttaggttttctggatctctggctggtatttacatatgacactcttttctttttttccttatttttttcaattatattttaagttctgggatacatgtgcagaacgtgcaggtttcttacataggtatacacgtgccatggtggtttgctgcacccatcaacccgtcatccacattaggtatttctcctaatgctatccctccccttgccccccacccactgacaggccccggtatgtgatgttcccctccctgtgcccatgtgttctcattgttcaactcccacttatgagtgagaacatgtggtgtttggttttctgttcctgtgttagtttgttaagaatgacggtttccagcttcatccatgtccctgcaaaggacataaactcatccttttttatgactgcatagtattccatggtgtatatgtgccacattttctttatccagtctatcattgatgggcatttgggttggttccaagtctttgctattgtgaatagtgctgcaataaacatatgtgtgcatgtgtctttatagtagaatgatttataatcctttgggtatatacccagtaatgggattgctgggtcaaatggtaattctggttctagatccttgaggaatcaccacactgtcttccacaatggttgaattaatttacacttccaccaacagtgtaaaagcattcctatttctccacatcctctccagcatctgttgttacctgactttttaatgattgccattctaactggtgtgagatggtatctcattgtggttttgatttgcatttctctaatgaccagtgatgatgagctttttttcatatgtttgttggccacataaatgtcttcttttgaaaagcacatgacactcttttctctctttttctaaactgctctgggctttgctcatgtaagaaaggccttctccacagagcacgagaggctttccactgaatgactcggtaagatatttcccattccctccacctgccagctgctcgcagtgttgtaagataaaatggcttttgctcaaagagtctctcagacaggttttcttgtttttaacagaaatgccattagcattggcctcaccattgtgtttaggcagctaaacgatatgtagtgccctagagacagggaaggaagagccaagcggaaatagtcaagcacccagtcactcatctgcaggccctcaacagcacagatgggctcacaaactcaacctggggcttaaaatgtaaactttaaattataagcaatctcacttccaaagaaaacaccctctatctctcaaaaagtgggtctgaaactcaaaaaaaaaaaagccacagtatctgtgatacagagaaaaatctttgcacttggaaggcattgttattatgattattaaatatgcaaaatgtggataattatttcactaaaggattgtggatttttttgaatttatttatttattgccataagagggaaagcgagcttagggtccacatgaatttcatctattaggagggactgacagagatgatcgattacattgggttgattgaaatttgtgacacacttatcctatatttccttacttggagacacaggaataggaggcacctgatttactcattttctggctcactggaggtctgtggcggttgttaatcagccaggatggagttttttctcctcagtgtctgaggttaaattcaatttagtttgataatgaccaagcagtattgctaatgggtgttcaatggcccccacggggagagttaatggccttagatagagccctgctgaccaaatgcaaagctcgcagaagtgaaatcacctggaccctaagggcacagtcctgtaaaatcacacaggggtgcagagaagggttctgtcatcccaaaccatcagcaggactgcacgcccacctctgacaaggaattacagatgataaatgcctcagcccacataggatgctcatgagctctgccattacccagtaaggctgggtcagatctgctgctggagtggaaggctccagacaagagcactggtttggaaagtgaaagtagagtgttgaaaagaagagatttgagcattagcctgggtgagtgtgaatctcagctccaccactttgtgacccacccgggcaagttctttgacctctccaagtggcaatttccacttgtacagaatggagaaaataaagttacctgtctcataaaactgttatgagataatactgcaaagttttgagtgtgggacctggcactgagtaaatgctcaataagaattaacaggtgacagtatgagtcatggtggtcattgtccaacttctgccactgccgattgtgttcctgggacacgttggctcatttccctgagtctcggtttccttagctagaaattacagctctgagctaaatagtgccactgattaattatcacttatgtccttgttgctttacattcttcatctgtcatcttcacagccaccttagagaaggttgtattttgtcatcttgcagatgaggaaactgagccagaagagctatgtcttccaaattgcggtggtctttgctgcttttgatttgtttgaccctggggttaagaggagggtttctgcttgaacagccaagctcttaagttgcctgagttaaccttcgcctaatctgtgctttcaatgtatttgtgaacttgaacctctccaaaagagcttttctaaatatgcaactgatttgtatggatatctgttttaaacaaaggtaataattagtccaaaccaagaacctgctaggtctttttgcactttagagatcattgagtcaagtggtggttttaaaatctgtgtccaactgtctccaggaaaactttggattcctgagccctccccaactccccttcaccacccactgaaaaagaatatccagggctgaggcccaggacctgtattttgacttcccgtcggattctcatgcaccaggactctcactgctttgtgaactaccgctctaccttgaccttcaataccacactctcatactagggaagtatttctcaaaccgtgacctaagaaccttggttgtccttggaaatgaaggttcaggagttctcagtgaatattttcctaattttatgtttaattttaataataactttaaggaaaacattcattgaaacatgttctggactttctgctgtgtcacgttataataagagaagatctccctcagtgctgggagaaaataacagaggtgacagtctgtcaatgacacattacagacaattggaggtcaagtggcatgacatcaaggcaaactgtaaaactaaagattccaaaatgaaaattggtgagagacatgagtcgtcacatggcacatggctggatttgcatgctgaacacaggcagtctctaccacatcattttgcaagtggacatttggttataagacaacatcaattattgaattaatgtgaatctgaaattgattagtttcatagttttatttatgttgtatttgaaaatttattttggttttcaagacatgtaaaaaccatagacataaggagtttctacctagcttcatgtttgaaatatttaaagataatttaagctaacactggaaggggtattacatgaaaatgcttttccttttaaaaggatccatgttacatgcaaattcgcgaaacactggtctaaaacataaaacatgttttacttactctacctcttacactactgtgtaaaaaaacagctcaaacacgcccacctgccttgtcttaacaattaggtccatgaatattggcctgctctgggccctacctgtctttcctccctaaaaaccttctcccacctcacactttaaactccccgtgttggacatgctactcaccaaatccaccagatcagctggcaagctttccacattgtattgtatttagaccatgatcatgatgataaaaataataacatttattaagtacttactgggtggtatgtcaggcactgttgtaaaaactttacagacaatgatttaagcctcaaaagagccccaaaaatcctatggaataccattttcatccttatttacagaggaagaaatgcgacataatttaagtcacctgctcagaatcacacaatggcttctttatctgtgaaactatgagctgcttgacagacacagcatcatatcccttatccctcctctgtctattcttccctcagcacactatctggcatgttgaaggcctcagttgtttttatttaagtaaaaatattttttctcaataagaaatagcaacagcacttttcatgttcctttaaaaaaggtactatgtagtgacaggagtcagtcattccttgccctgttttacccccaatctcccaccccattccaggaaaatggaaagggtgacccagagttgactgagtctggctgaatagagattgcaaatggaagttgtcttctgatgcaaataattgtaaaatgcacaagccttgtagagttttgcaattctcatcctcatcccagtaggaacaactaagaacattttgaagatgaggtgctcccttgggcagcatatatactaaaattggaacaacccagagaagattagcatggcctctgtgcaagggtgatgtgcagaatcgtgaagcagcccacattttttatcctgcatgttctcccacatatgaggaagctaaaaaaaattgagctcatagaagtagagagaataattctgattattagaggctgggaaaggtggcaggtggtaagtgatgggggaaggatagggaaatgctggttaacggacacaaacttacagctagatgggagaaataatttgtagctttctacagcattctagggtgaatatagttaataatttagtttctgttttcaaaaagctagaaaagaggattctgaatgttcacaatacacagaaatgataaatgttctaggtgatgagatattaattaccctgatttggtcattatacatggtacacatgtatgggaatatcactctgtatcccataaatatgtatcattacctgtcaagaaaaaaataaaagggaaaaaaatccttgcccaagactcaccagcttcacctgcccccaaatatatatagcagtgtgtgtagtgtgtgtgtgtgtgtgtgtgtgtgtgtacttagttcatttaaaaagatgaggaacctgagactctgagccatgaagtgacttaatctaacatcacacaattgggttagcaagaaatccaaaactaaaacccaagaccctcaacgttcaataccattttcagtcatatgatctcaatgtttcagtattccacactgcctcccatagcagctttaatagtatactttcatgcattaaatttggtggtggagtgagaaacatgctaagactacatgatgattgatcatgtgaatcttgttgcttaaagatcagaagaaaagaatggggcaaattaaagcaaatccaaagtgacttaaacccctaacagaaaaggcagaacacagtatcatcagagatgaagatgataatcataatgatttcaatgatggccttgataatggaaaagaaaaataaggaagaagaacaagagaaagctaacctttattgaggtttactgtgatgcggggatttagtctaattctctctgaagacatcaagtttttcacacgtagaccctgttgtttgcatagagttcttatgattccttactctctagcttgctcaactcctgaattcttgccctgtgaccctgaataggttacatacgttttcctagccttatttctcagtctttcataaagaagtggagagcatttacatagcacctactttggaacaagttctttttttttatgtcattttatttaatcccaaagacagctacagagtgacatccctcccagaaaggtttctgagccacctagcccaggagtttgggcactcttgacaaagactttcagtgccagctgtatagccctgggaggaggagcagaagagaaagagaaagggcaggcagagcagggggagcttcaagcattcctgaaacagtttttggtcaaaataatctttttttctaaacatcatatcttttggttttccattttgcccaaataataaaatcactaaccaaaatgacaaagttcatatgccacaatcctttcatttgagccataaacttaccagttctgttttccttggatggatcaagtcattaatagactagaaatgagattacggaagaaaaaataggaccaggctactgggcaccagggctccaatgcttactctaaactcaaatactggtgcttttgtgtctttgttgttagttctttgagggcaggcttgggcacttttataatcactaatttattaattagttcattctttaatgctagactgctggagtggaaagaacattaagcctggagtcccacagaggtttgagctatgcagcaatgaacaagtcatttagcttctctgccttctagctttcttatatataaaagtaggggtttgtcagggactatcataagtaaacttttgtatgctcattttgttaaatccatagggtccagagttttgactaaaacttcagagtttcctctaaacctaccaccagaagatgttcttaagactcagagtaactcaaagtaggtttccactgtgatagagattccaacttacagaatagaaaatttgagttttctcttgtaaaagaccaggggacctcctatggagagcaaatgcagtggaattaaatgaaaaagttactggcatctgacctctatgagcttgggcaagccccttcactcccagaccttaagattcccagccacacattgagctggtagatctgagtctcatttcagtcggccaaagagcctaatattctctgtttggtgaacttcagcaaaggccagaaattcaatccagccacaagttccatagaggaataatttatgctggcttagggacctgcaggcctataaatctgaggtgcaaagacatgagaaagtgcgaataacaacactcattgaatatttcctcttggggtgtctctttgtgggttgtgtagaatttacattcatccccatctttttcatagaccagatttctagagttcatattctgtatcattatggttaatttatttcctgttctttcagagaatgggctatgtgtttttcttcatcctgtctccctctatgtcttacataaaatggacatgaattgtccttgtgttggatgaatccactcattcatttatagcagcagcagtgtggtccagggtggagcaaaagaaagaactccagggtcagaaggtttggaccttgcactgtgactttccagctatgtgaccctggaaaactgaagtagcctcccagaatgccaggcctgtgtggcctccctcccagggtgtctgtggtaactaaataaactcacatagatgaagctatgaggttcgatgcaggtaaagagtttaaagactgaccatatcctatcactacaactacaccaagaaactgagacatgggaacagaggctgaaggaacatacacaaaatgttgacagtgacttttttagggtcctgggattacagatgtgatttttttttatgtatctgtttttcaaatgttctgaatcatgattcccttactttaaagggaatcctttaaaaaaaatgtagtgttttattattactggccagggcttgttgatttccttggaaagctctcccttcctttccactcccaaggccaacaccccagcccaggccctctataccccaccccatccctctgctccagcctgaagtccatcctgcatgctgaagccagcaccagcttccttcactaccacttccatcatgctcaaaaccctttgctggctctctttctttttccctctcatgcaacagaactaacttctctaccctaccttcaatcccattatggtgtgaccacatgttctttccagctactctcaaagtgtctgcagctccagttggcccatcttccacactagtttagagtccacagcaaaagagagtgcacaatcagccaacaagcatgtagtttgacttgtacagtactcttacaaggtttgaatcaacttttaaaaattgcaatttcacataaacatccaaatttccacttttttctccaaaaataaaatatggcaacataggtccttcatcctctcaaggctctaggctggcaacaatcaacttgagcctagtaacagctcttcccttacatggggcctacaggcccaccactcacagcagggcctctgctgccctgcacggcagctttgggaaaagtagggaaaggcatttcttcctctgggcagagacagcctcacctagagtgcacagcttggcaaggcaagcaaaggctagatggatttcagtctccattctccaactcagctgggctctctcatcaaaggcccagccagcctgaccataggcactggctctgcccacacaataaatgcaggtaggcacctggcctctgtaggtgcgcatatctaaaacatccagaagaatggcagtctgggctccaactccattgatctgtggtactctcagctctgccatctgctttgactccaggctggctttgctcagttacaagttgctgccaggagctaagcgtactacctgctgcctcttccttcacctgaagatggagagaatgccaccccatgaccctcaaacaagagcccaagctacactcctgagtcaatccctttcagccaggagaatagcaggcactgaatggctcaagcttagttacttaaacaattcattgtgactagactgatcaatgtttctcaatagaggtgctattaacgttgtggctaggacatttcccagctgtacgctacaggtacatctcattgcagtacctttggcatatctggtcccacccatcatatatcatttgtgtacaccagttccctggctggatataccagttcaatcctatagctggaagcctggctgaactgaatggcctacagatgaagtgaaccaaatgatctataacataatggggaggggtagttccttaaaaacgaaatctggtcctatgaagaagatgagagagtgcaaatgaattctgggagggaaatcaataaatatccactacatctttcttctttgtaggaaagaagattaaaaggaagaaaaaccatgatgctaaatatttaaatgtgtgatattcctcttcagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcaggtgcagtatcataaatactaagccagctgcctggccagcatgaccctctgccaatactgaatttagatgaagaatttctcttggggaagtattgtgagtgcccccttgtcactttcccagggcaatgtacattctcaggaatatgcatcccaaacccatcagggatagaaatttttatcaaggctactaatataattttgctcatgggtggaataaactaggagacacaaacacaacaaatgaacttttgtcttagcatcttatatccttctagttttaatcaaagaaataaatcggacttctatggattacctgccattaaccaggagactgaatgaaatcttgcatggttcaggccaggcatggtggctcactcctgtaatcccagcactttgggaggctgaggtgggtggatggcttgaggccaggagtttgagaccagcctggcaaacatggcaaaaccttgtctctactaaaaatacaaaaattagctgggcatggtggtgggtgcctatagtcccacccagcatcccttgaacccaggaggtggaggcagaggttgccatgagtcaagattgtgccaccgcactccagcctgtgtgacagagagattcttctctgaaagagagaaagaaagaaagaaagaggaaagaaagaaagaaagaaagaaagaaagaaagaaagaaaggaaagaaagaaagaaagaaagaaagaaagaaagaaagaaagaaagaaagaaagaaagaaagaaagaaagaaagaaaaagaaaccttgcatggttcaaatcagttttcttattcagagggctatatctctcgttcagttatgtttggtaaaatcaagatttccataaaatagattagcaagtcaagggtaccatttaatcaccaccatcctccaatttcctcaaattataagaggtaaatatttcaaagatagcatagaaaactttctggttaggcttcagttagactgaaacgcacagatcttattcatccatttgccacatagagtgaagctcttcaaaagtgaggtgacattgctttcctctaagagtacaggaaggctgagattgagtatgtcttactcttatgtgactttgaggggagagtgggagagcaggaaatattgtactcctgtggcatgcctctataaggaattctttcactgaaacagatttccacttgaaaagattcaaggagtaaggagttttaaataaaaaaaatgcaacatatatgttctgcagaagtcacaataaaagtaaacatgtctacaaaaaagcaatgtgcatagaggcataacactgagaatgacagcagaaaggaaggagcactgtgtctagtcaggctaaagagagagaaggcggacagcagaaataatgttggcaaaatcaaagcctgaaaggttgacatcctgattctcaaaacatttactaaatttgtgtttaaactataaagatgcaggtcactcttggaagagaagctaattttagaagcaataaagcatgatcttgctgaaagatttaataaatctgcattttgtggaacattaaacagatgaaatgtaataaatagatctcccatgaacctggtttttatgattattctgtaaagacagttaagaagtggggggaaatgcacaattctattccagttaattgctagcatagatggtaagagaattcctctttaaatattacaaattagttcccacccagaaactcagtggaaattgaacagtctgatgagattgggcttttgtttttgctttttccaaaaggcattacagaaaatcatcagtagatgaataatgggctcccacgtcttctaaattcatgtaaaaatgttcctgattccttgcagcacattattcttattgcactcatagctgtcatttggaggtttggagtctgtcttgccaagggtcaagcgcagtgggagccaagaatcgctcctgggcctcctcactcactccttgctaagctgctcctccctcacacctggcaatgatcaacccccgagttaaattaaactggagtatcagtctgcaaggaagggatggctttcaatttccagttgaatgatgagctcgtggtcatttagtatcttgtgaaacttaccaggacatttttggactaaagcaattgcactgtcatgtcagaatcccaaagagttgggagagaaatcctagaaaacttagattcaattttgcccagggtcacctttgaaaatctcattgggctggagcttaatcggatgaagggcgtaatctctgtatcgtagattctacacagtctgaaggaagaatgtaattaattcccattgatgaattatacactgatagctagtgtttctagaaaccaggaaaatattgccatattttaagcattaagaagtgcatttctcgtctcttgtttttgtttcccacagtgtgcaactgcgggggaggcccatgtgacagtgtaaccggagaatgcttggaagaaggttttgaaccccctacaggcatggactgcccaaccataagtaaaaataacagtacatgattgactaaccccactttctctaatgtgctgcaggtgtgggattaagaaaagctatgcaatatcactctctagaaactgctgagtcccacccctggacttaaccctttctgcacctcagcaaatggagcctgcaccaagtacttggtggtccacttgattccctagggcaaatgggtggtttacatttgcatagctctattttatccagtctttacattcagaatcttacctaatggctaaaggcaaagtcagaaacacaactcccagtgacagagctcttttcagctccttttcctatatcgtctcttcaggtccctgaaaatacgacgtacaaacaatttacaacacctggggaaactgagataccaagagatttaagtggcttctcccaagttacctcaaatctgaagtgggagcagaagtaaatattcaggctttacaaaatggaactgccttttatctctcctggttttctctggctctcctgttaattaaatcatgaggagttacactaggaacaaaacttttggtttaaaaactattttaatagtaggcatcccctcccccaaacagatgtatcttggtctctcagtccctcggagcagacgagattaaccttaccattggattacatcttagaagatgccataggatgtgaggcacaagtaatgccaagtttacaccctgattgaacaggtggcccctagacaaggccaatttaagaacatcaagatgcctgcctggtcctaagcatctcccccaccaagcctgaagtactggctgggaatcattcccttgagagagcttataagtaaaaccatgttaaacttcaaataacaaattaacatattaacaaccattaacacgccagtctccctttatcacgtctctagaagagagcaccatctgagggaaagagatcgggaacaggcacgttgcaaaaggtgatcaaggcagttctgaaacacagagtgccatccttgtgagtgtgtcacaggagggccctgggttctggaggtgatgacagtggtcagaggaactcaaatgtgaaaagtgagaagtgatgaggaactgggacctgcctccccatgtgcccacgttcagcctgaactttggtaccctcatcagatgtcaggaagcgactctcgcagcgataacctcagacctcccggtgctgaagtgttcatcctgccaggaagtggggctgtgaggaggagctgtgccctccctggggtggggagaaggctggtgctagcccctgaatactgagaaaagctaataggagaggaggagcgtctagccaatagccatcttcactagctaatgccaagcaagatactaaagcctgacaagaatagaattacagctcttcatgagacaaaaataaaaatggtattaaccaaggaaatagagatttatgttctgctaaaacggcctgcctttagcatgcttttgacttgtgattctgaagaaatgtttcacctccaggctgtgataagtgcgtctgggacctgactgatgcactgcggttagcagcgctctccatcgaggaaggcaaatccggggtgctgagcgtatcctctggggccgccgctcataggcacgtgaatgaaatcaacgccaccatctacctcctcaaagtacgcaggaatgttctactttccactctgttttcatcctggcttcacaggcccgcagctagtaattccttctacccctttttgtatctgagtctcatacctgtattacaggttgttagacctgtaggtctaacatagaaaacataagtaatttcataggaaattatgaaaagttgattgtaactatgagcttgggccaaaacaagaactactgtctacaaaagaggttatatgggaaatgaaatgactaaaagactagtatctatgcccaaaactactgaggaaagagaaacacttatttccttggcgcagccatacattacttgtttaagtcattaccacaaaaggtactgcaaggctaccatttccttagccttaatttgcaaggttttgagtttgtctagaagcatccttcttcttctctgtctctcctcaccccaccacccacccacctttccttcttatttacacacattctctctcattttctcatactcacagtcaaacgcagacattcacacacaccttgtttctcctcatagctctactggttaatacctagtaaacaagttaaaagcagccaacagattaaaaaacaaaaacagtaatacagttggccctccatatccacaggttccacatcctcagattcaaccaatcacagatagaaaatatattttataaaaacaataaaaaataatgcaacaattaaaaaagaaaaatacagtgtaacaactatttacacagcattgacattgtgttagtattataagtggtattataagtaatctagagatgatttaaagtattctggaggatgtgcatacattatctgcaaatactaggccattttgtatcaggaactggagcatccccacggggtcctgggaccaatctcccacaactaccaagggatgactatataaaggtccttgtatagctaagatttacaagttttctttcccactaaatcatgggcttctatcacaacaaaaggatatttttaaaataataatcattagctgagggaaaatggaattcaataccagcacattgttttgctttgttagtcaatttaggaaaatgattgagagcatggacgttgaaactaggttgcttgtattcaaatcccagctctgacacccactagctgtgtgaccgtaggtaagttatttaacctctataattcctcagtttcctgaataattattgcctctatctcatgagctgttgagagaattcagtgaattgatatatgtacagaagttagaacagtacctggcatactaagtactcattgctttttggaggtgcaaatgatatccatagcagttggccaaatatgtaaagtgtaagcaaaaacaaaaattgtattgtagcctggatagaatcttggtgtgaattttattctaaactttgaaattgttcttgtccaaaattacctgttggaacacatgaagacactaccccccaggggagtcacccagatccaggcctcctgaaaccactcagattctctttcctcaaaggcacaacttcaagacaggaatcattatggcagacaggaagtcagtgtcaagattgaagggctcactcccaagtaatctcagtaaagccgcatttagacccaactcctcgaaaatgaaaaaggagaaagccaggggtctgaaataaagagacttgcattaaaatgaggaaagttaatttctatactccatttacatcaatactgatgggttggtcagttcttccagacctaacaaaattaaaattctaaagctcagacacccagggccaccaccagcctatattgtacctttgtacaaattagaaaaaggagccctttccccatggtcaacccagcccctgaccagcatccctggtctagtgagtggagcttgcagaattttagcccctaagggcctcagtcccctctgcagaccccacccttcatatcaggctgcagcagcctgcggaccccactattttgagaaaagagcctcacactctactctgagtcctcttacactgaaagagttttatgtacattttttaaaacctggtgtgcccattgactattctcaaaacacattcttctgcagacaaaattgtcagaaagagaaaaccaatacgccctaagaaagatacaaatcaacaatgctgagaacacgatgaaaagccttctgtctgacgtagaggaattagttgaaaaggtacgtatgtatgtattcagtttctgggacagccttcaaagaaaggatttagctgatgtgaggctggctggtcacaaacgactgaggcttaacacagcccagaaaaaatgcagtgacccatgtgccttaaaataaatcaagaccagacctgtggagaaagttaacatactcagtctctaccgtctcctctcgttttgattgtttttcttgaaaagctatgtttgtggagaattttctgtgtatttgcggtgggttgatacggttgatttgtttaattaggatggtcattcaggtgtttgccaaggcatcttatgactaagagctacagagcatccagaattaaaatttattatatagaatataaaatttaaatattggttaaagtatacattaaatgataaatggaaagaaagggaattgtcctgagaaagcaatttcgctctttggcagggaaaaaaccactttcaaccatcactttataccacagactaaaataaattagcccgtttaaagagttgagtataaatctcaaatccacaagaaaatagaacaaactacttattaaatcttcaaagggaataacagaacacttaaatacaacataaagaatttcaataaaaagatagatttgacaagataaaatttcaaatatccaataaaacaactaaataaacaaaaaagacaactagacagagaaaaatattgagaaaaatacaacttgtaaaagctgtcaggaattaacaggaaaaacattaaaacatgagcagagtcaatgtgaaaggctattcaacgcactccgcaacagcctaatggaaaaacatccatccatgtgctatactaattttacaaactaagtcacgaggcaccatatttagcatattagaatgtttaacacagtttttttttttttttctaatgatattccaccagtactggccagagtacttcagaattgccgctttccaaaactggtagttgacattataaacaattctcatgatcaacaaaaattttaaaaaaataaaataacaatagtattctcttttgaccttggaccccaaaccctttaagagattatcatgaaaattgtgtccctagttcccggcaatggcacatattaatccaaccactagtgcttgaagagcagtgaaatctcttaaatagtaaaggaaataccaagaaataaatatttgtggaaactcattgttacttcatgttggtatcagatatggttgaaacttgctaaaactatcttaattcttttttctttttttttttttttttttgagatggagtctcgctttgttgcccaggctggagtgcagtggcgtgatctcggctcactgcagcctccgcctcccgggttccagtgattctcctgcctcagcctcctgggtagctgggattacaggcacacaccaccacgcctggctaatttttgtatttttagtaaagacagagtttcaccatgttagccaggctggtctcaaactcttgacctcaggtgatcagctcacctcagcctcccaaagtgctaggattacaggcatgaaccaccacgcccagccttaattctttcttgaggaaagaattttcaagaaaacatctgaggaaatgttttcaccaagattagctcctcccacagcccaggcagaattcctgatccttttgttgtacaatttccccacttctaatgtaagctaaatgcaggctttcgtggagaggaaataatgtacgcttgaaagttaacatcacagtagaaaaggctcccggacaagaagggcagaccaccaacacaggaggttgatgataaagctactaggaactttcacccagctgtttccatctatttttattgaatataatgttctgaccacagtcctgatggtgcaaaaacctgctgaaacatttcaaaacaaatgcccagggctggtcttaatgactttttaagcattcttcaagcccttgctctagaaaagtccatgactgattcttagatttaaggaaagctgtgtcttagaaagccttctatcaagaaagtaactaatatttggctttaaatagagtaaaggagttcattgtgtataaaaatcagtaatattgccccttgaacttgataagtaataccactttttgcaaattacctgccacatggatttcatgtgacccaaatctcacaagttacatccacctagctacgggttttgtctgaacttccctttctaaattctccagccttctactgggaagtcctacagccctttcccaccacttatgtctgggattcccctaaaggatgcccatccatctgtgttcataaatacccagtgctcaaaagatgctccctttggtgctgctgatcttgtctgcaatgaaaattccaaagatcgtgccaagattctacttttccatgttcccagagccactgtgctcaaggtcagagtgtcactgggctacaagcagaggtgagatgtggccctctcccaatctcagtgctgcccctcaccatctggatcttgaaggtccactgcagagcccagagttacaaagcacagtctccaagggcggctcaggaggtactgcaccatctcctccacttctactccttgaaccacagcagaagctacctgaatgacaactcatgcagagagacccacaggactaaaaggaaagtaggctatctccaagcatcaaaagcatctgaacctcatctctggtcctgccaaaaaggcaggagaaaattaagtacagttggccctctgtattcatagattcaatcatggcttaaaaatatttggaaaaattccacaaagttccaaaacgcaaaatacaaatttaccatatgctgagtattactttgaatccatatgaacgaagtgatgtataggcattgcattaggtattagaggtaatttagatataatatatatagggggatgtgcataggttatagtattgcaaatactacaccattctatgtaagaaacttgaacaaccatgaattttggtatctgtggggtcctggaaccaatctcccatggatgctgagggataactgtttacatttctattccagaagcattattgaacatctgtatataatatttatttatttatttatttatttatttatttattttcagacagagtctcgctctgtcatctaggctggtgtgcagtggcgcaatctcggctcactgcaacctctgcctcctgggttcaagcaattctcctgcctcagcctcctgagtagctgggattacaggcatgtgccaccacgtccggctactttttgtatttttagtagagatggggcttcaccatgttggtcaggttggtctcaaattcctgacctcgtgatccacccgcctcggcctcccaaagtgctggaattacaggcgtgagccaccgcgcccggcctgtgacagttagtgtgctaggtgctaggtatcctgaaatataataaggccctgttttcaagatgcttcagtctagcagggaaacagataagtaaaaacataattatgatacagcatttaataagagaaacatggtacaggctaaacggtaactctaaggaagaaatagtgaaatattttggcatgggtacactaggaaaggcttctcagagaaggtgagtattggcctgtatattgagaatgagtaggagtttatcagatactcccaagcaaggggtaagtactatgagaacagatagatgtgaagcagcgtgctaagttcttgggactggaactgtggccttgtggaagattcattgtaaggcagagagaggaggagataatgctgaagaagctgtcagaggcccaattgtgaagaaccttcccaaacacgctcgtgaacatggggacttcagcctgtggactctggaagtcattcaggtatttacccagaacaatgagctgattagatttgcactttagaaacgtccctctgcagtgtggatgatagactagccagtgaagactgacaataggggcactgcttaggagaccgccacagtggtctagagaagagagcagtgggttgctgtcttgccttcatttgaaaagaatttgcacagaacaaggatgaactgagactgtggtcatggaaaagaggaagagaggccagagtggcaggtggaatgaaacagacttggtgaccagttggaggtgagaaatggcaaagagagaagctccatcctgagacgtggatgactaagactacgaacacgaatggattactctggacattttaaaagtgaaatatctgtgatggcacagagggcagatagagatgtgaatctgcaattcagagggtaatcagggctggaaaggaatttagggtcattaatgtttaggaggtaggcagaagtagatattactgtacaaattctgaagtagcacaccaatattcctactattggtttgtccaggactgttgctgtttatgcttgtgtcccagaataattactaaaagttctccctttcatgtgcaaaaatgccccaggttgaaccataaaatatatgatcaccctagatattggttatcatcctcacgtcatctaccttttatgtactatattaccaagacatccttgccacttttatgtcaaatatgtacaagaagaattttctgttgagatgagcaaatgactaatacatttgtaatgtaaaccaccaactagtttacagttacaaggtaattttttaatttcagcttttcttaaaccgaggcgcacctgttttcccacgtgcctatatcattattttccttccacaggcaaagttacaggaaaaataaacattcatataagccatcactataggttcaattcagtcatcttacaatgtaaaggaatagatgttcctctttgccactgatccagtcatatatacagtatatcaatagctatatatctctatctacctgtatcttagcgccctctggcgtttgtcaaaaagaagaggttttcttataggcatgacatttttcagctgtctctcatcacttcaactgaagtttccatatcaaaaaataataagtttaatgacataggaataacaatagagctttactctgaagtatcaagccaaagtaaaaactaggggtgttgtgctttgcaaatataacttaaactggatcaaagatcaactcattaaaaattctaaaattttaaatgcttgtgtccgtattttttaaaagcagggaggagtaatattaagatttattatagtttctgcatatttaattttaaaatgaccacaaatactgtttttctggaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaaagcctctgggcatgtgtttgttataataccatttctgcattctcttccttgaccatctgagagggccacttgcttgggttattcctggagagtgtaaaaacgttcccggtaaaatcatggcataatcctctgggtagaatactggatgaaaggagagaagtttaaaacaaccacttccctatcctcaggaaactctgtataatgggtctaccagcgctctgtgtggcagatcaccccacagctccttcacgtattgtagcagtttttaaagagctgagccaaaaaagcaacagacaaggcaagtgggcattcgaccaaatgccagactaaagaacttctcttcctcttaaatataacccatagatcagtccttcaaatcccaaaagtaagtacatgtcgcccatgctgtgcatacagggtggtgtcctagccttgaatcatttctgtgctcttagatcacattctgtccttcaccacgcacacaaaaacacacacatacacacagacgcccacacaaaccctttcttcagaggccacatttgagttgggcattatttttgacaaatactgtgtgagatctctgaaacagaatctcccaagttgagagaatggaatcagcttctcggagaagagctccattcacgctgagccaaatctgcttgagcagttatttgtacacaagtgccatcaatgttgatgggaatttggaatgaagcactgaaaacagcatgttaggccagtgagaataatccttgaaatctctgtggtaattcaatttcagcagtggttggaccacccaggagccactggaagcatggtgcatttcaaggtctgcctattttttcaacaattttctctttgaaactttaagctcttcagtcagcacaatgtcaaaatgataagcagacatgggcaattttctagtccagcaacttgagatacagtaaaaatttgaagaataaattacatatgaaaggcagttggttgggactgaactgtgactgatgatataggaatagcaccagattttatagcattctgtcattctaaaactggccatcaagtgaagtaacttaggaatggaaaaccaaacattgtatgtcctaactgatacgtgggagctaagctatgaggacgcagaggcataagaatgatacaatggactttggggacttgcagggaagagtggagtggggagggataaaagactacaaatatggtgcagtgtatactgctcgggtgatgggtgcaccaaagtctaacaaatcaccactaaagaacttactcatgtaaccaaataccacctataccccaataacttacggaaaaattaaaaaattttttaaaagtaaaactggccatcacattacctttcatgcattatttttgggatgatttcatgtgttatagaactttcacatgccaggaagatttacgtttaggaaatacattatgcccacccacccctatctgtgcttatacaacattcttttctcatacatttaatctagcctttatacggattatttgtaggaaaatcaagcctccagaaaaggacaacttgttcagaaggaaagcatggacaccattaaccacgcaagtcagctggtagagcaagcccatgatatgagggataaaatccaaggtaaatatattctcttctggttcagtttaatatcaaggaaacacttatgttattaacatcagtaggcataatggctactgttaagtgtttgctgtgtgccaggaacttgttggtacagtattataggtttaaacttgtataaggtcttcatttcaagtttgtttatctggaatttctgagcactcatccctacttactatctgttgatgttcaataatcaatgtataaaatcattccctttttaggcatttcacagaataaccttctgacagaggagattgcatgctgtggtgtctctaaaatgcaagagttgagtaggagtcacagatttttctcagttatttgcagagaaaacattgcttttagaatgccagtaaactatcagttgacccaaatcatcacaagctctttctatgatgggctttcccaaaggccaatcaggcaacatgcttgggccccaacccagaagaaaaggaaggagcggggctgtgggagatttctttgtcctaaagcattgtgaatgattgtaccttccctcttggaggtttgcttaatttgtgctctcacttgcaatacatgcaggataatcttgaagactattttaatagtgcactaatagttggccttcaatttaccagcagaaaacagcagatttcatctgttataggataaagaagatttccttgggtgagagtttgctaagatccagtatctgcatttccatagtttttattatactatatattaagggctggatgacaacaccaagtgcatcccagggcacagtagcgataaagggacccacagtggaagattcatgtctttatactggggcatattgcatgcaaagggatacataaaagcaagattaatcatttgtcatgtttcctttgatgtctattataaacaataaaagcaaatgacatgcaatccaaacactcctcactcacatactctctcatggctcatatttttgagtttcctgacaaaatattctttttctatagcattttagagttactattgatttgttcaaaaagtgagattgaacctagaagataacatgaccttatccaactaagaaataaatgcctctttaggcagcaaatgccaggaccctagtaagccattcagagaaaataattcacctttgctattataacccatgttttgattcaaaagtgtttcatttgcaaaggatctgaaccctcttatttgatcctttaagcatgggaaaagatgaaaaaatgcaaaggaaatgtaaatgggaaacaataacttctaacagcttttaaatttttaaaataatgtgtgaatcgtctccaaaaaccaaaggcaaaaatactattgtctgtatttcccttttctaatctatactgcaagtagctaaactaaaacaggccaaaattataaatataagacttgcaccaaaatgccagagaattcagcatcacaagtgctagagctgaggaaaaaatatttacatttagtttatttcgcaggttaatattttagactttacttgaggagtggatgtttaatccctttatataattctggaatgctgtaagacaccaattacatgtcattccttattcccaaccatctctaaaataaccgctggcgaccttcaagctattatccacataaaatacaaccccttatcctggtatgatttatgtgacaccaatgtttgtttacccatcttgtctggtcaaccacatagatcatagtaaaccacagacacgcaatttcatttatgccagcaagataaaatgcttcctcttggagctgcagtagaacaaggtgacaattacataccttccttctcatcatatgtagtaggaatgagggattcaaagacgtatttcagtctgctaatatttagacaggtcacctaatccctttgagcctcagtggtccctccagttctaaaattctccacctgacttatggaagtggggtgaaaatgacctagagtagtcacgctctagaaggcaaacagcaactgccaaaaaataactatcaatgagcaaaagctcacatcatattataacaaaccctcattttgtatttagcctgtgaaataatttgaaagactcatttggacagctatcaatatgctctcatttgggcttaaagctttgatcaaatctttgtctaaaatacaattaataactccacacattaataatctcacccatgacaggagtgatctctgagcattttctccaagttaagtatgttatataaaaggctgatcaaagactgtagatttggatgccttgaatatcaagttacaatatttaacgctaaatattagcattctcaaatcactgtggaaaccagatgaggatgagagcagagcaggctttgcattagccagttcccattctgaagaccccgcatgggaagcagagaagagtggtttcctcgtgtctttctccttcgtggaatagatgatgagcttccatgctcgctgggattcacagcatgaacactagcacgctgcttttgaatgagtctctctttccatttcaggatcagccctgccctttgcccacagcccttgctcccttgcatttctagtgcctggtcatctctccctgctgccttgtttcaccatgttcttcctttcagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaacgtaggtgtattcctctcatagctgacccagcacatgtttgccctctttgtgggtccaatagcagacattaaacctagggcaacatataatcaaagcaaccaatttccagtgttcagaactatttagaatctacatgtggccacagggaatcattcaggacaacttgactttataaccaagatttttagattcaggcccaattctgagcccctgagaaacaactgagatgccacaaggaatctatagcagttggtgaaaaacgtataaaacagtagaaggaagactaaaggaaaccaattcccagaactacatttaaagaaattttattgagaaggcaggaatgctacaaggccagaaacattcatgttgtgaagaccatgaatgactttaatatcttttagcctccagtggaaatttaacatttccttcagcaatgagtgtaggcaccaaatcacagtagtattattgaatctatcacttgatcactgtatcagttatcaattgctattataacaaggcccaggccgggcgtggtggctcatgcctgtaatcccagcactttgggaggccaaggtgggtggatcacaaggtcaggagttcgagaccagcctggccagtgtggtgaaaccccatctctactaaaaatacaaaaaatagctgggcgtggtggcatgtgcctgtagtcccagctactagggaggctgaggcaggagaatcgcttgaacctgggaggcggaggttgcagtgagccaagattgcacactgcactccagcctggtgacagagtgagactctgtcccaaaacaaaacaaaacaaaaaccaccccaaatgtattcatttaaaacaataaccatttattgctcatgctttcatgggttggcaattcaggctggattcaacctggacagctcatctctgctccatgtgacatatattggttgagctcactcagatgtctggggctggccgggaaggctgggcctctccctccatgtggggtcttaactcaacaaggctagtccaggttgttcacataacggcagctttaagagagcaagaatgaaaagcacacggtctcttaagcctaggcttggagctcagcaatgtcatatccattttactgatcaagaccagcccagactcaaggagtagagagatagactccactcttgattggaagagctgcaaacaattggtttaatctacacaatcaatggaagaaatcacagatttgcatattatattttagctgctgctgatatctcatgacactatttaaattcaccaataactcaaaattatggtaactattagatccacctttagatcttgttagttaagggattagtaaagaagcatatacattattatattacatttggtttttaaatatattagtctccttttaatttctatatattttattgtatgcattttagaacacactctaagaagcagtctgaaggcttcattagattacaaagggactaatgacacaaaaagggataaagggcagtaggtcgttttcctacaactgtcactatcaacttctgctaacaattattgtggatactgtagaaagacattactgacatacaggtttattatggtggcaaatatgtaaagtcttagaaacagtaagaaccaaagaagaatctcaggccccagttctgagtcagactcagaaaggctagagctcagatgtcagtcaatgccagatgtttccaagcttgtcacctcctgtggaatttaacaagacttccctggagaagtgggaccaatcacatctcccactcggcctccttccacctagaatgcattttccaacactttctatactcagccaggaacttttgtgttctgcttacagtgatggaagaaaatctcaacaagacaagctaatattccctgaagaaaacagaaattaacatattcaacatattcaacacatgtgcctttgagcagagaataaaagacacatgcaaagtttaagaatatcatgtcattgccatttaatcttttttccaccaaaatcatggtttggatttgacccagtggagctaactaaaaacagttgcctagagaaactacagaaaatgagtgggtatgaacatcattttgccttattaccgacaagataagtttggttatttttaatagtaaaaaccatactatacccaagtcccctttacacagtaaaattattaataatctggataataataagcatagtataatgatatggttttcacaaaaagcacaacctctgtgggaaaactaatcaaacccttctttcaactgacagttatccagggactcccaaactctaaaaagtagcattttttacttcaaatctaaaaggtggagctaattttgtgaacaatagcttcaatctccattgctaaagaaggcatggcctgagaattttgcaactttgcaaaatgctgggaggaatggaagcgaacaggagaaagccacactgagcctttatctccatttcttcccagtactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgaggtacagcggacactcaccatcaatgcatttcagcatcagcagtgtgatggtacaccaagaaggggctgttgatataaatttttttaaaatattggtatagttaaatacttatattttaaaatattggtgtgttttttggtgctataaattactaacttgtgtgttcctaaaatcaagttgaaactaggataattgtctagttcttgctttgataagaacgcagtagttctgatgcttgtgtccatgtgtatgggtctgttattcttgcaagtgggtaagcaatgcatagctttttttatactgagagcactagaaggccaaagcatctcaaaaccatgggttctgggtatgcataatttttggaaaggcacgataagcaaatctcacagtctggctggtcagcagctgcagggataaggagactaattgccaaggccatgcaaatgcaaagaggaaggtgaggaggattcccagatgtgatcatagcttgcaaagatggtcatctcatggggccagaattcgtgcatgcccacacctacaaagctgagaactggtagtggtcatgtgtccgcttcaagcaatgcatgtattcacagccgccagcatcaagaggggccatcttttgataggatgacacatgcatgttcaaacatattttaaaagattagggagaaaagaatactgtgaacaaatagaaaccaattatgagcaaattcacgaattcggttatgtactattgtggctggcaaaagccacttaaactaggctctctagcctgattttcagccatcattacccctcactaagaatccttgtaaaatttcttccgtaaaagttaattacactcatcaccactgtttgctaatgggagcaaacccctagccaatattttttagaataatatggttgggataactttttttttttttttttgctaaatgaatgcatgattatcttatacaataaaagtataacacaaaatactgttttaagatagtcgctgggactctccttacccttgaagtgtccccctttccctcctccacatccagtcaaccgcaggttcctcccaggtttactatctgacatgttttagctctcttccttcttttccattcctctacaacttctctagttctggctttcattgtttctcaaccaaaacagtctccccttctctctcctccattcttgcgtccttccaaaacatcctctccaccctgccagagcagctcaccttagtcacagtctgactgcaactgcatgtgcttatcaatcctctcatttctcctcatcacctataacagtgcttttgacgctgcaacttgtgagccatttcgcgggttagaaaataagtttcatgggttgtaaccagtagtttaaaaaaaaaaaaaaggagagacagataaaaggaaatgaaatcaagggaatagaaaatatcaaagtacacatatatagtaaggtgtggtttcatcacggttctgccttatatatgtgtaccaggttgcaacgtacaattctctgttaacctctgaaagacactatcctgtggacagcctatgctctttcacgtggcattcaggactccctctgatctgaccctaccagcctcctcagcctcacctcttactgttctctgcctcacacattaggttcaggcaatatcacacaaccagtaatctcacctgcctggaatggaaaccgctttttcttttctactcatctggctaacctcacttatcctttaagtcttacctcaggcattacttcctccaggagacctaccctatactccaatcctgtaacatgtcttgcacagctctgtttctgaattgtgatcatctgctaatgaatctgtcttccccattgaactcagggctccaaaaagtaagggaatctgtcttctttatctttgaatcatggagcatttagcacaatgtctgacacaaagtaacaactcagtaaaaactgggttgatgtaatgaaaaccttaaggactttccaatttggggatcctgtagttttgtcagattgtgcccaagtttattgaagatgcattttcagtgctaagtaataagtgattcttctcatcctgaaagatttaagcccatacccctagcctgcaggataacactattctactcccaaagaagattaagagcatttaagtaagacagaaacaacactgcaacctcatgcaacaattctcagggttcaccagtgaagacccagaactatgttccgtactgcaagccctgaaatgagaagtggacctgccaacccagaccggtcctggtaggacaagggcaagcaatggcctgcaggagatcccatccagaccacagctgtgcccttagccacagggagtaatgtttattgctgagaaaaaagcaagacctattattaatactaccgataatgataaactgtatttggttctcattttagattgtgagttctcgatctcagccaagtgctttgtcttctacatagccttgtgctagagaacacatatgttgtgtgttaacatgttccattctcttctgatttatttttaggaatagatcttacctccaaaagtcctttgtaaattttataatcaggaaggggagcacacagtcaatgaactgagaaccaaagtatctgcttaggcacaaaccagccgatttgctggtggttggtaaatgtcagggtgtgtgcaaaacacagtggactttgtaaatgtaacaagcaagaggacagtgttgcctatatgaagagacttcagttctaaaagtgaatgaatgccagaatagcttttaaataaacttatacagatttttttaaacttcatgcatatggctaccaaaaatttggcatttttgattcagacagatggtagtgctcattttaactttaccaaacaaacccttctactgcatacaaatgaacagcatgagcaagatttcaggaagggaacagcatagcgttgaggaatttgaaagccctgctccacctcagttctccttcctcttcctgatctttggatctggcattagccacagttgcaccccttttgcccccatctcttccctcagtgacttcacccaatctcactgcttcagtccttaaaagggatttatttgtgggtctgcatccttattcaaaactgagccccacagcacaactttcatatttgtgtctttctgcaggaatagccacgtggattagccttgctattacctgctgaaaaccaacaccttttttcctccaatttcctttcctattttctcattctttcttattcttgtccagggttctcctctcccctccaagtccccagggtctaagtcagcccctcctgctctgggttctccagtgatttctccattcctttgtgtctcacttgtggatattttggtctgccccctgcctagggtcccagcttctctccccttgagattactgccagattcgatttcaaggtatctctaaatgtatagaaactatgtaaccaaccttcatcaaatgccttcaatggcttcctacttaagaaaggtaaattcctcagccacccatgatctgagtccacctactgttccagtgaatttcttgactttcctacaaactctgcctcttagccactggagaccgtgcacattttctacttattgcctttgctcatggtgtctcctttgctcatctctctcatccatgagtacttctgtctagcctttaagccaggttaagtgtctccctctgtagagtgcctcgcctactcattccagtccagtggttcctgcagtcttatatccttttgagaattcagtgaaaactatggaatatgcaggcacacagacacacacacagacacacatgcacatacacacacatatatatccctgccatgagaaaaatgtgcacttgttcgcatgtataagattgacaggcaagttcaggtagtccaccttaaccctgggttaagaatgctggctcggtggctcacgcctgtaatccctgcactttgggaggccaaggcaggtggatcacctgaggtcaggagttcaagatcagcccagtcaacatggtgaaaccctgtctctactaaaaatacaaaaattagctgggcatggtggtgggcacctgtaataccagctacttgggaggctgagacaggagaattgcttgagtccgggaggcagcggttgcagtgagctaagattgtgccattgcactctagcctgagtgacaagagtgaaactccacctcaaaaaaaaaaaaaaaaagaacactagctgccagaaggagtccttccttcctctctactggtgcagccattggttgtatcactggaatgatcaccaggcttcatcacactaagcatatattcttctatgttcctgtctaggagtcactccttttttttttttttttgagacggagtctcgctctgttgcccaggctggagtgcagtggcgcgatctcagctcactgcaagctctgcctcccgggttcgtgccattctcctgtctcagcctcctgagtagctgggactacaggcacccgccaccacgcccggctaattttttgtatttttagtagagatggggtttcaccaggatggtctccatctcctgaccttgtgatctgcctgcctcggcctcccaaagtgctgggattacaggcgtgagccaccgcgcctggtggagtcactcttgattgctgaatgcataactctgtgtgtgtgtgtgtgtgtgtgtgtgtgtgtgtgtgtgtgtgtgtgtgtgtgtgatggtatgcatctagtctaaccccactagaccgtgagcatccaagggcagcactccagccttgcacaaattgtatcttcctagcaccaaacacaataacttgcatttgttacatctattgatgaacagatggatggacaaatgcttggagcactgtcaagtaatacagatttgatttatgtacactggttcttcatgatcacaaatactcttatttcatattaacttggacttctaaattactaaacactactttcaccattcttttgcatacttttgcaaaatatcatgaaattttaattccttccaacaaaatttaaaatccaatgttttatttatagtctttcctacgacaaatagatttgaatggatctgaccttactggaatttgactctgtgttttagaaaacaaacttaagtgggtttgttgttgttgttttgagacacagtcttactctgtcacccaggctggagtacagtggcacaatcttagctcaccacaacctccacctcctgggttcaagcaattctgttgcctcagcctcccaagtagctgggattacaggcatgtgccaccacacccggcccaaatttaattgttttaattttacatttcactattacacctacagcatgggctagaaaagaataatccccaaatttcagttatcatacaaaaccaaaaaagtacccacagagcttaatcattttgacatgtaccaacagtagccatacaactagcaattacattattttgtcatcttacctctatctccaaagggtaacagaatgattaaaaacttatcagatgaacatgagattgtatagtttaaaagtaagtaaaatactccttcaaaagcactgtttagggattactatatacccaagctttaccttcccaggactgttttttgttgtttttgttgctgttgctgttgctgttgttgttgttgaccgtggaactttttctatttttttgcatatgtaatatgcacagtgaagcatgctgaatagtgacaattgtgtcattttcataattatcagttttcaacattttactttgttcaagttgaccacttttctgtggaaatatctttatttgtttcaaagctaattttattcatttctgtctaatgctatatacggtaagtgggagaaactcattaacttgaagcatattgtttttcatctactgcaaataagcttatatacagtgctattagcacacagctttgaagtttgtctctgacttcagggtgttagcagtgttctcccgcagtcacccagagagaacttacagaaggggtaaagaacactgtaaaaggaaaacagttctgtgagaggtaaataataccaaccttttttcaactcccttcttttacatattttaatacacatattttacagtattgcttttgctgtataactcccagtctttgtaaagataagaataattgatctcagatagtcacactgtattaggcttgatggatattcagggaaaattgtttctttaaaaatgttcttgcattaagaggatgttcaaatgtgattcttttctgtctctagacctacacctaccccataacaacatatctggagaagatgggttccattcttccttttctttaagccagaaaagactgcagggagtaagaaaggacattaagatgaacttaaaaagctttaaagtatttccttctctatctaggcttctataattatttctatgatattctagattacactataatgtatatttcaactctgacttgttactatttctaaggtaacttcaactcatttttcactcaaattgtaaaatgagtcttttacttttccctcctaaagtttctttctatgtttctttcaaactctaaactcattggaagccccataatatttcttcagaatcacaatgtccctgcctctagaacctaaaagtgatggtagaaattaaagtactcatcaagacatgtattagtatttactttcccttctcaaaacatctgagcatttacaataaagagctctgagaggtatgaagcaagattaaaatttgatgctttaatagtagggccatttttaatttttaaaaggacataataagattatttttgtatattctctgttcctgtccaaatgggctgtttgtgtcaggcccaaggctggcacatgataaatactttttgaattaattcatattccaatcactgcaaatatagagcctgtgttcaatcctttctccatagtcctcttttatattctgggaaaaagagacaaatgccctctctaaggcgctagctctctttgaaatgacggtgttataataatcctccgtatgtctaatctcccaagattcttactgttgttatctctgtattataaatgagaaagcagcatcaaacaggtagcattccccaaaggcacacagcaaggatggagctgggatatgaacccagatttgtctgagtccaaagagagcaagttgacatttactgctctccccaacgctttccctaaagacatattcacttcactctcccttactcttccttcccgcagaaacaacaggaaagagtgagggaacaaatggaagtggtgaacatgtctctgagcacatctgcggactctctgacaacacctcgtctaactctttcagaacttgatgatataataaaggtaaggacgcacgtgacttgttcaggtttgtatttccagcaggttacaacagcagctcagtgtcacagaataataataaattcatatctaaccagtgagcaggcattataaagatcagatgactgaatgttttagtttcttgcactgtacgatgaccaccagccacatatgactacttaaatttaaattacttaaaattaaataaaattaaaattttaattcttcagtcacattagccacttttcaagtcctcagcagccacatagctagcagctactatattcagtggcacaagcattgtgcagaaacaggcattgcgccactgaatatagtggaacttcttgcagagagttctattgaaaatgctgctctcgatccatcctactcactcttcactcataaagttgtgtttgataaatctggcattcaaaatcaataaaagtcacattttgtaaaagtagaaaatttccaataaaatgcagtgaactgaactatcatgaaattactcttagttcattttattacctttcgaaagatatcactttaaggtcatttgattgtccgttgactatttcagcaccaaactgtctttctctccaaactgactcccatcactctccttggtgacagcaaaatccatatggatgaagtcaccgactctctgacctccagctccttgaacttgccctttccagcaagcttatcctccagtccacctctgttttcccacctatggccatacccagatcttgtcctcagtaacagtacctcctcccaaaccctagtttcaagcacctccctcccagagcaccatctcctatctcacttattctagaatgcccactccagtaattctctggccacatggagacctccctgccttttttaccgtacccctctcatgtcctttcttccctccttaagcagctcaaattatcaaatataataattctttcaaaatacccttaactaccatatctgcctgttcctctgttgtacctacctgagatttctgactcatccccagcaccatggccataccagagcagctgcatgcgactggtgggaacccacttcccatgctatcagttctgcctggtgacttggcttcctgctttctgaaaaattagaaacaaagagaagagaactcccttcatccttcctccccagatccgccggcccgcctgcatctgtgcccacacctctgcctcccctccgttgtaagcattccttctcctgcccggccttgaaaacaggttgcagggtttcactcctcaagttatgccctttcttctgaatcatcccgttctcattctttacttaatcattaccatcagcgtacaaacgtgctgtactatctcctatcttttaaatatcaaaaagaaaaaagccctgtaaaaaaatcttttataaagcttgcatcccctctaacttctgccctaccattctgctcagcttcacagcaaaatgtctcgagtgacttatcattgctgtttctacctcccagactcccactgtcccctatactcggccgtttctgaagggggttccatccccttcactgagactgttcctgtccaggtcaccagcgacccgcctgtctctcccgggctttctcagccctccctcctctaaacaccaggtggcgcccttgtcctggctgctctggtaccgctcatggcctctaccctggctagcggtttcttcccagccccctttgctagcctcgcctctgcacaccctctaagtggtcaatattttaggctctgcaggccacgtacaaccactgtctcttatttttttctgggttttgtttgtttttaatttttttttacaaccgtttaaatatgtaagatatattctcagctcaacaggctttggtttggtgcagtggctcacgcctctaatcccagcactctgggaggccaaggtgggggaaagtgcttgaacccaggagttcaagaccagcctgggaaacatagtgagaccccctctctacaaaaaagaaaatttttttttaaatagctaggcgtggtggtgcatgcctacagtcccagctgctcaggaggctgagatgggaggatcacttgagcccgggaagtgcaggctgcagtgagccgtgatggtgcctctgcactccagcctgggtgacaaggtgagaccctgtctcaaaaaaaaaaaaaaaaaaaaaaaagatttgagctgcacttgacactgggccatgttgatctctgctctggataatgaatggctctgtgcttggtcctaggccttcttttctacctatactctctccctagctgatctcattgactcccttggctttaaagaacaattacacaccaatgaatacacaattatacctccagctatgacacctccacggagttccaaactcctatatccgagtgctaacttgacattttcaagtcagaactcagtacgactgtaataaagtcacagtctcatctatgatgtattaataatagacatatcaaacttgacatgtcttaaataaaacccactccttccccagtcttctccatctcaataaatggcacaacccaattgctcaaatcaaaactccagagtcactactgctttctcctttctccttatctctaaaatgaatcttgatttctttctttctattttattttatttatttttttattgttattttttttgagacgtggcttcatccttgttgcccaggctggagtgcaatggagtgatctcggctcactgcaacctctgcctcctgggttcaagcaattctcctgcctcagcctcccgagtagctgggattacaggcatccaccaccatgcccggctaattttttgtatttttagtagagatggattttcaccatgttggccaggctggtctcaaactcctgacctcagatgatccacctgccttggcatcccagagtgctgggattacaggcgtgagccaccacaccaggccttgaatcttgatttctgaccactttccttgtctctactgctgctctttggtccaagtcacctcatctacagtttaaattgccaccagagcctcctagctgatccaactgtctccactcttgtccttcaagacatattctttatgcagtagcagaacaatcctttaaaaacataaccaacattatttctactatagacactccccagtggcacttaaagtaagaaacaagctcattttgtcatggcccatgagaccctacatgacccagctcagacccacttttctgaccacatacccaactcttttctcactcactgcactccagcccaacaaactcctctctatttttcaaatataccatacttatttcctgcctcaggatttctgcacctgctgccctcagatcttcaaatggctggtgtccttatgaccctgacatccaaatgaaccccttaccccactcactcctcatcccaccccacctgtcatatgttattcaaaatatcttttactccctgaaattagcttgtttgcttgtttgatcacttgtttattacctgtatctctcccactaaactgtaaattccttgaaagtggagactgtgttcaaaggtattctacccccagaagagttcctggtccataatgagcacacagggaatatttgttgatggaatgaatgagtaaaagtggtatgtccatggtctattttccacttatacaattaaaaacatttttttcaaagtattgttccccagatgaccaaccaaaatggctagaggtttaatactgcctccataaaagtaaaccctttgtactacaaaccctttgtgctacattctgggattacaaaaataagttaaactcagttcctgcctcctaggattgtatgatgtgatgagttaaataatcacttaaaattattacaatcatttgacacatgaatgaataataaaaacacatggcaacacttaactcatcctgaggaggttagggatggcctcaaaaaggaagtgatatttgagctgaatttgaaaggaggagtagagctttccaggtagattagacagaaaataaaggaaaattattccagaaagggaaaatatttgcagaggtaagagaccagaaaaaattgtggagcattaaaacaacaaccagttggtcaagattagaccatgggatatagcaggttgggggtcatgagaattgatgaaattggtgagagaagagcggtcagctgatgatgtcatgcttagaaattggactcattcctgcaaagcaactggctgattctgagaagggaaataacatggtcagattttcttaataggaagattacctttcctgcaagacagtggagaatggattagaatactcaaagactgccctcagagaaagaagtgagatcactcaggggagaggaaagggctgggagtcaaatgccaagtttcacggtctctttcttggtcagggaaagaggagacccaggagatagcatagtcacagaagctaggaaaagaaaagagttttaagcaaagacagtggccaacactgtagcaaaccacagatgggtccagtaaataaggatgggaaaatgtcaagtggatctggagatttggggccaggtgttggtgatcttggcaagaaacatttctgtaaagtgcactgtgtcaaagcaagagaaaaagctagaagggagcctaaagtgaaagaataaggttttttgtttgtttgtttgtttgttttgttttttgacgggagatacttgagcatgtttatatctgagaagagtcagtagctagaaagcaagaatgaataacggggttaccaagacaatggggcagcatgctttatacagaaaatgaacattttcctcttaaaattggagagaaatttttgtgtaggtgtagctataaatacatctatagagtttgcggggaagggctgggggctggttgcaaaaagctggggaaatacctgttcattggttttggagtctctgagggagttaaccaataaatagtgaccctttccagaacccaagttctaaacaggtggaaacataaataaaatagtaaatacagagaccaaggaggttgccttatttctgaagcagctaagcagcaggcatggctttaggtctcttagccaagtggggtagctgacattcagtcccagtattaagcagctgtgcccacccagacaggcaacaccgtaaggcttagatgggggttctgcccagaatagttttaacatggaggaacacaggaaaactcaggctttctgctggcagcttgctcccaggacaaagaagggtggagttgagcagagcctatagagttattcttcccaaatttacccacaaaatcaaccactcccctctcacaggagtagagtgaggaaaggggtagagaggtctggagtttcactcactgtgctccctgcatataaaggagacatcagaagtgtggaagaagtgtcccccactaacagtttatgacctccaaataaaaaagaaaataaagtgatctgtttacaatcagatgggggtgggtgaaggaaatgttggcttaggaatcatgacaatgtttagaatcactatttgggtgactaggagaacaaatctctttgcagcattgaggggccagccaaggctgaaactcacgggtttgcaggaacatccgtctacacagttgcacgatctttaagcaaaatcgtaggtctgtggttgtattaaaaaccaagagagcctgtgttacaaggtgatttttaggaagtagtcagtcacctgaaaggtaactgaaaggtcagatgaaaactgaatgatgtccattagatttagtaacttagatgtaattaacttctcttttggtagagtaatggagtagaaatcagacaggactaggtcaaaataggaaatataaagtgagagaaaatagagacaacatatataaacaacttccattttttgaaatatgttgctatgaagagagcagaaaagtattgtagtaacattagggacatgtgtggataattgaaggttttagtttagttttagtttttaggtctgaaatggtagagcatttctgggttgtgaatgctagctagggaagcaatcaatacagaagaaagagctggcaatgcgggataaatagacatatacttacagtattttagacttatgtggtcctgcactgaaatttactgaccttcataataagaaagaacagagattatcttttggtgcctaggaaaaatgttttaagttcttctaaattcaatgtatttattaaaatttttttctttagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggtaatatcctggttttagaaatgcaaatatctacatggggtgaataaaatattactattcaattccatatgtcagaactactgggatacaattttaccaggttgattaaggttgggtatgcttatgtgttgatatgttggttggttggttggttccttggttgcttggttggttggttggttggttggttgttccatctgagagtccatcattgttcattgcaattgtttgggggagctggtcttttttatttaaaaaaaatctgtcatattaaaggtctgtgttccgggaagaggggggtgtctgttccacaatttttagtaggatgaccaaagacaatgtataaaacattgtcaaataaatcagatccctttagaaggtctaattctaacattacctatttatttcatagacagcattatctttccacacccaagtgtcttaagtaaaactggtcgggaattggcaatataactgacttctgataaatactccacagtgcccagcaggaactatttgatttcaacacctgttaagagaaaatcaattggcaattttcctcccagcacctagaatagaatcacacacctcttggacactcaattaatgttaactgaaaagtactgaaagatcagaattgaattcatgaccctgaaataataggcaaataatgagatcattatagagaaagactaggaaaaaaggaccagtaaaggtcattaataaaataagaaccaatattaacttctgttcaaaatataaatcaccttcttattcttgattgccaaaattttcaaacactcttccaaatctcctacgaagagagaagaaaagaaagagagaggtcatataaaatcttggtgtgtcagtgggtgagacagtgccatatcccactcggtatcatggccctagaaacatgagcttttgatgaaggcaataaaatggagcttagaaaaaacactattttgataatatactatattagcagaatgttgtttttgagatccatcttatggctctcttcattattcttttgtcattttgtacctacatcccattcattgggattccaaaatataacttctgtgtataatgccactctgcaacaaacagtgttccagcatgattctaagacagttactacatgctttacgtgaaacatgatccaaaatatcaatcaccctcaagtccttttgtatttagaatatttctgactatatattcatgaaagcatttcaacttagagacatcttcattcaaaaggtgagtatccttccatatctgtctggtgtacacaatgatttacgtgctatgctcgaacaaagataaacaaaattcattaagaagcttccatttcaatagcacatgtttaatttgaatactgagttagtacttgttctgtgcctagtattaaaagcaaagtaataaaggctttgtttcatgatctttggtacatcttaccactctcgccagcaaaattttaaaatattaataaatatttgtaacattttgtttcttttgtcccttttttaaaaaatgttttcttgtctgccttccccagattttgctatctgaggccattttctcagaaggggttgtggggaggaacaggtagtgagtatttagattagactcccctctgtagagcagagccccatgacttctataggccctagacacttttgccttggtgggttcctttctccatagaaaaagtaaaacctttatttcatgtctgcattggtataaagattaataccattattattgttatcctcattttttccttctgattgaaaaaaaaatgaaaacgctgtgcctaatggatgagtcagcccttttgtagagggggtagaatgattatagacttggttaacagagagggaagtagccaaagaaatatagagaaagtccctctaagggagcacacagggactggaactggatgctggagattgaggaacaattaccgagctcaacaggtcaggcggtttgaagacaggagccagtgtgggatctgcaatgtcatatactgggtcacggaggaccttctggaagttactgacaaatgaggtgatgatactaatcatcgatgtttgggactgagaaaaaaaaataaggaattggtggatttaagactgaataaaattaagacaaaggatttagacgaactgcggaagtggaggttagagtttatattacagaggcagtagaagtatttgtcaataaaataaattatgcgggtacacatagagttttaaaatcccaattcaggaaatggtgtaggtataataataaaccctgacgattagcagatgccaggcatggtataccaagcatttctatattttattcctgttatatctcacattattagcccctgtgtgcaagtgtgcaagtaccctgtgtgatgggtactcagtaaatgttggatgaaccttacacaggccagagaggggcaaaggcagagactatcgtgtgaaagggcaggggtgagggtgggctgaggtggggctgtgtgctgaggaagggctggggctgtctcactcctgaggcccaggatgcagccaggcctcaggagtgaaacaaaccttgacaatacgtgccctggccaagctctgcatactctcctagagccttggcttcctctacagaaaggaaataacaatgctgatttggataagcactaggtagtcatcataatggttcattcctctgcctgacttccatcacataaacaaactcctgcaagaagaagtgcagagggctgtttttaaatcgtcattcccttttcctgctgctactgccagacaggcagctgtcagagaaccaaaatgctgttcagcaaagacagaagaatgcagaggaggtgtgaccctcaagaaaaccttgccacactaggtgactttgaataacaggaaggaagcatctgtgatcctagaagtatttaaaaagcaagcattaaacatggccccattccccaagaaggtaagaaggagaaataacaatgtttgtttattaacaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgtgagtattccctgaaagttctttataccttgcctttcccactggcttttctgttttctgatgtcatctcttgaacttccagtgtgaaatccaaatggcagaaagagtggaaaaggcaggggaactaagggaagaccatttcatgaatgccttgaaggtttcagtctgcagattcttcgagatgtgctgtagtccagtcagcaaatgccagttcctttgacagtttatttttttagccaaagtccctgaaaaaaaaaatatgtatttaaaattagttcttgctgatagagaagatactttatgcattcatttatatttttttcaactcaaaattatttattgtgtggcttctatgtggcaagcactttggtggggccttggccagggctttgttctaggttcactgaatctttcccaaaaaaacattaccttgaaaatgccaaaggcattacttcctcatggtcacatatttgaccttaattttaagctgtgaaaataaagctaaatgcattttgcttggtgtttagcagataaactgtgtcatttaaatccttcaactatgaatagctgatttcttctgctgtcatttttaccctcttctctcaattcctttgtaggcggtgagtgggattgatactcaaatcatttaccataaagatgaaagtgagaacctcctcaatcaagccagagaactgcaagcaaaggcagagtctagtaaatatcttcactttcctatctcctttctaatttatagctgcttccctcctttcatacacgtagacagagatttccaaatctaggattaaagaatagtattataactacataacatatcagtagttcctgctcagagtcaagttacaaaagagcaaagatttgatactttaaattgtgattgaaaaaaaaaatgctatgtagtaaactacatggaaacacatagctatctcacatactgtggctattcctgctaatcaaataggctgattaatagaaacttaccataaataccaatttttaggggaaaaatgtcctaaaatacacttaacactaaaactatattgcacaaaatttcctctttcttgaacaatttcgaagtccttttaaaatgtttcccatgaaggaacgagtcatcactgtgagtcaattaggatgacagggtaccacaaagccatctggttatttgcttttcttttttttttttttttttgtagtttgtgttctacataggttactgtatttaggacagacctaacaagcatatggtaagaagcatttccaaaggccagtgtttgcatctgctgaagtgtgcacatccaagggtgagggagggaaggaaaaataaaagcaaaatcgcattagacaattttgaatcttgtgagttactcttaaaaacaatcgaatggactaagaaattcactaaacattattcatctctgagataatgaactaattcccaaggatttttgaacattgactaatgaggttggaaattcatcatctagcgaacttctaactgccacctaaaaacaaaggccaagtttgaaactaaaaacctcacccaattttgttgaagtaattaatctcatttaatcatgcattttctttatcttttgcaaagagccattacacagagaagataaatgcactttgcttttcatacacagatacttatttatttcccataaaacaactgttattttatttttctgggcaaacaaaggcaataaaaagtgtcattgtttctctagtctaattattatatgtctaattaatttattatgtaagtctatcctgaacatactctatggattagaatatcagtagtgaagaattagaatattaacagtaaaatattttaaaataaatgttgctatatctatgtattgcttttgtttcttgtgaagatcagaatgtgtcagtcttcatgacacagtgacttaaatattttattctttttgataacttgtaatatattctctcagtcttgtcattattgagttattgaacctcataaaagcaacttttctattttaaatttaaccattaatcgatccctacccacatcccttcaaagttccatattttatgtctgataaatctctctgcattagcctgtttgaatattttgcagacctgttcacctatttcatgatctcatttggccaaatccctttctgtatttatttgcaaaaggaacaacaacagggagttagtactgtgtggcttagaactttataggactgtcttcctttgataatacacacatttgtgatgtacattcaggttttcaaattaaaccatagtcatctactgaattacattataatttcagattacatttctccattccaaattcctttcaatgatcagtaatctttatttcccaaatttccttttcattatatatcaaatagttgatagtcaatataatctcaggaagctgctatttaaatgaatcttctacttaactcatttgcaaaatgaaaagtatttatgcaagtcagtaaattccaaatagaacacacttcttatgaaacatttcttcttataaacatcaagcccaaaattgattttcttcctcctctttttatcaagtgctccaaatatagagttaaatatattctttctcagtatatcaggtagtatttttttttgtttttgcagtcatgagacccaaaataagagctaaaacattgtttgtattataatgtttgggaattgaaattagaaaagaggaaggaggcagggtgcaatgcaaattcttcacactacccagagaaaatatgaaagaagtgcttgtatttggttaactgtacttcatgacaccaccacccattatacacatatctgggggggaaagataacattaaaccaatcacatcaagactacctaatagaacagcaaaggggtgccgtcagagagtgtatatttacaatcccattggagagaaagagaaaagtgtaattagaagtgataaaactatttttctgtttgttaagaaacaaaattctcagtgctttggaattaaagcacaaacagaaatgaagaattactggcaaagttgatcctttagttcagatgatgaggtaattacatcatgatctgttgggatttgctcaaagataaccagtctagtgactgtgccacaagtgtgctttcaagaacaattttataagcaaaagactctcaaaactgatgcaaatacaaaatctgatagaactgtatgtacatacatatgtataataaatttaaccactaatcgatccctacccacaaagaaatctcaaggctcagatggctgccccagtgaattcttaaacatttaaagaagaaataacaccacttttatacgagctcttctagaaaatagaaaacaagaaagcactctggaacttgttttatgaagccagcaaaacttggttacttgaatcacataaggatattattaaaaaggaaaattataagccaaattctctcacaaaaagagatgcaaaaattctaatcaatatattagcaaatcaaatctagcacacctataaagtgcaatatatgatgaccaatttgagtttattttaggatttcaagaatagtttaacatttaaaaaatcaattgtaatttgtcacatttataggatataggagaaattcatatgatcatctcactacatgcagaaaaattatttaacaaacttgacttttaaaaaagatttttgacttttaaaaaagactttcggcaaactgagaatagaaggaaacttccataatctgaaaaataaaataatattcagcaattaaaatggaaatattgaatgcttttccactaatattagaaacaatacaaggacaccctacattaccaattcaatgtgtaaaaatccgatttaattttacatacgacattgggaaattaacttttaaaaataacagtgtttgcaatagcatcaaatacataggaataaatctgataaaagaagctaaggttgctacgcataaagatctaaataaatgaagatctaaacaagaatttatatataaatgataaataaataccatattcattgagtagaagattaaaatgtgtaaaaatgacaattctcccaaattcatctacagatttaattcagtattaattaaagtacctgaactgaatattctagaatttatatggaaatgagaggggaaagccaagaatagccaagactgtcttgaagaataaaaacaaagctggaagacaaactacattatcaaggtgtattatagctctatatagtaataattaagacagatataaaagattataataccatatcctcacttgaataatgtttaaaaacagacacaaacagatggagatagaattcaaaaaagtgattatctttgggttatcacaggggctctagggagcttcaaaggtggtaataagtttctattttcttgacttggatgccggttatgttttgtgttcattttgtgaacatttttgtcaagctgtgcatttataaagggtgcctttttctagatgtatgttatattgcaattaaaattttattgaaacaaataagaaaacaaggattatttttataaccagtcgttatcacatatatgtagagagagagagatttttttcttttcagctctttaacaattgtgctgcttggtgttattagtcatggcagggctatatgtttcaatcaaagaaagtaaccatgatggcatcctaagtcactcacaagcagtattacaagtgttctgcaattctgtacctcgaattttaaatgctactttccagaattgttgatctatgttcagagtattcagaatactgcaaatactgcagatgactgcatcgtacaaatgagaagtttccttgttgaaatggaatccttttcgaggcatcttggctccactagtacttctttctgctgctcttccacaggcagtgatgaagcagtggctgacactagcaggcgtgtgggtggagccctagcaaggaaaagtgcccttaaaaccagactcagtgatgccgttaagcaactacaagcagcagagagaggtaagcatcagagagaattgaagtctcatctgttgattcactggagtgtaaggtaaaccttcaaggaaggattaggtaattctttgtttgtcaatgattttatacataaatgttattttctgatgacaaaatacgttcatcacaaaaaaaagttctagaaaacaaaaagaagaaactaaatataaatgctgtaatcacaccacgtagaggtgacctttagatttgagagcctttttttccagcattgcctctgtgtgtgtgtgtctgtgtgtgtctgtgtgtgtgtgtgtgtgtgtgtgtgtgtgtgtcttttaatgggatcatgctgtttatagtgtttggtaatggctttcttatgaacatccttcctcataacaatatgccctaatttggttattggatttctttggcccagctgtaaacagcttccctctgttacatgtcaagtcattcttaccatataagcaacaggcccagagaccaaatagaaaccagggagaccaacaagcccaaatagagaaacaaaagcacacgttttgcttaatctgggactgcagtggtatcttagatagatgtgattggaagcagatgtgccttccttcgcgcagtgaaagttaaaaaactagtgcagcatatgggtgttttactagaatgagcaaatcctagctacagtgctacagtgcaccaaagctctggccaggagagtggtccttcatggagaagcctcatcatcaccgtcatcagaatgactgtttattgatgcttagtgtgagctgggcattgtcctaagtgttcaacatagctgtattagtccgttctcacgctgctatgaagaaatagccaacactgggtaatttataagaaaagaggtttaattgactaacagttctgcatggctggggaggcctcaggaaaactacagtcatggcagaaagcacctctttacagggtgacaggagagagaatgattgctgagcaaaggggaaatgccagacacttataaaaccacgagatctcatgagaactcactatcacaagaatagcatggggaaaactgtccccatgatccaattatttcccacccatccctcccatgacacatggggattatggaagattacaattcaagatgagatttgggtgggaacacagccaaccatattaatactttatgtcatggggataagtaccactactgccttcaggctgatatgaaccctgaggttcatgaaggttagggaacttgctgcaacaggcacagccagtaagaagcagattcaggattgaaactagcatttatcagaatccagaatatgtgaggctaaatgaaatatatcctcactttaataaattatttattatttatatattattaaattaagtattatttttataataaaaataattataattcacttaggtgatggtataacttcaaatttataattgttttacagttctaattacattacagttggggccaaagaaatccaataaccaaattaggtcatataaccaatccaataaccaaattagggcacaacttcaaatttataaaatttgaagttataaagtcacctaaatgaattataattatttttataaaaataataaataattctcatagaaatattagaaaatgcagataagaaaaaaagaagaaaatcacctataatcccatcccctagacaaaattttttgttgtaaatttacatcatggttattttaaagatgtaatttttaacaaaaatgggaattcactactaaaactctttgaaatttgctttttttctattaaaaaaatatctttctttattgattaacttctatagaatcatttttatggcagaagtgttccacaagcctactttttcataaaagacagtgatatttgcaattaatttcagacacaaacctcttatgagttaaaatctcatgtgcattttctatggctttcttaccaggttataggaaatacaattactcttctttttaaatttacctcttaatttggaaatgttttcggtgagccacatggttatccaaaaatcttacttttgcttaagagcccaaaatgtgagatctgtttcattcaagggttaaaggggtgttaatgttccccaacaaatatccggcttctctgcaaagtgaatgaccctgtgctctgtgtaaaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcaggtatcacttagaaatttcacaatttgaatctaattaaggaattggccattaaactctatacatcttttgtcaaaaaacagttttcttcatttgggttttggattcgaaaattatagaagttagcttagaaaaagaaaagcttttgcactgttcatctatctatctatctatacctgtctaaatacatatgagaaacatacatatatttcgtatgaacactagatggattggtaaagagtcataattttttctatgtgaaattatggtagcaattgtatcaacgtaagacttatcttttagggaacaaggttaatcaaatgttgggtaaataatcttaacaaaatactgcttagcttttagaaaaaaaattactaaatggcattgcttctactaggcaacattgctttttctttatctgagtaattaggttattaccaacaagtactgaatatggccaaacataactccagctttctattaagaacagcgtgttggccaacttgaatatacagttctatagaaatgaaaatgaaatattttcatgtctacctaacttattttgtagatattagaaccaggcagtacttgtgaaatttcgctttttccattctcacatttttatccaatcccttcataacttcttaaacagcaatgtctgtcaatatcatgacaaatcatgactagaactttttgttctccaatatggttttgcaaacaatactaccttcacttgtatctgaattaagaaaggtcataaatccatatatgatctgtcagtacaaattttattccaatttacaaatacccattcccataacagtaaaatagctcttttataatgatcttttaagtatatattcatttcttccatgtaaccactcaaggaagtgcttttaaaattttgtctttaaaagatttgcctatatgaaattcaattattacatttataatgatattgcctcgggaatatgtaccaaatctgttacatttttttcccattttttaccagtcttatcaagtgattccaataagcatccagaagtttcaaaaaattgaaattgtttactgtgcttttctcaaatagcattttgtggttcaaaacaaaggaaatgaaagaggataccataatgtaagacactttataagtactctaatataaggtggctccctttttctaagagaattgattgtagggagcagggggactctgtcttataaacatttccataatcaatatctaacataattcattaagtatattatctctagtttttaaagactagtatactctaaaataaatgtcgttgtcagtgatccaaacaataaatatttacctctgtattaatcaatataataaactgatagttgctattattttacttaattctattccttgcactggagaaacatcgtgtgtcctaagtacagagaagggatgtttccttgatctgcactgacatagtctcctgaatgtgagtttagtttttctctaggaagacgcttgctcttgcccagctactaatgcttaatgaccatggccctgcccttaggaaagagaatacctcaaaagtatttcgtctctgagccaatggttctcaaatactagtgtgcattagaatcacctggaggccttgttaaacagactgctggatcccactccaggaactgctgattcagtgggctcgggacagggccaagaacttgcatttctgacaagttcctggtgatgctgctgctgcttgtctgggaaccacactttaagaaccactgttcagtcaatgaaactctggaaaaatttatgccattctctttgttttgagtttctctcatcaagctgtattcttatgactggtgcttttttttttttgagacatagtctcgctctgtcgccccggctggagtgcagtggtgcgatcttggcccattgcaacctctgcctctcgggttcaagcgattctcccgcctcagcctcccgagtagctgggattacaggcgtgcaccaccatacctggataatttttgcatttttagtagagatggggttttgccatgttggccaggctggtctcaacctcctgacctcaggtgatccaccagccttggcctcccaaagttctgggattacaggtgtgagccatcaagcccatctgacttgcgctcttttctatgtttagaaaacatagaagaggaagaaaacatagaaaaggaaaaaaggtggaaaacaatcttcctaccttttttcccagtattcctcttgacctgttatatcagttatattagaaatgcaagcagaacctgtgctatatggttaaaggaacatttgtatatataccgtggtccctgccctttagaaaaagcctgctctagatacaatttttagatcagtaagtactataaatgtcacaaaaatagaaacaaactgtgctttgggctttgttaggtccacgactatgccaaatgtcatgctcggggtcaggttcgagcccatactgaggtctgagtggagtgggtgggtggctgaaagaacacttgagggatgtagacaggtgaaatatagttctgttcagcagctctctcatcagaagctctctcacactgcctgctctgtctcggctgcttgctctggctgctcccacacacagctgagcagtcggcttgctcttgccttcagggttagcagcttaactttctctctttccaggtacaagccagttcctggctcccccatgcctaccttcaaggcaactggctctcccctacaggggtcagtagcgttactctctctttgggcaccagcacgcctgagccatgttgagccctggctctccctctgtccgtctgcaagacaggcggccttggcattctctctttctctgggcgcaagagcacgcatcctgtgcatggcatcggcagggcagttatacattttcaaacaatagtggctgtgagccaagtatgagcttacacaaacaggttatataacaaatggagtatgcacctgtgccctaaactagctgagtccgtctggcccagatgtctgcctcaacctattccctgatcaaagcacatctgtgtaccttacaggttttactattaattttgcaggattaaaaatcatttctcttagttctaccatatgtaatccatgtttattgtctacatctgattcttgaaatataatattgagttattttcttaaatgattaatttttattaactgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaaggtaactgatgaaaagactcatcagtcagtcagcggtaataataacacgaagctgagctccaactgcttgggcagcttccagagcctggacctttctgctgtattctccaactcagtagttctcagccccatttgctaattagaaacacgtgaggaacactgaaaacgaaaccaattcctggtcccaacctgaaagcaatagatcagactctgtagagaaagggctcagtacctgtatgttctttaaagctcccaggttattctaatgtgtagccaggtttaaaaaccacagagttaaactagtcaataaagctaatatagcaaaagaagtaaagcctcaataaaagcctcaattcgttcttatattttatgttattttaacagctgctttagtgcaattaccataatggaataatctatcccatctgtcctaccccttcaagaaattatctggtacaacacaaattatgcagaagcttttactgaccacccgcagggttaactgaggaatcacatactggctaagaggaataaactcaacaaacacactatatgtgttttgggacacatatagaagcaacttagcagaagataactagggctggcatttgtaggaacatctcctgacatagcaattacttttcaatgtggcaaagtggagcttgttcttggacctcttgaatttttttaattgattcatagaccagactcactttttatgaccaaagtatatggttttattttctcagttaagaatcggcctgagcagactactggtcctaattactgacagaaagaagagttagaaatcaactatttcgtaatgtagaagattattcttggtaaatagacctgacttttaaatgatgataaatggtcccttgtgacaaattaccttatttagatgccccagtgaacattttcaaaaaaggtttatctaaaggtacatcaagaaatggcattctaaaagctaggtttttatgagtgctttcttgtaatattatttctataaagagtatgactttgggaccttaatcacctaagaccatttgctaaagacagacttagccccacctttgggagttgggagctcactcagtgcccccaagtgggatgcttttcatgcagacatgcactattctcagactctcacttattaatgtaagactttaatcccccacactgcttgtttattaagatgtattggtcttggccgggtgcggtggctcatgcctgtaatctcagcactttgggaggccaaggtgggcagatcccttgagtccaggagtttgagaccagcctggccaacatggcaaaaccctgtctctaccaaaatacaaaaattggctgggcgtggtggcgcacacctgtagtcccagttactcaggaggctgaggcacgagcattgtttgaacctgggagatggaggttgcagtgagctgacattgtgctactgcactccggcctgggtgacagtgagactgtgtctcaaaaaaaaaaaaaaaaaaaagtattagtttttactcaactgataacataggacagctgcactccagtcatttggaaatagagccttgagctcactgaccacccacattagccaaatcaatattaataaattaatataaagatgcctaatcatttggaaagattcagataaatgacataagtatacacaatccatacacttgtaaatactctaaaaattatccctgaatcagaccagctcagcatatcatattgggcctcttagaaatgcacttactgaattgtgctttgttgtgatgcctttctgtgagccattataagaggcaccttatgaactcattattacagttattataatggtaggaccaggcactggaaagcactttatagttatcgtatttcatgctcacaacaaatttattatcctcatttcacagatgaggaaactgaaggttaagtgacttgctcaaggttacatagttaggaagtggtagagcccacctggtctgagactacaaagctagtccagacccctcccaactgtgtagacaagggcaaggatgttgctcacagcctcaccccatgtcccttttatgaggaccctagggacaaagtcccagctgtattagtaaccaaaattagttctacttctcccaaacaattagttttgtataaattgtatgagccttgtgaattgtatactgaccagacaacttgagcaagttgtttagttcacccaaaccaagtatactgttcatggtggaattcatatttatcctcattcttggatctacttagtcaccactttttttttgctttctttcaccccactttaaactactgtgtcacaatctgccctaagtcttctcttcaactaggggaggatgtggtaaataactacaggtatggaggtgaagagagtttataggcccctgtcacgaatgagggaagcacgggaaagcactctgcccatttctgcaaagcacttttaatgaaaccgttgtgtcactccagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgtaagcacatgagtttgaaaggagggaataatatttacaaggaaagctgctttttctcttgcctaaaataaagccacctaggcaaacaaaccaaaacaatgcccattctggtaactcagaagatctcattttaatggcaaaattaaaagaatgactaaaggacaagtcatttcttctctgtgtgggatattgtggggattgtttcctatcaccatcacactactaactttgatgagtctgaatgaaacacctcaaagactttcagaaagacagaagcctattctgtttgatgctgaatcctgtttagagatgcatagtgatcggtactgtcaggctgtattatattcctgggttagcctcacaaaattagcccattcctggcagccaacaaatttccacgagcctgagcaagatggggccagcagactctgatgtggccacagggaggctggaaaggaagagacactgcctgctcacaggagcttcggataataattcaggccagaagtcacttgtatatacccaaatatttggatttctgattgtcctttaaaaaagatgatgttcattcttatgaattttatttaaatgacttcttacttcttgatatttcaggccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaaggtacagtgaatccatgacacagggcatatatgcacatatcacaagaaacctgttgaacgtgcacatgtgcgtgcacacacacacacacatacacagtcttcctgtggatgttataaatagcattttcctccctttattcttgctccgttttcttccattattcttatattctttcccaaacaccttagtaggaaagaaaaaaaaaagtcatttctaaatcacgatctgattattagattttacctggtcaatccatgaattaacttcaaaatggaatgtctttcttctctttctcattgattgtggtattttgtaaatgcttattagtgtcacaaaattacccattttgtgatgagggagcattaacattttgacatttaaaaagtattttctatgaattatataataacaagtgaaaattatttatctcaatagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaaggtcagccatacagctatattttgacctattacaaatctacagtaattgtttttataaatccataaacctataatgacttgggggttgctgatatcactttaagagcttagttcatgggggagtagaattctgaaccagaatctataaacctgatgtgtaaatctggtctatgctactcatattttcataatgtcaaatgctttcaagttatagctaactcctgaagatcagttcattcattctgatacatgcatatgtaattaatattacccccacctgccacaggaaggtccgtagcttgtggtgtcaccacagtttagatctaatcttcagctttgcagtggtggtttcaaaaattcagttatctcacctaatacaggtatgaaataaagtatctgggatgagagagggggtgagacttcggagagagtatgaaatctgatgaagggggataaaggaaaggtcgaagaagatgggaagttgatctagggttccaatttcaggactattattactagttatgggcacataattggaatttatctgagaattattttccctctcattatatgagaacaagaatacctacctaacaaagctggcgcaaggactgatttttgtcatgaattcactgtacagcctatgaccagcacataatctatgctcagtaaatcccactttctctgctaagatttgcacaactgacaagttacgccatatctaaatgatttggcataaacacactcgggtctagaaagatatttccacaaaggggtaggtctccttgacctactattagttgcattgtctgttctgtgatgtctgagtaaaatatgaccatgagacaagtggttttactttttctattgcatagctccctaccagcttaaacctgcctggctttgttggctgcctggaactggccactttgaataatgatgtgatcagcttgtacaactttaagcacatctataatatggacccctccacatcagtgccatgtgcccggtaagagacagttaagagtactaaagacttggatattcatgcaagagcagcagatagaacaagtatgagtcaatattcaggttctcaaacttttctttggggaagccagttttgaaactacataagtcatacctgcaaaaaactcttcacctgttctctatcatagatgagcatgcccaagtatgaagtgttaaacaacttgtttgcagccttgattaaggattccagagactagggtgtccctggagacttcagttgtcttagcacacaggatacagaagaaaacaatccatttaacatacctacaaatacctctttatctcttccttgcagacaacaggacttcatttaaatgttgtaaggtccacagaagatgttagaagaatgggttaaaagggcttcacttgaaaagcataacagaaactgtagtgttcaaatgaccgttgtgtttccatttcagagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggagtgagtaaaaatacaagtcctactacttctcctttatttcctttactttctgctactcatgtttccaggaaccttcccaggtctagtgtgtcatgccatcaaactgaaattctagtttagaaagtcaaattggattttcttcttcaggaaagtaatgacagcaataaataaaagcaaccctgagatgcatttccccacagtacatttttggatataaataaactaagagaactttgaggaaattagaaccaagatctagatgagcagggtgtctgcagaaattttgcactgggctcctaacttttccaaaccatatgccctaatcaattttaaagcaaagcttgcatgctttgtatatatgtatgtgtgtatgtaagtatatatgtatgtacacacacacacatatatatctttgtttataaatgatacatgtgtactataaacagatataaatatagtatgaaacagtcaaagcttgtaataaaggacaaattatataaagataaaataaaagattatatatttaaaatgaagattaaattgacttatttattaatgatacagaaatgtttttctcactaaaattatttttaatagtactttatctactgtacagctcaaagaaaatagttttagtgagaaaatgtaattaagtatgctaaatattttcaaaaatccttaaactctttgtgacacagtgattcaaaagtcttgtcctaagtccagtttatttcaacagtaattttattggtggttgtaactagacaagacacctcacaaaaataaaaaatgaaagaaccatatcattagctgtgcctactaactcaaatagttttcaatcacattcaccaagtggcaaaggttgtctttgagatttgattggtgtatttccttttttctaatattagttcttgtaagctaaccaggtatcattttgtaaactttaataaaagggttcaaagctattgaaaatctttatttgaaatatttttctaaaggttagaaatttcttccctcaaatgttttaatagagctgataggagagtttttgtaggattgcatttacattgttcccatcaacaaaagcaacaatagaaaaattcccaaacatattttttaaaaaccatctctccacagtataaccgtcctcaaaaaaaaggagaaaaagttactttctcatccattattatgataatacccttacattgatgtgacagtatgtttcttttttgaaataactagtaggattcatactactgtcagacatttgtcatcacgaataaagttcaacaaatttagaataattcatgttacaaagaaaaatgtgtaaccctctataaacttaacagcattttcagaaatttgtaggaagtagccagcaaatatctgtgtgtctcaaaatgttttcacatcactctacatctcaatacaaaatgagtgtaaatattctattatttcggttatatcagccttaaatccatataactagccacacgtaaactgcaataaattgcaataggctagaagcaaagaaatggatgaggagctaccttcaactcttcaagtgtggaacccctcttgggaagccacacatattatgtgaattttgtgaaagtctgacaaaaggataaaatgaaggcccagagtcaataattcatgtgttaaatattaaaagttagtttctttctctattttagattttttagtgagtataaatggatgttgaaatattttcttctctatttcaggtttttttaaattagtataaatagaagttgaaatattttcttcctaaactccagtaggctgctttccacactcccaggaatgtacaaactccactcaggagatcacttcctatagaatagggaccttgccacaatgctttatttttcaaatccattgacttcttgtatctatgaactatcttctgaaacaagcaaaactccagtaaattatttgagtgttacaaaatttctttgattcttaaacatcatgtgttccaagtgcataataattctatatttatttacataaatccagtgtttcaaaacaatacagcaatggccttctttttttaaatccatatttgctgataatatggaagaattcttttcagtataccttgaaattattttttaattttactaattttcacctaaaataaatgcagacacatctgttggcctgttataatttttaaaagtttcctaaagacaaggcagttgaataaacatggtatactatactctattttcaagattttcttaaaaggcaataatgtagacttaaaacttcatccattagttcagaaagtagaatgaaaacagaagaatttttacactgtgtataaatattaacttttatgtattaataagagaaatagctgctgatatggaagtagttgtcactttttttttttttttttgagacagagtctcgttctgtagcccaggctggagtgcagtgtcacgatctcggctcactgtaacttccacctcccgggttcaagcgattctcttgcctcagccccctgagtagctgggattacaggtgcctaccaccacgcctggctagtttttgtatttttagtagagataaggttttgccatgttggccaggctggtctcaaactcctggcctcaagtgatccacctgcctcggcctcccagagtgctgggattacaggtgtgagccaccactcccagacactgtcacttttatttcataagaatttcatgagactttcttagtcttcaaatagttccagtaataaagaatacagtcttatttctcaaattcagctaaatctgactctactcgcataacagatgttcctatcttacaattcctttctctcctcagagtatgtttttcagactggaaatgcgcaatggttacctacatgtgttctatgattttggattcagcggtggccctgtgcatcttgaagatacgttaaagaaagctcaaattaatgatgcaaaataccatgaggtacaaatcattgtagtttggttggttttgtttttgttctttatacttagatctgttgatctaatcaggcagtcaaatgagacaggcaggatggtaaataaactgagaactttcatatctaaagagcaactgaaggaccctcatcttctcaaccctaggaaaacatttactttaaaacattggatgtatttttcctgttgatgttccaatttaaaagtcactgaaagattccttttaattgcttaattaaccagaaggcttctattaatcttaaatatctcaattggtattcctacaggatacttctatacatttgttgaatgagccagagtgtagatacacagcctttttttgcttatcctttgagccccaccaaatttaacaagaatacatataagtaaatacagaatttccttttaaaccacttatccagaatttagaaaatactagcacagttttccttataaagagaactcacaaagaatcccctttagttttgaaacagatgtgcagactactgaaaatatacttcatccattttcattaactattttaaatatacaacttaataaagtgtatacaaggcataatatcttttaagttgaaccaaaatgcgaagggtaggagactgtatttcccttttcagttcaaagtccatagcctcatgagaatggtttacaataaaagaatattttaactatttctctgactagcatttttgcagattcattagaactgctcactgtgtcaccaaaaaaattacacctggtaacatgcaatctagattccagaaggcacctgcttgggaatacaataggggtcaccaggggttaggggatagggaaataagaaattgctgttcaatgtgtatacagtttcagttgtgctaggtgagtaagttctcgaaatctgctgtacagcatggagcctatagttaaaactaatttaaaatttatttaggatagatctcatgttaagtgtgcgtaacacacatgctcacacacacacacacaccacaaagggacacaaggaaatgctgggaaatgtgtgatatgtctcttaccttgattgtaagatgatatgagtgtttgcatatgtccaagctcatcaaattgtatacataaaatatgtgtagttctttgtatgtcaactagacttgaataaagttgtttttttaaaaaaaaagagaatggtggcacctgtttatagttctttcctgaatcctctcagaaggagcaggaggaaacaataggtctaatcgcaaaatttttcttgggctggctcctcttcatacagacctcctttcccagaaagtgtgaactgctgcttgtagaagcaagagttttcaagtctgtgagaaaagaaaatctatctattccccattttgtgaacaaacaagcacaaaggcatggaagaacagctagtataccaggagaattaaaatatatagaagtcatcaaagaactgaatattaaatagttaatcaaggcttactatatattatctctcccagatctcaatcatttaccacaatgataagaaaatgatcttggtagttgacagaaggcatgtcaagagcatggataatgaaaagatgaaaataccttttacagatatatacattggaggagctcctccagaaatcttacaatccaggtaaggctttttgttaagtagctgtttgttcctagcaatgtactgggctggcaacatccaggagaggtctagtaacagtgtacgcacccttacttgctacttttacacacagggacaggcacaggtacacacattcatgtaccttcaggccctctgcagtcagtcctcaggacctcctgaaattagcatcgcatagatgtaatcacagatttcttcaattattgtattactcttagaacatgatctaatgcagtatttctcatcaataataggaacggtggaacatgtgtattgtgtgaagacaaaacagcatttgtccatttacttttgctttagccttaaacccattttgaactctccaatagcatctgagctacacaaatttttaaggttatccaaagggttgtgtattatgtataatgaaacattaagacactcccctaaactttgttgattacagatgtgttggaaataatgccaaaatggattcattaatgacgtggattaataaaagtctgaagacctgtgttcaaatcctaacatcacttgtgacataagagaataatttatttcttagtttcatttcttagtttcattacgttaaaccctgtgaaattactaagaattgattatatttctgtgtaacatgttagttcctatgattcaacctaataatcgtctgctaaagggaaatcatagcatctccatctatttcactgaattgttataaagataaaatgagataatgtaagttagagcattttgaaaactgtaaggaagaaattggcttgacgtagaacaaaactcttctataggcaaagattagacattgctgtgtgcctatcaaagaaagcatgagaatatgaatgattataaagccattacaaatgactataaataaatgcaaattccatagcctacatatgcagggtaacatcatcatcatggctgtatcagtgaggctgactttcttttccagggccctcagagcacaccttcccctagatatcaacttcagaggatgcatgaagggcttccagttccaaaagaaggacttcaatttactggagcagacagaaaccctgggagttggttatggatgcccagaagactcacttgtaagaaccactcagtcaaaagctttttaatagacacaatacttatcactctcaaaagctggaaaagttcttttcagcttctctctgatcctaggtacaccttgggttcctttctgccaccaccagaaagaagaaccattaagctagaagggctcttgtgcatggggttcctctgtgacttgttcgtttgcttcagttttccatgggtggggcatctaacacccagagagggtgtgctagcatcattgttcactcaggttggagtcagtggagaagatgaaaccccatctctcagaggagctcctagtgtatgcctgaattccaacatagaccagaagtgggaaaataaactatttacgtagaaattaacaggcaaggccttccgtatgtgaaacattgatagttttaagcatttgataattctcaaaaacactatctccacttgttctggcacacagatatctcgcagagcatatttcaatggacagagcttcattgcttcaattcagaaaatatctttctttgatggctttgaaggaggttttaatttccgaacattacaaccaaatgggttactattctattatgcttcaggggtaagtgtttgtttttctctgaggaaacttctttgtgataattgttttgcctattaaaaataatttgtaatgcatgttagaagtgattttctattcagattaattttgactcacacgtagacacacagaatgcctcatttcaaacactttataaaatattctatgtattgtatatcagaagttcctaacctggaattcatagacccacccccaagggttcatggatagaattcaggggggtctgtggacttaatgcgaaaagattacatctttattttctctcactgaaattgatcattttctttgattatgactctaggcaacacaccacagtagtattaccagtacctgtgactttgtcattaatagaaatcacagatttttttgtttcacattacaattgtcacagaaatctcagaatgtcatttttgctcattgctacttctaatgttattaggtctgctatggaatcttattctttaatgccttaataaaaaagttataataatatcacagattattttaatattttgaaaactgtatttcagtatgattggtttcctttgtattattatatgttttgttttatacatttaaaaacattattttgtgaagcggtcgctatctgttaccaaaatgccaaaggtgtttctggcacaaaaattctcaagagtccctgtttgtatgcaatgaacaaacacatttgtgatttaatttataaaagagtaaaaagaacatacatacttctcttagatttgctacagagcatttgagctcagcttataaagatacgttatttcaagaataaactaaggtctgtagaggattggtgactgtaagatccaactgatgggtctctgaaaaggtcatcatcaatatatacactgatgtgccaggtcatcacataacttctgaaagcagctttcacttttcatatatattacctgcatctgacacatttatatccaatttaattggaatcagtagaatttgtgagaatttacccaaagcattttgtagaacttctgacccaaacctgcctcagactaccctggttagttaaataacactttttgcccataaaaagtagtctattttgagggcagacttaagaagttggtgcccatataaggaaagagaagcaagattaacccttgccaaatattttaagacaagcaataagcaaattcagataagaagagctaacttgcttttaaaaatgtctcttctgcctctagatgaaaaagtgaaagattttaaaaagccaaactagtaaattaacccttgcctagtcatctagctacatccccaaggagacccaaatatcatctattcgaagggattaaaagtgagattgaaagtaggaaagtaactgagactgggttgacaactcccagcataacaaagtcatcaaaaattttcagttggaaatataggagatacatttttctactgaaatgtgtctaattttataagcaataccagtacaagcaataaggtattcttggttgttatttatagaaattattttacaagcaaatttcctacacactatattgcctttaagcaataccattcagtaaatgttgaaaacatttccgtcttttggatccctagactccctacttacatgcctgtgcttgcatttcagtcagacgtgttctccatctcactggataatggtactgtcatcatggatgtaaagggaatcaaagttcagtcagtagataagcagtacaatgatgggctgtcccacttcgtcattagctctgtctcacccacaaggtatagctcctcacttcatattctttccaccatgtctatttgtgggacatgattatgtcaaaaaccactatgaataataggctgtcctataacttttctaatgttaaaacaaaaatgctagaaggaacaacttatcttcctcaaaaaaatattgctattagtttccaagacatgtaaaataaatcactatgaaatttcttaaactaaatataagggttctttttccagtaaaacaataggttataatctccttgagggaaatgcctactaatattacctactgaacagagtgcagtattttgcacatagaaggagctcagcaaatattggtcttgtttagaccttgagtcaaacagttgagaatgcaacatttatggcattttaaaagctcgaacttcatctttaaaatagataatactgaatttatttttcataataagaaattttctggaataagaaatgaacctctgctgctatcctatgtccacttttgtggacatagaaaacatgagtaggctttttctgggccccacttccagtaaggatcaaaataatctaatgtgctttgccatgaaaatggtcttccacaaatgtgattaagtgatcatcataaggtatgctctgttttatacacacacacacacacacacacacacacacacacacaaaaataatgctgatgactagtcatctgaatttcttgccttacgggtttaaattccaatcttggtttggaggatcttttttgcatatagaaatatccaaccattttatcctgggcctcatgaagagtttggcaactcgctgtcttttcattaaccacatgttccatttcaatttcatgagaaaacctgcttatccaacctagagtgggtcaaggtaaaatgctagctctgtggtatgtaaagaagcctttttcttttgcagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccaggtataatatttttattattaatgaatctgcatgattgataaataaaatcaagacaacagcaaaaatattaaaactgagaactatgaaatgtatctgaggcattaggggatagtaattaaaagcttttatgtgcttgagaaactgtcatacttgggtttctgtgtaggttctttgccctttaatttccatatgaccttgactaagtaagccttcatttcttcacctgaaaatgcagataataatggtgcctacttggtaggtttgtcatgaagggtaaatgagaagataatgcacataaagcaacttgtacagtgtctggcatacagcaagctataaatattagatgcaattatttttgtacttatcattaatgacagagtaacatacccagaggtttacaaaactcttaatttaatgcatgattttaaagaaagctattaatctaggtccttaacaaagacaataggggttccttgagtacaagaacaagcaagggaggaatttaatatagattaagaaacagaggcagttccaatcatccagagtgtgttgagggaaaagatattcattattataaatatgtgatgccaggcacatagttattaacaggttgaatgttaatttaaagggttctggttaagagtggttgatgggtaaggacccatcacacatacacacacacacacatgcacacacacacacacattttaattgccaaagctctttcacttccataatattcatcatgtaattctgaacaatatttttaatatttattttttcctctgttacaaacacagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaaggtaaaagataatgccgttctgacttcctaattgtcatcattttccatgcacacagttctagacactgctgttttagagaattgacttgatactttgcaactacgtacataggaaagatgggattcttgcagtatcacatattctagtttaccagatttgttgcattaattctttgttatagaagcattttttattttttattgaaatgtagtaattgcacaaatgtatggggtacagagtgatctttcaatacatgtatacaatgtgcaaaaatcaaatcagagtgatagcatgtctattatctcaaacatttattatttctttgtgttgggaacattcaaaatcatctcttctagctatttggaaatatacaataagttattgttaactatagtcactctaccatactatagagacacagaacaatttcctcctatctagctgtaatttggtacacattaaccaacctcagcctatcctcctcccgccgctgcccgtcccagcctctgataaccacagttctagtctcctgtgaactcaacatttttagctcccacttatgataacatgcagtatttgtctttctgtgcctgccttatttcacttaacataatgtcctccaggctcatccgcgtttgttgcatcagttcttgttccaatgaacagtctgaatcagctatttattcatacttccaacttacaatggtttcctttacaatggttgaaatgtccctgtgcttaacagtttgtataaataatacatattatttagtactataattctctagtatcatttgcttttgtgtaacaattttaggcttttgtcacaatcatggaaattattcaagtttctgatcttaccctggtttttcccctccttcctggaccttcacttcaaccactcacatgcacagttggtctgtgacatcagctaaagctactccattatcaaaatcttgagttctaaaattccaacctgactactattctttctcattcatttacttcaactgtgtacattatttgccttcattacaagtgggacccttaatcccttctaattctatcagtttaaccctccccacctctttcatgatccaattttaagagtgtgctcaggtgtcagtgttcccagcctggcccttgccaccaacaactctcatctgagtaactgcatcacctcccagcaggtctccttgcttccaccttgttccctgatagcctattctcaaccctacagtcagatccttataaacataaatcatatcatgtcactactgtgctcaaatggccccccgactacactccgagtaaaagcccaaggcaccacaatttgtaagaggccctatgtgatccatgccttaccctgagttcatctcctcctacttgcccacctccctcactcttctccccatactggcctcccaactattcctagaatgggccatgtgtactcctaccttaggttctttattcaggcttcccttctgcttggatcacacttctcccaagtatctgcacagacaacttctcctccttctacaattgttcaactctcacctgttcaatgacctacattgacaccctattgaatactgcagcctgcctcctacctcctaccagtaatactgctcttttgcctctttctattcttttttcatagtccttatattgtaatttattagcatgctttctttattatgtttattatttattgtctgtctcctctactaaatgcaagctcattcattttgttccctgacatataataagcactcagaacaatgcatataataggtgttcaatacatacacagctatctgcatcatagggttgtaacaaaaactaaatgagttaatgcatgaaattatatgcacttagcatagcacaaggcatatagttaagattcagtgaatattagtggttatatctctatagagccttatgagtattctggaggattggttcctaaaagtaaaattgcttggctcaagggaatatgcattttcaatattgaggcaataccaatttacactcccacaaacagcatttgaaagaacatattgtcccacactattgtcaacaatgaatataatcaaatttctataattttgcaattctgatggacaaattgaggttttagtttgcatttctttgaatgctagtgaggttgaacatcttttcaggggaagaactgattgccttccaaggctggcttctggaccatcagcaagagggaagtgtctccaccaccttctccattctgatggtttttcactgaccattatatcttgacattttccatatatttgagcatatgtggactacttttttcaatcctcttgaaacttctcctttgttcatacatgactgctttatcaatgttaacaaaataattttgtgtgtgtataattaaaacttagtagtttcttaggatctcttcctgagtttgacatggaagacagataatttcattgattctcatgaaggattttgctggaagatactatgaaggagttttcagagtatactataaaattctaatagagtcttgctgttaccctcatacattgatgctaaaagatttatcctgaaaatttttttatctgacacttgaacactggtcagaggttcataggcagcagattaacattacaggctgatgagggacatcaaccttctcaagcaaacacagttacccctttaaataaacacagttttctaaattaagttgtctatcaaatgtgatttcccaacaaacattcaatctcaaggttataatcaacagccctactaacacaagcttttccatattataggaaacttgttaacctttatggtaaatagtgttagacagaaacttgactttgtaataacaagatacagaatcaccatagatttcaattatattttatggtaactagaatgtcaacatttgctaatcttttcttatattgacccttgtttcaacagcttcataaatagctaccaagaaaaatgtatggcctctgacctaaattttcatcaaggctgcatcaaagcaattgggattgtaataatttattttcacaatcacttcctaatatcccattttattcacttactatattcacttaaccattaatagactttcagttgcttctagttttctccttttatagccaaagatctttgtaggtaaatctttgagtatgttgctgaacaaatctttaagatagattcccaggggcagaattactgaatcaaggcaaattgctttccaaaaaggtaacattgatttctagttccctatggtatttgtgaatacctgtcttatcacctatgttccagccttaaatttttttaacaatgtttatgtttcaagtttaactgggaaaagtttctcatttggtgtttaataatgaacatttcaggtattgtaacagacatcatgctaaggtatctggcaaaccactctcttctctaagaactgatttccgagctagtgggcaggccctgtgttttagatgcacgacctcacttccctggatatagatcactggaccaaggtagatcacgtgcacgaagctcggctatcagattctcttccttggaaacttaaaacctagagagattagcctgagctggccattgaacagaaaacatgtaaacctaagggcattatgttaattatacacagaggaaaaaaagctccttcatagagtgaaaggcaaaaagctatcctgctgagaaagaaaaatgaaaagagatgctctgagaaatcagaaacctccagaaagggagtgccttgattccttctagctttccaattgattctagccctgctgggacaccacaatactatcctatcttagattgtttaagatggccaggtgcggtggctcacgcctgtaatcccagcactttgggaggccaaggcaggtggaaaaagaggtcaggagatcgagaccagcctggccaacatggtgaaaccccgtctctactaaaaatacaaaaattggctgggcatggtggcgcatgcctgtaatcccagctactcgggaggctgaggcaggagaatcgcttgaacctggaaggcagagtttgcagtgagctgacatcgcgccactgcactccagcctgggcaacaagagcaaaactgtctcaaaaaaaaaaaaaaaagatacccctatatccttataacacattgctgtctttttcttcagtagctcaactagcttggctgttatctgacacaaaagaatcttgctaaattgaactagtactatcagtaggattgcaactaataggcccacagagaaaacaaaaaattacactgataaagccaaagtctagtggagttcattgagaatcaccatacacatacccatcttaggataataaactgagtctcagtgttgtatggtataaagtaattaagttataacttggctattttatcattactaagagtgtgaatgtgtatctgcagaagaattagcatatttggttgccatatataaagacacccgagtttattgatttttgcagcagatgagtgatgcagcctacatagtcatgtattcccacactgaagcagagtaaggcaaggctggtaaattgagattgttctgtttcaaataaccctgtgcttcactgagcacctagagctaagtggatacactgactaagaaagcgtgagatcctttccatccaaatggagaaaacaggaagcagccagagttggggaaagtcctctaccctcactctcactctgttctctcaccctcactacaggccctgtgcaaagtatttccagctgggcctttcactgagacaaaagtgatcatatctcctatcataaagtgtattactccactgggattgaaatagagcatgtatttggggaaattttcctaagacattagagttaaagaatctcctggcagccctactccagcccattctgcccacctacggcttgaagctatggccattatctgtaggtgagagcctggaccaaaaagtattggtagctgggtatatttcccccatccaagagagaaaccttgtttctgtggcagtaaaaatcaggttatgagtcctgacaactgcataaagaagggaagagggaatggtggaaccaggtgggctttcctttaggacatgagagtctatgagctcccacctctctccaacctaaccaccactgtgagagtctccactgccaaaatccaactgcacgagctgctgccctgagagcaagagacactggcacagctcgtctgtcctttaattaattaacctgccctctgcccaaaatcagatctagattttgaaagtaattctgagatttagctaaaacactatttttttgtgggggggattttgtcttttgcccttatgagattaagggttttattgtccatctgttccaatctactttatatcttccagaaattccacacagcttggttctgccagtaaaaaccctcctagatttccaggactgctgtggatttatttttatgtatatagttctgacatttcaatgggaatagggaggcagggactaaaggtgtatgctcattcagtaatcctcaaccagaacttttcttatctaatcctctctctcatcttgtctgttgcctgtgagtgtgcattcagtaatcctgaatttttgtatctaatcctgcctctgtcctccctgctgccacacatttcctcttctatcaggccttccttgttacaagctgtcttcctaggtgggtcagagcaggccactccctccctgctttgaaagcaggatgaggatgtgtggctcctcatcacctaaaaaacaaaacttccagcaatcatctaaggtcctatctggcaccaacctgttttccaatttgctattataactgtttctccaaattaattttcagttccttaaaaaacaggaatcatttctcattcactttctattccccactacatgccacccacgggaggcatgtataatcatggatttccttcccctttacttctacccattcaatagtcactaaacatttgcttgaataaatgactaaatacttgaatttatttgcatttacttttattttgcttcagaaattgaaactaaataataattaaatattagcctatacttgcacaactctaaattttagcatcggccatgcaattttaagagcacaatgtgtttaaaaattgttttatatcctgtcacataaaattctgctacatatcctatcaccaaaaatatccttaagtattttgaagatgttgctatgttaactttttacacaacatgcataagtaataatctgtgtattaaagtaacattaatattgtttcttatatgaggattttgttgattgattcagggtcattttaattgccaactttgccacttttcactagtatttaagatgtgcacttaatttaaatgatagagcagttgtctctatagcttcagtttaactttgctttactaccatgcggaagaatttggggttagttaacatgctatgttgttgatgttactgctgcagctactgctgtcatttgctcatggggctagaggtaggaaagagaggggacctaatgttccatgaatggaaaatgcacaaataatatataattttttatccttattaatgatgaggacatcacaaattactttttgctgctagtatgtcacttttatcccttaatttggtttacttttatagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaagtaaagtaacacactatactcctagactcctaatgacatggctgggctccatctttgtttgtcacatgtcatcgttttttcccatctttcctttctgtgccaccttaatcctattatgttatcaccaaaataaacactaaatagtacatgatttatgctatcaaaagaattatattctctgtgactttccaattgtaaggttcataaaacagtattcttccaggatactgtatttgatcaaaaagaaaagacaatcaaggaaaggaagatggagcaagtttcaaatgactcatcatctaacattgatatccccctccctctcccatacaaattgctttcagattgtaaatgggagtgcatttgaactgctaaaaggttaataaggaaaggcattgaaaatacaaatatgcttgtatgtctatgaccctccagctatctccaaccccatcgcctctttccagtatttcacaaatctccaggttatctgatattactgaagaattatttttacagttttagcacccaaatatttttatataggtcttacatagctctgtcaaacattcatagaggcaaagtattcaataagaaatctctaataccttataatttgctacctgcctaataggcagaatcagtattttgtattttccaggaagaatttagagttaatcaaactagaagttaacctaataaatgtatcttatccatagcctggggctaaatttctagaaggttttgtttaatttctacacgctcgggtggctgctttttacatgtggtatccattaattaatttttactgggaaaaaattttagtctgtgttttagatagtgcacaactgatattatttgtattattcactagtattttgtccacatggataagcttctttaacatacatatttttactaaattgcagcctttttttttttgagacaaggtcttgcttgctctgtcacccaggctggagggcagtggcatgatcatggctcactgtggcctcaacctcccaggctcaagtgatcttcccaccttagcctcccaagtagctgggactacaggtgcgcaccaccatccctgg[452 bp omitted]ccagatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtaagttgaaggcagagaacagcattaccagcaaatagctaccattgtcaaatggacactaatgggcctccattactctctctagaaatatccattttaaaattctgctgctgcacactcagaattcaatttcaaaaaattgtattccttataaaagtcttgaagcatactatttaaaaagagacacaggctgagcgtaattatttaaaccaaaggatcagtggtcaacataaactgaaatttggtttttaatgatttctcacttattttctactgccaataggtttttacttttcagcaattattattgagtgtcttttattggctaagctgtggaagatacaaagtgaagagtaaatcagtgaggaagataggataccacagtgggagcagataaatattgaaagaaattggtgggtatgtaatgtcaagagtaagcaatgtaacatgcattacaagtaatcacaagaagtttaactgggagagaacatatggcctgttctgtctatatgtggcctggttaactgggaaaagcttcatagagaacatggaaaaacataagctatattcagaaattaagctttaaatcattctatctagaggtcagaaaatacatagatcacttcctctaatacctgaagtggtaaatggaagatgatcatgaaaaaaatacacctatgcatataaagcaaaggggcctggagacagctcacaataaaggcatatgctgtataacaaaacagaatcaaatgagggataaagtttctgccattccaaaaactgcattgccagaagcctactaaacagaagagataaactcctgaccttcagagatggggccattttaaaaataaactttctgaagatttcccacagcattgcaatagcaaagttggaagaagaggaaacacagccttttctgcaatcttggaatgtacctgagatgtgctattgtccttctcttcatccaggtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcaggtaagccaggcatgaccaggtagagccattgaccattagagccagaagatcatctaattgaggccctcgtctcacagattaggaaactagaaactagcaccagtaaaactgtagttttctggaaatgggatatcaaagtaagtactgtcttatgggctgcctgtctgccctgtggcattacaaagtcagaagtaatctttcaattctaaggtagatgtcaaatgaaaaagtttcagaggcataaattatcatgaaaatttatgtctcaaggagatcttatttgttcaggaagtacccatacttttaatgtaaagacataacaaaaaagaaagcaaatcattgcattatacattattgagtgaaaaaaaaagtttcaggtcattatgcaaactacaatcccatttttcttacacacacacacacacacacacacatacacacacacacacacaatttgtaaatgtataaggaaatgtggttgccctggggagaagtgagaatatagtagaaaaatattatttgtgtaatttaaaaattaaaaatattgcacttataaaaaatttagcaataaaaggaatgcatcaaaggactaaatttttcttaacataaatataggttggattttagcaatgttaaaaataatttctaagacctattaatatatgtagatgaagcaaaaaagatggtttacattataattagattttagataagcagccccaattccatggcaatctcttttttaaaatgtccaaatgcaggacaaaatcagttatcttaagtggcccaagtttcatgtcctgtgatatgataaattctcaaccacaaaaacagctcatgaaaccagaaatgaaagctttctgctgtttatttggctatggtagatttaagtaaagaactttgctagccctcatcagccttaggtgatcttggcacagctgtcattcttgagggaaaactaggatacttctaaatatgcagtttgaaaaccacagctgcaacttattgtgtcaaagtgtaacataaaaatgtccatagcttaattactacaggttgacattatcaaatacaaaattccagcttcaaacaaccagttagaaagcaactatccaggaaagtactgatcattcagatatctgaaataaatgaaacaaggaattacgtgggttccttcaggactcaaaccccctcattttgcttccccttggtgcatttgtgttgagaaaattgattttaagaaatatcttcttccctcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctaggtaacattagtcatgttaaaaatatgagtcatgaaatgcttcttcctggagatggctaacagggaatatcaggcccagagttaaaacttaagaatgccaaactcagccctagaagatgacctcttcccacaagaaccacctttctccctcctgcactccaaaccatacatgcagtccccatccctgtatactctccctgaccaggcttctccacagctgccaaacttctggatgaagaccacctgggctcctttagaatgtctatgctgctccgtggcctgatccatgtcagtttttggccaccttgctcctcaaggtcttgctctgctccttcttggcatgaaccattgtcctactaaaggaagtcccactttctccccatgacttgcaacaccagcagacaacgttatccttcagaaatttttatttctggctttttattattctccttgaccattactccctcactcattcagtttttattgtatgcctcccataaggcagtccctatgccagatgatgggacataacagttctaaaaataaataaaatcctagcagactacacacaatcatcatctaattcattccaagaatattctatggagcaatcgctgggtgtgaggaagacaccagaataagtgcccggaattaggataggaaagggtataaagctgcatgttccctcctctcaaggcacttaggtactttgcacatcccctgaataaagaaattacactgcagccaagtttactttttaaaccaccaccatatccagcagaacacccagaggtagtatttcctctctgcttagctcatgattttactttcctgcctcacccatctttacccctacactaaaacacctacacttacaattctcagcctttcatggaatttcagtgataagaactcttaacagtttggacagctgggaatacagagcaaactgcacaatttatatactactccatgagcactaactaataacaggaaaaaattttaaatgatttataggatacattaaatgaacattatttagatgccctggtttgcaatgagtctcttggagtaaacacaactattcttaataagaattttattggatcacctcagtaacagctcctaaatactttctctgctctttctcctctgaaatgctgtacaacactggcaccagttaggtttctgtttaataattattttaaaatacaggtccgatcaagacagctgtcttgctcagtgactgtaaaataaagcctaacttccatacttcaccactagagcccttcccagtgtggctcccactcaccatgcctccttctcccctggcagggacagtccagccacagtggccttcacagtgctctccaagcattccagcctctgtacctgtgttgagtctacttcctctgcccagattgccctgtcctcctcacttgtgaaatactcagtagtgctgctgctacttggaattaatttctcctcccctgagctcccataacacatattttgtgtgctgttgccagcctcacaccccacaacaggattgatgcattagttatcttggttccccacagagctttccacagtgagtttgacatggaaaagccactttctacttatctgttaaaaaatgcatcaaactttcaaaaacagataaaaatatatataattacaaaatcacaccatagttacaaatatgatcttgctgttcttgggagtttatagtgtttctctccacagatgaatctttcaatattggattgaagtttgaaattgcatttgaagtccgtcccagaagcagttccggaaccctggtccacggccacagtgtcaatggggagtacctaaatgttcacatgaaaaatggacaggtagtgtctgaaaaatgtttaacaatttgtctcatctgaccttggattctagatctgaagcagatttatttcacagaattatttcatcaatctttcctaactgaaaagaaatataggaaagctataacatgaaatgtaaatgtgggcaatatttggattcagcttcctatgttgaaagttgatttggttaaaacaaagagtcataaaaatatggcaaaactatcaaaaaaatcactaataacaacacagttttaagagaagaatgagaagaactttttttcaccaaatggaatcagcaaacataactatcaaaatcaacaaacactaaaacatctttctaaatatctataatatgtatgtatatcagatatatgtatgtgtactagatatgtatatatactatacatattattctcaattgatagaaataaaaaattatgttgtaatgccactttcatcctaagatactactaaagaatattcatggaagtattcaaataaatattaagaaaaaagtatattttcattgatgctgctaacttaacataacagatttttatttgggttctagtacattctattaaattatattgagccatcacaataaaatgtatccctacttggtgtttactatttgttgggtactattctaagctttacctagattaactcatttaatcctcccaattatctccatgatgtaggtaacagtatcgcttataatttacaaacgagaaaactggggcagagagtaagttaaataggagactggctgtctagcttcaaagtccatgttcttcaccaatacttcaacctgctttgtataacacactcaatctttagaaattaaagggatttattctatttcttattgtccctctctcgcaattttctcccctatgaagtcactttgttctctccccaaagagcacccccagttgaacctatttctataggctgccaaagacccttgtgttcaaattgcaaagctaatcatgtgtgaatatttgttgaagtattgcttcactgtggtaaattatttaagaaattcagttttatcacaatgaggacaaactaaatcatacaatgtgtcctatcttttgcaggtcatagtgaaagtcaataatggcatcagagatttttccacctcagttacacccaagcagagtctctgtgatggcagatggcacagaattacaggtgagaaaactgactgccctggggagcctgcacacccaactgtaagattatgatctggcagaacttaggctatcacttatatgataggtaatgcatgacagtctaaaagtatccaagaaaagaaaatcatgttattatactattatgtgtatactgaatccacatgtgatttcaaaatatgaacgctgcaaaattgtgttaaggggttgcttcaataatgcataacttatagggcaaaaaaaagtagcacaagaatattctaaatattctccctttctaaggaaaatgttacagtaatctcttggttagacattgttagacatcattgatgattttaataatatagaagaaagtgtgggttttattctggaataaataaaagcaattgctgtgataaatagtctttctcaggttaaaaattcatcactccagtgccacttatgaccagtctttgccctgcatttcagttattagagattctaatgtggttcagttggatgtggactctgaagtgaaccatgtggttggacccctgaatccaaaaccaattgatcacagggagcctgtgtttgttggaggtgttccaggtaagtgttgtttaaaaaggaaaagttcccaatccaaaaaactgagttctcacaattgttattgtagaattgagccatgtgtttttatgatgcacctagttactcaaaggattttatatacagtgttgtttaaatggaaaaggcataataaagtgacatgtaagaactagaccccagcattccagccagtggctattactctcccttgccatatttgcttatttttttctttcctttcccttttaagtgcccgccacacacatacacacagtgacacacatactcttattttatctctaacacaaagaaaactcattgactaacactacagtaggatctgagaactttggaggattaagtttgctgttagttgctccccttcctcagtaggaaaaaatgcacagttcggtccatgattagtctgaactgcaaaaacagctgcagaccataagttgttgtccattggtagtgacattccctcagagaggttcccagctgcaattctgtaaacatcatcagtcactgctgctgtcatctgccaagaatggtgtataatcccggatggtgacaggacacttatggacaacacacaaacaccccaattgttttaaacctgtgaagcaaggaccatgtcctcatattgaatgcatttgtttttacacatttcactaacttggaaaacctgaatgctatggctggggagtgggatttaaaagggaaataacccagcttttgcagctggaacttggtggggagtttttaattgacatatcatagttgtacatattttgggggtacatgtgatattttgatacctgtatacaatgtgtaatgatcaaatcaggataattgcaatatccaccacctaaaacatttatcttttctttgtgttggtaacattacaattcttctcttctagctattttgaaatgcacaataaattatccttaactataatttccctattgtactatgaaattctagaaattattccttctatctaactgtatttttgtatccattaaccaagttattttcatctccttcttcccccttcccttcccagcctctagtaactaccaactactctctacctctctccatgagatttacttcttaagctcatgtatgtgagtgaggacacatgatatttgtctttctgtgcttggcttggtggagattttaataatcttctaatagattatttttaaactgacccataaagacagacaatgctttaaagaagagagcaagaagcacagataaaattaagcatctgaccttgggtactccaaaaatagtaacaactaagcactcttctttgtctgaatttttcaaatactagtattgacaataatagtaacccggtgtgaaaaaaaatatttgagaccctcgcaaagcaactcttctcctttgtctcctgcttccactcccctctccattccccagtcctctccctgttcctgacttcagctttgaaaggattctggcaaaggccagcactgcacttcatgcaggtgcagcatgaaaaagtctcacatgagtgcatatttctgcacattgcttccctccagaaatcacaacacagtttaaaatgtttcacaggttcccaagagcctccaggattaaattcaccatagcatgcaagctccctgatcatctgtctcctccttgtccctgccttcgggatctccccacaccttctgggacttgcagttcctaaatgttcaacgatggtatctttgctccgggcctttccataagggaactgggcctcaatttctgggaaatgttcttcctttcctcccctagtacctttgttaagaaacaacttctcctattcctccccattctaactcctattgacctttaggactcagctcagacttttacttacaacacgcccctttccccctaggatgtatacacatactgctgttgtagcacttagcacagaatattgttgaaactaagaagtgcattccttgatggcagggaacatgactatatccaacacacagcatggattgtctattaagcattgtgctaggctttgggaggtggacaaaacaagcatggccctccctcatggaagttggagtatttgtccttcactatgccacccaacgtacttactacatctttcaaacagatatttctctttggtttttgtttgtttgtttgctttcacagtctgatcccagcctcacacactgccatcatccctcactacaagagttgctaagccctacagactggacaggcaagatgtacctaaagccaaattcagcctgcctgaaacacagaatgaatagcaaactttagttaatgagccagcacaggagctagcaggccagaagggcgtaaccaccagcccactgcaccactgcagcttttaagtccatctaagaattatgccagcaagcctagaataaaagcaactatactttaagatgaaatgtaattaattatatcattttgagctgttcaagattaattccactaaaatcacatcagaaaccaggcattaagaggatagctaaagaaattaggctaaataaaacccctaaatgcactgaattctccaagaataccactcagaactctggtgactcattatttctatccataaaaagctaacgcataaaattcctagaactacacaccaaaaaagtcaactttagtgtgtgatagttttaaaatcaaaattaaaaatcaaagaattttttttctgccggacatggtggctcgcgcctgtaatcctagcactttgggaggccaaggtgggtggatcacttgagctcaggaggtggaaaccagcctggccaacatggcaaaaccccatctctattaaagatacaaaaaatagctgagtgtggtggtgagtgcctgtaatccctccagctactcaggaggctgaggcagcggaatcgcttgaacccaggaactggagactatagtgagcacagatcacaccgctgcactctagcctgggccacaaagtgagactctgtctcaaaataataataataataaaataaaaaggttttgttaatgtagcccacccatgggtctaaccattcattcctctactgaaaatcctgcattatttgtatatagtcaagcattcaacctgggaaacattctctctaaaaattatgcattaatttcattaatcaattacttaggatcctagggcactgtactgtcactacctacaattaattgtatggtgaattattcagaccactaactgctacatgaattattacctccagatgatttccctcataagccaaaggatggtaagcttgggcagaatcaaaacctaagttctaagtcaggtctccaaagtaagcagaagtattagatgtttctacctcttataagcattcctgttcactcatttcttacccaaatgatgaagtacactgagcaggcttgaagaatagtcacactaatctagagacaataaagggaattgatctctcaggccccttccaaatctaaaacttttatgattatcattctaaatataaaatgctatttccatgatttattttcagtacacagcttctgcatattcttaccctacattgcttagaaaacttattacagctgcttgctgatgtttcatttgctgttctatgttctttcctgaattactgatttctaagtgttttccatcctttatctgctactgctcacatagctgtttgtaaataataataagctttggctaaatggattttaattttatatttctaagctctctaaatcgctttaaattatattgcttctatcatcctaacacatttaattgtgtctgtacaattaataagcataaggcttcttctagatttctaattaagaggagaaagttcccttggcataccacagggcacttgtgcccacacaaagactaagcgagttatcattaccctatttatagttcttaaaccctgagctcagaaaaattgaatcttagtttattcgaattcattactttctcattatattttatgaacaggcaaaaatgtagaggcttaagggtgaagggtaatgaattaaacagaaatattaaccaagtccaaaaatagtgtggaagctaaaatttctttcctccttcttagcaaagtacacattataagtgaggcccaggtgaaattaactttaaaaaacataggtagatcatgaaaattcactgctgaggctttacatgtaagtggtaaatttcagccttgaaagacagctacaatacacagaaatgtgatcatggaaaacatggcaaaacgttaaaattaccacatgtccataggacttcacaagcaaataatgttactgagaaatgagtcaattataactatgttctatttttgaaatgtaaatcatattgatgatatgagcaaatatgtatacttttaccaggaagtaatatttgggcttggaatacctcaattgcaatctttgtttttatttcttgctcttttcagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactag

SEQ ID NO: 36114 - DNA, 19469 bp, Homo sapiens
gcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgaggtgagccggacctgccccccgacccgtccccgcccgggcgggctccgcgccccgcctttgtccccctcccccccagctagctccgggctggaatttggggacagatccttgggagcctcggatttgagctgaatccccttggacgcgccccagaaccgtcgatcacttctccacgactgactccccaagctcggggggtggtggcggtgaggttctcctgggagccctcaagatttgggggcgctcggaggactcccgaattgttaagactttttttagaggacctcaaagttggcagcgactccccgcagggatgccaggattgaggcagggctcagactctcctccccctccccccagacttcagctcgaggtccgggaaggattgtgggggaccgatttgggataccctgggacttggaagagagactgagactcagaccctgggtgtgcaggtcccccgtttacttggtgctggaaaaagtctccccaagtgggaccgcgctccataacttcgggggtacttcttaatcccctggattttgggggtcacttaggtcttcctgtggaggaggctggtgtgaaccgatccagggacctggacgcagcctccagagtctggtgggaccccccccttccccgtcgctccgcacacaatctgcttaactggccgtgcctaggaccgagcgggcgctcggagcagagggcggctccccgcctccggccataagggcggcccggctcccccacctgcgcggccctggagagggagggggcgcggcagctgggggaagggggcctttgtcttcctgactcacctgtcgagacagctggtgtggggggcgggcaccaagcgctgtaggccggctgccttccccaccacggcccctccccctttgctcaccgtccccctatccacccggagccttggggttggaggagggggagctggaaagcttcaaggtcatagccctcttccctagggacccaggcttcccagataattccagctatcttcccaggaatttaatcctgggggtggcggcccaagggacccagggatttggtctggccggggcctcccccgaactcctgggctcacctgagggcggggccagtgtgggcaggggggcccaaccatcccccctattcttccctcccctggccccccataatctctcccatggggccagagcctgacaatactatctcccttcctctactctctctgggacttcctgccccaaagcccccagcctgagcagggaggcccctggggacggttggggattaaccccgtggtgcccacatcccccgcatttcctgaacccctgccctttgacatcggagtggcgtggcattcctttttatgaccactagagaatccccctcccgcgtttgttccttctgatgtgaaaggcatggctggaaaatttggagcaaggaggacacccacagataccctcaagacttcctgcctatccgctccccattatagcaacatcccttccaagtccgccctggagaggggtcagtttagggagcgtcgctctcttccttcgccctcttcctccgggactcttctctccccttgccccccagccccgcccctccaccccccctcgcgtttccggtcccaggctcggtggaaggcggatggcggatgtccgagttagtgctgcctcactcactgcaaccgtaaaagggcaggagcggtgtctgggccggccccctgtcctccccaccaccaccaccaccaccagcaccagccctggaagccctggccctcccacaaggcccacctcttgctgtggtggtggccaagcatcccgtcttgtgggggtgctggggtggggtgcggtgcagaaatgaccagatgcctgtcccaccaaaaggccactcccacctttccagggggtctcccctgcaggtggtcacacccgacttcctgggctgtgcctcttctccaaggacagccagaattcaaaacccatgcccctattacccagctggggaaactgaggctcaaagagaaaaagacatggccaagatccctcagaaattcctaggcaacgttggaggggtggaggagcctaggatcctctgatttctggctggtttggctggggacagtcctgggggcagttggaagagaggatgttaagatggaaaattacaagatatagttctttttctcccagtttgacaaatatttgttgagtgttggctgtgtccgggactggagctggggtgctgggaagacagagaagcgaggcagaggtctagaatctcagggcagaagggacttggggagaactggggtccatttctttcttcttccaataatagctatttttatttttaaaaaataagagaccatttgatcaagcatctattttatgtggggcatttttgtgcctgacagcaattctggctggtttttttgttggtttgtttgtttgttttgagacggaaattttgctcttgttgcccaggctgttgtgaaatggcatgatctcggctcactgcaacctccgtctcctgggttcaagcgattctcctcctcaaccttccgagtagctgggactacaggtgcctgccaccatgcccggctaatttttatatttttagtagagatagggtttcaccgtgatggccaggctggtctcgaactcttaacctcaggtgatccacccgcctcgacctcctaaagtgttattattacagacgtcagccaccacacctggcccctcatggcagttcgaacaatgatactattacaaccttgtggcctccccaccccggtactcagtttatagatggggaaactgaggcacaggaaagttaggcaaggtgcctattaaactcaaacagggccaggcgccggggctcatgcctgtaatcctaacactttgggaggccaaggcagaaggatcgcttgagcccaggagtttgagaacagcctgggcaatatggtgtaaccccgtctctacaaaatatacaaaaattagctgggtgtggtggcatgcgcctgtagttccagctactctggaggctgaggcgagaggatcgtttgagctggggaggttgaggccgcaatgagtcatattcttgccactgcactccagcctgggtgacaaagtgagaccctgtctcaaaaaaaaaaaaaaaatagagataacatgctttccgtgttcttaatgaagaaaaagaaaaaaaaaaaggaacgtgctttcactgtgaaaactcttaagataattcagataagccaaatgaaaccgaagctgcaacatttatcttcctattcacttatgggaaactgaggcccaccaggaggaagggactagagtagccccatccccgacaaaagaagatttgtcgtttggaagggtggtgtatatgtatcataggttttatggtataaggagggtatgggctaagtcttgggttcaggggacagtgaagggaagggtaagactgcaagttttgtgaaaaccggattcaccatgcttgattacctctggtgatgggaagctctctccttcatgtggagcgtgtaccaagttacagttcctgcgtttagggctttttgtccattatctcttttaatccttacaatgaacccagtgagttattgtttccagggctggaaactgagtttcagagaggcaaagccacacaacaaggaggcaacttgaaccgtcttttcatccgccatgtgctagagttttccaaaatgtggggacttgcagggaggagtgggtcctgggctggctggaaaattaaagtgttctcatgtccaatggagggttctagacttcgggaaaacacactggaaatgggcagaactcctttccatctcacagcccccgcacccccgttttatggctatgggattttcgttctggcttttgtgtagtttacagttttatttattgaacttaagtagtgagttaggtttttataggtaatttcaacccatgataagaaaacaaataataagcagtttgaaatacttactgaaattattgaaatggtggctgggcctggtggcttatgcctgtaatcccagcactttgggaggtcgaggcaggcagatcacctgaggtcaggagtttgaggccagcctggccaatgtggcaaacgcccaaaccccatctctactgaaaatagaaacattagcctggcgtggtggcacacgtttgtaatcccggacactcagaaggctgaggcaggagaatcgcttgaactcgggaagtggaggctgggaggctgaggcaggagaattgcttgaacctgggaggtggaggctgcagtaagctgagattacaccactgccagcctgggtgcagagtgagagactctgtctcaaaagataaatggtacaaaatatttgtttcttccctccccagttcctgagttcccctcaatggaggcagccacagttagtgtcttgggaaacagtctctgcatatatcaccactctgagtgcagatatatttatatatgctcctcactgtttttttttttgagatggagtcttgctctgtcgcccaggctggagtgcagtggcgcgatctcagctcactgcaacctccacctcccaggttcaagcaattctcctgcctcacctcctgagtagctggaattacaggcacgcgccaccacgcccagcaaatttttctatttttagtagagacagggtttcaccatgttggtcaggctggtctcaaactcctgacatcaagaggtccgcctgcttcggcctcccaaagtgctgggattacaggcttgagccactgcgcctagcctaccttttttgtttgtttgtttttgtttttgagacggagtcttgctctgtcccccaggctggggtgcagtggcgtgatcttggctcactgcaacctccgcctcctgggttcacgtgattctcctgcctcagcctcccaagtagctgggattacaggcgcccgccaccacgcctggctaattttttgtatttttagtagagacggggtttcgctatgttgcccagactggtctcaaactcctgaccttgtgatccgcctgccttggcctcccaaagtgctgggattacaggcatgagccaccgcacccgaccttttttttggttttgtaaagcctctgatcaacactaccttgtactttggcttttaaaaatttcaatttagctctgcttcttcatctttaaatgaagttaagaacttgtgggaacttcgtttcaactatgagcccctctgcttacttgctgtgtgatctggggcaagtgccttcactcctctgtgcctgcaattcccccttgtcaaaagggtgagcgtcagagcctatcccatgaggttgtagagtcatgcagcagggaaattggtgtcaagcaccaagaagagtgtctgggacccaggctgactgagaaatgttaggtgtcctaggtaaaagtttgcctttttttgtgagggagtcttgctctgtgagggagtcttgctctgttgcccaggctggagtgcaagtgacctgaacaaggctcactgcagcctcatcctcttggactcaagtgatcctcctgcctcaccctcctgagtagctgggactacaggcaagcgccaccacacccagctaattttaaagttttttgtacagacggaggtcaccatcttgcccaagctagtctctctcctttttttttttttttttttttgagacagagtctcgctctgtctcccagactggagtgcagtggtctgagatcggctcactgcaactgcctcctgggttcagtgattcccctgcctcagcctcctgggtagctgggattacaggcatgagccaccatgcctggctaatttttgtatttttagtaggcatagggtttcaccatgttggccaggctggtgtcgaactcttgacctcaagagatccacctgctttggcctcccaaagttctgggattacaggcataagccaccacacccagccttcccaagccaatctcaaactcttgggctcaagtgatcctcctgcctcagcctcccaaagtgctgggattacaggcgtgagccacctcccctggccaaagtttgcctttttttacagatgtttcgtaactattgagtccctactatgtgttggacgccattctaggttctggggacacagcagtgaacaactgggacacaaatttctgcctttttggcagcggagacagacaaatattgtgttgggcaggggtcactgctatgaaatgtgcagcaggggatgaaaaggagagaagcgtttccagctaagggagtgagggacggcttcttggaaggggtgacatctaaggagagacctgaaagtggggagaggctaggcctgaggaagaagcagcacacaggcccgaggcaggaatgtgtctggcctgcgggaagagcagcatgggggtaggaggtctagggtctggaacagagtccccaagggacagtggagcgggaagaaatgagatctgaggacacacagatcacggaggccctggagagaacttggcattgattccgtaggagcctggagccttcaagaagaagaagagacatcccaccttgtaggtttttgttagtttgttttgttttttagagatggggggtctcactgtgttgcccaggctggtcttgaacttctggactaaagcaatcctcccgcctcggcctctcaaagtgctgggattacaggcatgagccaccgttccccgccccacctcgtgttttaacaggatccttctgttacaatgggtatagtgttccctggagaggggcaagaccaccccttggtcacccagcaggcgccctgttctccggccagtccagagcctcagtagggcagggctgcctgggagagcaaagtgcagccagggcggggcagcagcagccccgggctcctggccagagtcggccctgggtgtgggtggcaggtgtgggtgaggccgaggccttaaccctgccttgccaggggcagcaggagccagaaacagcccccgaggctgtgtttgtctggaaagggcacctggtgtttgggtggggcccacacagttcccggtggttaaggcttggaagcctgaattcacatcttcactctattcctcagtagctgtgtgactgtgggcaagtcactcaacctctctgggcctctagtcctcacctgcaaaattagaatgagtggctctctggataagctgcagtgagaataaaatgagtgactttgggggaggggcttaaggcccctgatccacctgaaatgcctagtaagagggagatggcacaattaggtaaatttgagggtccctaccccaggtccctacccacagctgagtctgcctagggactttccctgccctgacttcccagcatcagtgtcacacccagcccccagccctcctagagacagaggctttgcggggggtgtctaatttctgtccccggaaacctctgaccaccaacttccccatttcaggaaaaagcctggtgtgggtggggtggggaggagaccagtgcttccccttcccctgtgtgaccttgggcaagtcacttcctgtttgagttcctgtctaggcctgagtttcctcactgggggagaggggattgaacctcccagaggggctggtgggagggtcccgagggttgtagctgtcccgggccccagtggtgcccatgagagggatgttgacagttactgagctctcggcgtgtgctggacgctgtaccaagcacttagctttttttcttttttttgaaacagagtttcactctgtcgcccaggctggagtgcaatggcgtgatctcagctcactgcggcctccacctcctgggttcaagcgattctcctgcgtcagcctcctgagtagctcagactacaggtgcacaccaccacgcccagctaatctttgtacgtttttgtagagacgggatttcaccatgttgcccaggctggtctcgaacacctgagctcaagcgatccattcacctcagcttcccaacatgctgtaattacaggcgtgagccaccacacccggctgtaccaagccctttaggtgcccagattcatgtgcccctcccccactgccctggaggtggggactgtcattttcccagttcacaggcaagaagaggtcttgagtgggaaggtcatgtgcctgagtcacatgaagtaggtggctcagtggggatttgaacccaggtctggggatatcagctcctgaactctgcaccagtttactgacacctcccacccaggctaagtcagacgttgccttttccaggaagtcctgcctgactctccaggctggggcaggcgttccttcagggtacccccagaccctgggctccttggtcctaaacctgggttggtaccgtctggggacagctgtgtctcccacactggactgtgagccccaggagggtggtgccggagctgtctgggtcactgctgtgtcttcatccccagccccacccaatataggccagacacagagcagggagtatctggggaatggccgctagtgccctggggagccaggcgaggggtgggcagcgggaagtccctttggaggaagagctcagaggtctgggatgggtccccaacctgctgcaggcctcacacttcccctcccaagcctcagcttcttcctgagcaggcagtggtggaggggggtgcgtagagatagggaaactgaggtcaggcaggggctggtccctagtgcagctctgggctcttggcctccttctggcccctctgtcttccctcctgccctctgctctgctaacccgcatccccccactggcattggcctcggcctcttacacccctcagcctgtctctccatctttatcttttccttcttattagttttgttgtgttgtgttttttatttttcattaaaaaagtttttttgtggactgggtgtggtggctcacccctgtaatcccagcactttgtggggctgaggcaaatggatcacttgagcccaggagttcgagaccagtctggccaacatggtgaaacctcgtctctactaaaaatacaaaaaattagctgggcttggtggtgcatgcctgtgattccagctactcaggaggctgaggcggagaatggcttgaacctgggaggcagaggttgcggtgagccgaggacagcccgggtgacagagtaagactctgtctcaaaaaaaaaaaaaaaaaaaaaaagattagtcgggtgtggtggtgcatgcttgtagtcccagctacttgggaggctgaagtgggaggatcgcttgagctcaggaggtcgaggccacattccaacctgggtgacagagagcaagactctgtctcaaaaacaaaaataaaaataataataataattattattattagagatggggtctcactatgttgcccaggctgctctgaaatgcttgggctcaagtgatcctcctgcctcaacctccaaagtgctgggattacaggtgtgagacaccacgccaagaccatctttatctctttctgtgtctgcctcttcctccaggtcccctgtctgcccatcctttttccccacccctcccccatctgttcatctgtctgtctgccttcagtctgtctctcctctttgtcaacccgactctccctttcccacctctctctgcgtctgtctcttgcatctcgtttgtgtgtttgcctgtctctcctgatctgattttctctcctgatctgtctcccccgtctccttctgtccacgtggctcctgcctccctctgtgtcactctcttccttccacacactgtctttgtcccttggaatctcccaggagagacccagataagaaggtgaccggcccctctcccttttcctcccgcctgcagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtgcagcttcccgccggccccctctgtgggctgaacccctacccgccccacccctgcgcccgccgcccctcacccccctttcccctcccaccaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggtcagaaatggcggcgggcaaaggggaccagtgaatgcggctgtgtggcctggggctgccgctttaccctgctgggacttggtttactcgtcggtaaaatagagcgaattcattgttatcatggaaaattatcactagcattttgtgcattccagtgtgaccgtgtgcacctatgtgtaaaatgcaccattggcccggcgccgtggctcatgcctgtaatctcagcactttgggaggccgaggcacacggattacctgaggtcaggagtttcaccgtgcccaacatggtgaaattgcgtctctattaaaattcaaaaattagctgggcgtggtggtgcgcgcctgtaatcccagctattcgggatgctgagggacgagaagtgtttgaacccaggagatagaggttgcagtgagccgagatcaggccactgcacttcagcctggcgacagagcaagattccgtctcagaaagaaaacaaacacaaaaaaaatgcacgattactcagggatcagtactccatgaactttacacaggcacactcccgggaaaccacctcccagatcaagacataggtaggtcctgccccagaaacaggatctcgctctgttgcccaggctggtgtgcactggcacaatcatggctctctgcagccttcacctcctgggctcaagtgatcctcttgcctcagcctcctaagtagctgggaatacaggtgtgcaccaccatacttggctctttttttgttttgttttttgagacagagtcttgctctgtcacccaggctggagtgcagtggtgcaacctcagctcactgcaacctccacctcccgggttcgcgtgattctcgtgcctcagcctcctgagtagctgggattacaggcatgtgccaccatgcccaagctatttttttgtattttgtttttatttttatttttttgagacagagtctcactctgttgcccaggctggagtgcagtggcacgatattgcctcactgcaacctccgcctcccgggttcaagcgattctcctgccctagcctcccgagtagctgggactataggcgtgagccaccacacccgggtaattttttgtatctttagtagagacaaggtttcaccgtgttagccaggatggtctctatctcctgaccttgtgatccgcccgcctaggcctcccagagtgctgggattacaggcatgagacaccatgcccggcccttgtattttagtagagaaggggtttcaccatattggccaggctggtttcaaactcctggcctcaagtgatccacctgcctctgcctcccaaagtgctgggattataagtgtgagccaccatgtctggccacctggatcatttcaaattttttttttttttttactttttgtggagatggtctacaggctggtcttgaactcctgggctcaagtgatcctcccacttcagcctcctaaagtgctgggattacaggcatgagccactacacccagcccagttgctttttttttttttttttggagacggagtctcgctctgtccccaggttggagtgcagtggcgcgatctccgctcgctgcaagctctgcctcccgggtaaatgccattctcctgcctcagcctcccgagtagctgggactacaggcacccgccaccacatccagctaattttttgtatttttagtagagacgggatttcaccgtgttagccaggatggtctcgatctcctgacctcgtgatccgcccgcctcggcctccgaaagtgctgggattacaggcgtgagccactgcgcccggccttttttttttttttttttttttttttttaatatggagtctcactctgtctctcaggctggagtgcagtggtgtgatctcagttcactgcaacctccgcctcctgagtttaagcaattctgcctcagcctcctgagtagatggaactataggtgtgcaccaacatgcctgtctaatttttgtagttttagtagagacggggtttcgcagtgttggccaggctggtctcgaactcctgacctcaggtgatccactcgcctcggcctcccagagtgctgagattacaggcgcgagtcacgcgcccagcccagttgctatttcttaaaccttaacgtgcacatgaatcacctggggatctggttaaagtgcaggctctggtgcaggtgggctgggcggactgagactccacattctcacaagtgccctggtgatacccaggctgctggtctgcggacgtgactgagtagtgaggttttaggtgactgccgtgcatctggcctggaatcactgctgtagaactgaaagtcaccaaatgcaggggtgtttgcttcgtgggacaacttctgtgctagtgcggaaggggcttgctcctctggggcacacagaaaaatacagtgggcttcagttgagtcatctgtaaattggggctaattcattgttaattcgtagccaattcaattcaggtgctagggccagaggcctggaggtaggtgaggaagaagctctttacctttccaggttcttaggtaaggtccaagtggctgtaacagtggttaagagctagccaggggccaggtgcggtggctcacgcctgtaatctcagcactttgggaggctgaggcaagtggatcacttgaggtcaggagttcgagaccagcctagccaacatggtgaaatcccatctctattaaaaatacaaaaattagccaggcatggtggcaggcgcctgtaatcccagctactcaggaggctgaggcaggagaatctcttgaacccgggaggtggaggctgtggtgagccgtgattgcactgctgcactccagcctgggtgacagagtgagactctgtctcgaaacaaaccaacagtggttaagagcctggctgctggaatcagcctgaattcaagtcttgttcctgcacattccaccctggagaaatctggggcaagtgactgttccccgggccttagcttctcctgtcactgggacatcacaacagcacctaccttagggcaactcaggccagggaagttggtgctgcctcacctcccaatgtgcgtcctcctgggcctggagcctcagggcctctggaaggaggaagtgagcgcctctgggcaggattcctgggaggcctgggagagcaagggaagcgccaagagctgagcagagttctgggactgatccatggccctttctctctcacctttcaggaggtgggccccctccacccccagcacttcccacctggtcggtcccgaacggcccctccccggaggaggtggagcagcagaaaaggtggggctgggccctgggtggggaaccttagccgctgccagagttccatatgttctggaacccttgactcctagagttcagaacccagccaacttgcagttttcagaatgttcaagaaacttctgacactcagagttgcagaacctcctggtccctgcagattcctggaaatcagaatatggtggttgaaagaatcttgtggctgggcgtggtggctcacgcctgtaatcccagcactctgggaggccgaggcgggcagatcgcctgaggtcaggagtttgagaccagcctggccaacatggcgaaatcccgtctctactgaagataacaaaaattagccggtcatggtggcgcccgtgcctgtaatcccagctcggcaggccgaggcaggagaatcgcttgaacccgggaggcagaggttgcagtgagccaagatcgagccactgcactccagcctgggtgacagagtctcaaaaaaaaaaaaagaaaagaaagaatcttgggcattttgtaattcggtgttcctgacagtttagtgactgggatctcgcatcctgatctctccctgtcgctgccctgccctccattccccctactctcacccagcccccttcttggttccctaggggaggaaggcttgggtgagtattaggagccagccaccctggagacctctgagagagaggacggaggtcgctggccccttcgctggccatccttagggccctgattgacggcagctctctcgcctccccccacaggcagcagcccggcccgtcggagcacatagagcgccgggtctccaatgcaggtgatgctcagatagcttcgggagttgggagggggcctccctggaggaagtggccagccagctggacagtgaagaatgaggcttctctctctcagctgcccccttttctgtgtttgtttcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaaggtgaggggccgggagaggtgggcagggggcaacagggcttttatgggggatgaggccagggctgccggcggtgtcattgggctggaaggccaaaaggcctgcccctaaagctcctgccccttttaaatttctccagcaggaggaggcctcaggggggcccacagcccccaaagctgagagtggtcgaagcggaggtgggggactcatggaagagatgaacgccatgctggcccggaggtgagcctgagcctggacccccaagtcacctggagttccagttcagtagggcccagtcagaggagggctccaattcctgtttagtttgtttcttttggtgaatgttccccctttgataaccaggtttgggatataatggtggggtttgtcatgaaatgcctgaggcttgcaaccacctaggtagcctgtagatgttctaaaacccagaattctagaaccgtaggagatcctgcctcagaattctgggaactcaggttcctgcaatctcagtgttccaacacagcaccgctccaccctcggaatcttactgttccctaatataagaatcatagaacctcctccaccctgattctagaaccacaatctcttgaattttttttttttttttttttttttttttttgagatggagtcttgctctgtcacccaggctggagtgcagtggtatgatctcggtccactgcaacctccgcctcctgggttcaggcagttcttctgcctcagcctcctaagtagccgggattacaggcatgagtcaccacacccggctaatttttgtatttttagtagacacaggatttcaccatgttggccaggctggtcttgaactcttgacctcaagagatccacctgcttcagcctctcaaagtgttggcattacaggccactgcgcccagcacaatctcttgaatttctaaaactagagtttccttaggttttcggagttccagaattctatgcgctaggatctacatttctagaactcccctcagaaggggatgggttgggtgacggaagcacgtgtttttgcttttctctcctgcagaaggaaagccacgcaagttggggagaaaacccccaaggatgaatctgccaatgtaagtcagggactcttcttgccctacatctcttaggccgtaccatgagggtagggatagtgggatgtgtggggtttgaacctgaaagaggaaatgggcagaggtgtggcaggggctggctcatggcagttttatttcctaccagcaggaggagccagaggccagagtcccggcccagagtggtgagtagagtgcccagtccagccacaggaactacaaatcccagaatactctgttctcacatgttaagcacccttataggagagtcagggcgaatggtgctggggattgtagtctcctgagatggggctttgatcaggggctgatgaggttgggggagtaagattgattggggggcagtcttttgtccctgatctttctgatttcttgcctatccccagaatctgtgcggagaccctgggagaagaacagcacaaccttgccaaggtaggccatcggtcctggggcccttggggaggtaaaggcgggcagatcgcttgagcccaggaggtcaagaccagcctgggcaacatggcgacaccccatctctacaaaaattagccaggcgtggtagcacttacctgtggtcccagctactcaggaggctgaggtgggaggattacttgagcccaggaagttgaggcctcagcgagccatcatcatgcctgcactccagcctgagaaatagaatgtgactgtctcaaaacaaaacacaacaaaccaaaaccaaaaaaaaaaaaaactggggccccaaaaatacttggacttgcccaatttataaggcagagctcaatgtgacccctggaataggaggcggggaagcaggtcctctctctaatctcattgctgtcccaaaccacaccaactcccccaggatgaagtcgtcttcttcggtgaccacttccgagacccaaccctgcacgcccagctccagtgattactcggacctacagagggtgaaacaggtaacttgggggggaagttggggaccacagcaagagagatctaggtctggcccctgccactggcatgccgtatgatcctagataacatctcagaaacctcaggtttccaatctgacaaatggagaaactggattgggtcaaggatgaccgagactccacacccccttttctggcacctgtgacagacattattaatctatcaccgcgctcattccagatgagtgccttgaattctttccgcacattgacccagctgtccatcaccaattggagttggcaggaggctggaatgcgcttgccaaccttggtactggatgttctccagtacttttccggctccaaggatccagaattctcccctagaatcctccagtcactctgcgaccttgacagcgatgtcatggtgtcgatgtaggggtaggtctcaaacctactacccctggcttttccatcaacaagaaagaggggactctggcagggcacggtggctcatgtgtgtaatttcagcacattgcgaggctgaggtgggagcattgcttgaggccaggagtttgagaccagcctggggcaacatcgggagacccccatctctaaaaataacttttaaaagttacctgagaaggccaggtgcggtggctcatgcctgtaatcccagcactttgggaggccgaggtgggtggatcacctgaggtcaggggttcaagaccagcctggccaacatggtgaaacccatcgctactaaaaatacaaaaattaggctgggaatggtggctcacagccataatcccagcagtttggaaggctgatggggacggatcacgtgaagtcaaaagttcgagaccagcctggccaacatggcgaaaccctgtctctactaaaaatacaaaaattagctgggccttgtggggggcacctgtaatccagttatttgggcggctgaggcaggagaatcgcttgaacccgggagccagagattgcagtcagccgagattgggccactgcactgcagtctgggtgacagggagactctgtttcaaaaaaaaaaagaaaaagaaaaagttacctgattgtggcggcaggtgactgtggtcccagctacttgggaggctaaggcaggaggattacctgagcctgggaagttgaggctgcaatgagctgtgatcatgccattgcaccctagcctgggcaacagagcaaggttccttctcaaaaaataaaagaagggggattcattcctgcaagtcccggtaccccctcctgattagttttaccccattaattttaggagcttctggaagaggtgaagaaggaattgcagaaagtgaaagaggaaatcattgaaggtgaggtggtttgctttggttttgttcttaaacatttacttattttggaggcatcatgtccctgggcaagagccctgttttggaagggaggaggcagagactctgcccctgacctctgctccttgtttccttccagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagatatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggagaaggggaggaaacttctcccctcccaccttcacctttagcttcttgaaaatgggcccctgcagaataaatctgccagtttttat

SEQ ID NO: 36115 - DNA, 19522 bp, Homo sapiens
aggcgggaaagggcgcagggtttgaaacatggcggacgacgtagaccaggtaagtgtattttaaggaggtcgctcgaaggagcttcttgtactaggctgctttttccagactcaggaaaaatggccagtcgtgcctcctctctccaagtcaccatggcctaatccaccctgtcctttccgtaaccccccctccgaattttgccgtaggccctgagaccttttcctgttagaagcccacctgatgactattctcacactcttcgcttcatttttttaaatctgtagattattatccttagctacctcatggagctgtcaggattccaatagaaagccaggtaataaagttaggagttgttatcattagtgagcgcaacaattatttattcattcagcagatagagtgaacatcagctttgtatggttaggcactgttctaagggccagggacactgacatcgacatataagagatccttgccattacttggagcttatatttgcgaggagaacagataaaagtaaatataaatatgtaagacttccaggaactgtgatgtgctgtgaaggaaacaaggaactggtatgcagaataacagatggtcctagaagctttttcacctggtctttttcttcctcaaatatctttggagatcatgccacaacttaaactttctactgaaatctgacctcctcagagaggacttctgcccaaatagcactcccgctactctggttaccctgcctcatttttcttcatagagagttattttttcatattaaatgtatgcatctttgtttaatgtgaatctctccccactagaatgtaaatgccataagagcagggattttgttttgttcattcttttgtctttggggtttagaacagtgctggaaacactcaaaaaatatttgagtgaatgagttagatgatcagaggaagcctctttgagaagccaatatttaaagctacaggatgaaaagagcagacagtgggcatcccagacagaggcttaggtagcagtagggctttttcatgtgcatattcttacagtattataattatttgtatgcctctccacagtagaatgagctccttgagggtggggattgtgacttctctatcattgtaatctaacagttggttatctgatcctttaacaaacacttgttgaactgagggacatagggaccagttgagttaggttatttttttctctcatcaggccttttgaatcttcagagcctgttaccaattcagttaccttcctccactggccttgtgtacttactgaagaagctctccttgaataatctttctaactcttagcggctgcaaccatcccttccatgtgggtgaccccaagtcatcctagccctgacctctaaaaccaatgtttccagcagttctgtaataatataatattaataggaatcttttcttttcctttttttttctattcttttcttttttttggatggagtctcactctatcgcccaggctggagtgcagtggcgtgatctcagctcactgcaacctctgcctcctgggttcaagtgattctcctgtctcagcctcccaagtagctgggactacaggtgcgtgccgccacacctggctaatttttgtatttttcgtagagatggggtttcaccatgttggccaggctggtctcaaactcctaacctcaggtgatctgcctttctcagccgcccaaagtgctgggattcaagcgtgagccaccacgcccggccaataggaaccatttctaaatattaatattttctgttttcctggcactgtttttaaatgcattaactagtttaatcctcataagaacccagaaagaaggttgtggctttctcaattacaaatgaagaatctgagaattacagatggcatgatttttaatctcagttcataaatgtcaggtcacagccaggagttgaacccggactgcctgactccaaagccagtgcttgcttgccttttttttttttttttttttttttttttttttttttaaaaaaaaaaaagacaagagtctcactctgttgcccaagctggagtgcagtggcacgatcttggctcactgcaacctccacctcgccaggctcaagcaatcctcccacctcagcccttggagtagctgggactacaggcatgtgccaccatgcccggctaagccagtgctttcaaccagtgttctatactggctactaaatatatttatcttattcaccagttggcagcctaaactcaacctgtgctgaattcataatcttcccataaacctacacctctatttggcattctgactagtgtatggtaggcattaagtgagtgtttttccaatgattacataatatttgagataaagctaaagtccctgagaccctatgccctgaaattgggtcaggcagtttggattttgagggaacaaagtatagtcatgattattttgctgtgtaacttctcatgtatgtgtgttttaacctacatttatatagcacgtattatgtgaaaagctctgttctaagccttcatgtatatcacttaagcctcacaaaaacagtattaggtagacactattatctccattttacagattaggagactgaggcagaaaaaggttaaataacttgcccatggtcacacagcatagcagtgatttaagcactactctgactctagtactacattactaatcctgtttcttttatcagcaacaaactaccaacactgtagaggagcccctggatcttatcaggctcagcctagatgagcgaatttatgtgaaaatgagaaatgaccgagagcttcgaggcagattacatgtaagtaaatttatcaagttaccttgaaatcagattccttcctacccccactcccttgaaatgtaaaacctgtccagagtgaaagggtattttgaaggaagagagggtggtggaaagtcacccatatcacataagccaaataaagcggcatgtattcacatttttaacattttttcttttaatagaaatacgtttattatagaacatttttattcccttcatttttcccttctgtttatttgtaaataatatttacttgtcctccattcgtaaatgttttttaaatttaaaacacaaatatgtgttttattaggaaaagttaaacagcacaaaaatatatagagtaaaaagtgaaatcccatttcttctactggtaatcactactaaaaatgggattatcttggccaggtgcagtggctcattcctgtaatctcagcactttgggagactggggcaggaggatcacttgaggccaggagttctctgtgttgccagcctgggcaacatagagagaccctgtctctacaaaaaataaaatttaaaaattgggttaccttttctgtatgtttacacatatacactcatatatgtacatgtgcacatacttgcattatgtacaccctacctctacaaaacatggatcttgccatacatgtttttcagtaccttttttttttttcacttaatctttcttggaaattgatcatgagtgcatttaattttcgtttattctttttaatgactacctaggattctgtatatgatagtgatcgattttttttcatttcttgctacaaatacgtaaatacttgcagtaagcatttttttacatatttctttgtgcatatctgcaaaatatctgtagaattggtcccttgaaataatcccatttgttcatagagaaccctgaaggttttgcctctccttaatgacttgttactttcctaagtgtgttgtttttagtattgctactctaccctaaagtgattaaaaatagctaacatttattgagcattaattatagaccaggtactattattctaagcattttgtgtgtgatatctcatttaatctttataacaaccctatgatgatacatactaattattcctgctttgcagtgtaggaagctcaggctcagaaaggtacagtcacttgacggtaaagggagagccagaatttgaatctaggttgtctgacctgagccccactcttaagtactgtggttccgccttccacaaaacctaaagataaagaacctctgggcttggaaaggaaatagggacccagggagacaatctacagctggccttaaaggaagagagactccaggaaaggaatggtggtaactttgggaatacaaatggaattgagtttaattacttaagtttgtggctcttggaggcttcttcagttccctgtgtaaacttgatggtctctatcctaaatggccccaactttctgtttgttttgtgcctctcagctatacatgtttgatcttgttagtgtgccctgcttagcagttccccacatggctgacaagtgacttttattttgatgtgagcaggtgaaccatgtaacacgttgttagaagtaaacttgagttctgaacaaggtcccagaaagtgcaccttttagtaaaatgaatgaactttggagcttggattgaatatcttagctgtaacatttattgattgagcccacaggtactaaacacatttaagttctggataggttagaaatgggcagggtgttgctctacttactttctctctgcgacatgtggtctactgtgtgcctttagaagactgcaatggcattatcttaccagtaaacaaaggattttatcttctttactgtatttttcttgtcagattgttataggtgaaattgaaggatgtctactgataaatgatgaagatgaatctgctgtttttcataattaaatattataaatgatgtgactgccttagataacaagtggggtggagactttaaaaataatttcaagtgatttgaagtaaatttatttttggcaatataagcagttttatatttttatcaggtcaattaagtaatcattggaagtgacttgtgaagaaacagtatattagtactgtaggattactttttatttgcatgtaaaagtttgtgatgtaagtatcaaatgccctagttgtaattgagcaatttgcatattgttaagcctttatcatttttgtaatttgattattaaatttcttggttctgtaccctcccactttaggcttatgatcaacatttaaatatgatcttgggagatgtggaagaaactgtgactactatagaaattgatgaagaaacatatgaagagatatataaagtaagtcatgcaattctattcattgctttgcaaatatcagctgttctctctcgaacagcttaacccatatttatgggaagcctgtcatgttttgacacctacttatggactcagtagagcatagcaattaaaagcaagggttctggcatctgacagaccctgttgccagtactggcttgaccacttcctacttgggctaccttgggcaagggaattaagttagctgagttctcattggtgagcaggaatactaccacttacctcatagggttcccagattcagtgagatacaacaatgcaaggtggctatgtataatagtgtgtaacagtaatagtggacagtgttctttcgttttctgtggatttgatctattaatacttaatttattagaaactgaaactgaaaaattttttaaatatttattcattaaaaaaacctgggccgggcgcggtggctcacgcctgtaatcccagcactttgggaggccgaggcgggcggatcacgaggtcaggagatcgagaccatcccggctaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaacctggccaggcatggtggctcacacctgtaatcctagcactttgggaggctgaggcaggtggatcacctgaggtcaggagttcgagaccagcctgaccaatatggtgaagccctgtctctgctaaaaatacaaaaaattagctgggtgtggtggcatatatctataatcccagctacttgggaggctgaggcaggagaactgcttgaatcttggaggcggaggttgcagtgagctgagattgtgccattgccctccagccttgtcaacaagagtgaaacgctgtctcaaaaaaaaaaaggctgggtgcagtggctcatgcctgcaatcccaccactttgggaggccaaagcgggtggatcacctgaggtcaggagttcgagaccaccctggccaacatggcaaaaccctgtctctactaaaaatacaaaatattagccggccgtggcggcaggcactggcaatcccagctactcgggaggctgaggcaggagaatcacttgaacctgggaggtagaggttgcggtaagctgagatcgtgctactgtactccagcctgggggacagagtaagactctgtctcaaaacaaaacaaaacaaaacaaaaaaaaacctatcacgtgttactgtaagtaacatttttatgaacaataactattttctaaaacaaaattttaatgaggaatgtctttgttttacatttttgcaaatctctttaatgccccgcttaatcgataacagctagaagattctcatatcttttttctgcgttaaatctatcatgagttgttgttgtaattgaagcaaatctgaccacacagataggtagttggaaaggaaggagtttgttttgtgaatgttctacctttgatactacacccaaactgaacaagtggtagtcagtcaaagattatttgccatctggaatctgaaacggtaacagtaaacttttcgtactcttgttaggtgaaaattcattaatctgccttgcacctcaaatggatctcttactcatgcatgatttggttacatcaggcactggttctttagaaaatagtagttcactgggctatgcagattcattttatttcttcagtgtttaaaaaaaatcacatttattagttatcaccagtgatcttgtcagaaaggtctttttttttttttaaagacagtctgactgtgtcacccaggctggagtgcaatgtcagtctcagctcactgcagcctccgcctcccaggttcaagcaattctcgtgcctcagcctccaaagtagctgggattacaggcatgtgccaccacgcccagctaatttttgtgtttttagtaaagacaggtttcaccatgttggccaggctggtctcgaactcctggcctcccaaagtgctggaattacaggtgggagccactatgccaggccgtagcagaaagaaaggtctttaagatttggaaagacagtttctgaccctgccagggcatagtggttaaaatgtgggctcagagtacaagactacatggattcaaattttgactcccttgcttaccacctttttaattgagccagctcacctaacctgtctgtggatatgtttccttgtctgtaaaatgggagtaatgataggacccacttcatacaactgtggaggattcattgagggctacatgaaaagccttcagatagtgacaggcacgttgtcactgttaaactgttagccttcactggattttgtagttctgctttatcctggctttcctcctctctctgaccacacctgactcctttgctagtgttctttctccttctgagtgtaaacatttagcatttttttctttttttaaaatttttacttatttatttatgtatttttgctggcttatttctccaagaaagaatagcattttttaaaatctgcattttttcccctttaggaatttcatttattaactattgtttagtggttattgttttcttaacatggacacaatcataagtactaagatgcactttttcttaaattttagcatcttaaaaatctgattgcatcttacaggtgatgtgataaaaaaagaattgtgtcatagtttaattggcaaaatttatcctttttcagctcaactaagcttacaaatgataccttaaatgtgataaaatatggaatatgtggctttaatattctgctttattcatgtaacatcattaacataagaattttaccatgagagtagactcttcataagcattttaatgctcttgtcttgaattctgcttgtgacagaaatgactcttcaactgtggtgtctattacagagaagggaacactgccacttactccatgtttgcagtgaactaacagcagggtccacctgtgtcatccctagtagtctgctccaagtgcggttcctcctgacactgtttgaaggtgctatgtgtctgtgcacatgtgcatttctctgggtggggtgtctgtaacagagtctcagtagttactgacctccattaagattaattgctgccttgaaaggctactggggctggttagctcctgaacgctgcgtgctgcgtgcatgtggcctctcttgcgcctagagttgcagctgagaacagtaagcaaagtctatttagttaatgagttctttttcacattgccatgatgtattgggtaaaacatttaaaattgaatctttggatgactgagaatactttagtgtgtaaatgtgtattaactatagacatagaaagcaaagacagtgatattatagagagtgtctgcatctggttcagtgccatggagaacaactacttcactctcctgtgcgctcttgttactcctctccaagatgggaaaccagactaaatggtttcttaccttggcccattttacatttcgctctctctctcgtctattgaaataactaatgaacatcaacgttttaccaccaaaacagtatgggggacccataaaccatcaggttgttgggtttttttccccctataacttacataattgacttctaaataattaatttggctgctgacttataaatgggaaggtggaaagcagtcagtcttactcttctgattcttggtcctccataattggagtttccattttacagattgtgaacagtctgtgttatttgacccagactactttttcggctgtccatcatgtgtactaccttccttcaccaaacacctcgtagtttggctcaccagacagtttctcttggggacgttgtgcccttttgtaactaagccctctgctccctctgcttgcccgaaggccttctacagcatcagatggctcttctagacctttctgtagattagcactgtaataatagaactgtctgcagcagtgaaaatttctatctatgctgtcattacaggagctatgagccacatgtggctatttggcacttcaaatggatgctggtgtgattaaggaactgcacatttaattttatttaattttaatttaatgagccacctgtgactagtggcactcatattagagcagctctagacctgctccctcatacataactaactctttatggtccatgctgagaccatatggtccatatcaccgtatagtacttaacacatatttcttttcttactcattttaaattgcttccattttaatttaactttttgaatagatactagactcacacagtcttaaaattacaaaatgcagaaaggaacacagtgcagtaaaatgtcttccactccagcctctgttcatcatctttacaccccacccccagacataagcactattactggtttcttgagaatcttctcgtgtctttatgcatatgctaatgagtgttagttattctcccttcccctgtttttttatcacagtgctctttccctttcatacatagcttccttgtgctttcgtttttagctttatggtacttcactgtgtagatgtaccataatttaactgttttcctgttgatggacagatagccatttccaatattttgctagtaaaacctattctgctgtaaataattttatctttatctttttttttaattatactttaagttctggattacatgtgcataacgtgcagttttgttacaaaggtatacacgtgccctggtggtttgctgcacccatcaacccgtcacctacattatttctcctaatgttatccctcccctagcctcccagcccccgacaggccctggtgtgtgatgttcccctccctgtgcccatgtgttctcattgttcaactctcacttatgagtgagaacatggggtgtttggttttctgatcttgtgatattttgctgagaatgatggtttccagcttcatccatgtccctgcaaaggacatgaactcctccttttttatagctgcacagtattccatggtgtatatgtgccacattgtcttaatccagtctatcattgatgcacatttgggttggttccaagtctttgctattgtgaatagtgccgcaataaacatacatatgtatgtgtctttatagtagcatgatttataatcctttgggtatatgcccagtaatgggattcctgggtcaaatagtatttccagttctagatccttgaggaatcaccacactgtcttccacaatggttgaaataattttcactcccaccaacagtgtaaaagcatttcagtttttccacaacctctccagcatctgttgtttcctggctttttaatgatcgccattctaactggcatgagatggtatctcattgtggctttgatttgcatttctctaatgacagtgatgatgagctttttttcatatgtcttttggctgcataaatgtcttcttttgagaagtgtctcttcatatcctttgcccattttttgatggggttgttttttttcttgtagatgtgtttaagtcctttgtagattctggatattagccttttgtcagatggatggattgtaaaaattttctcccattctgtaggttgcctgttcactcatgatagtttcttttgctgtgcagaagatctttagtttaattagatcccatttgtcaattttggcttttgttgccattgcttttggtgttttagacatgaagtctttgcccatgcctatgtcctgaatggtattgcccgggttttcttctaggatgtttatggtcctaggtcttacatttaagtctttgatccatcttgagttgatttttgtaaaaggtgtaaggaagggatccagtttcagttttctgcatatagctagccagttttcccaacaccatttattaaatagggaatcttttccccattgcttgtgtgcatcaggtttgtcaaagatcaggtggttgtggctgtgtggtgttatttctgaggcctccattttgttccattggtctatatatctgttttggtaccagtaccatgctgttttggttactgtagccttgtagtatagtttgaagtcaagtagtatgatgcctccagctttgttcttgcccaggattgccttggctatgcaggctctttttggtttcatatgaagtttaaagtagtttttttcaattctgtgaagaaagtcagtggtaggttgatggggatagcattaaatctataaattactttgggcagtatggccattttcatgatattgattcttcctatccatgagcatggaatctttttccatttgtttgtgtcctgtcttagttccttgagcagtggtttgtagttctccttgaagaggttcttcacatcccttataagttgtattcctaggtattttattctcttagtagcaattgtgaatgggagttcactcataatttggctatttgtctgttatttatgtataggaatgcttgtgatttttgcacattgattttgtatcctgagacttcgctgaagttgcctatcagcttaaggaggttttgggctgagacgatggggttttctaaatatacaatcatgtcatctgcaaacagaaaatttgacttcctctcttcctatttgaataccctttattgctttctcttgcctgattgccctggccagaatttccaatactatgttgaataggagtggtgagagggcatccctgtcttgtgccggttttcagagggaatgtttccaggttttgcccattcagtatgatattggctgcgggtttgtcataaatagttcttattattttgagatatgtttcattgatacctagtttattgagagtttttagcatgaaggggtgttgaattttatcgaaggccttttctgcatctactggcataatcatgtggtttttgtgattggtcctgtttatgtgatgggttacattgatttgcatatgttgaaccagccttgcatcccagggatgaagctgacttgatcgtggtggatcagctttttgaggtgctgctgggttcagcttgccagtattttattgaggatttttgcatcggtgttcatcagggatattggcctgaaattttctttttttgttgtgtctctgccagattttggtatcaggatgatgctggcctcataaaatgagttagggaggattccctctttttctattgtttggaatagttttagaaggaatggtgccagcttctctttgtacctctggtagaattcagctgtgaatctgtctggtcctggactttttttggttggtaggctattaattactgcctcaatttcagaatttgtattggtctgttcagggattcgacttcttcctggcttagacttgggagggtgtatgtgtccaggaatttatccatttcttctagaggtcctagtttatttgcgtagagatgtttatattattctctgatggtagtttgtatttctgtgggatcagtggtgacatcccctatatcattttttattgcgtctatttgattcttctctcctttcttctttattagtctggctagcagtctattttgttgatttttttcaaagaaccacctcctggattcattgattatttttttagggtttttcgtgtctctatctccttcagttctggtctgatcttggttatttcatgtcttcttctagcttttgatttgtttgctgttgcttctctagttattttaattttgatgttagggtgtcaattttagatctttcctgctttctcttgtgggcatttagtgctataaattttcctctaaacactgctttaaatgtgtcccagagattctggtacgttgtgtcttcattctcattggtttcaaagaacatctttatttctgccttcatttcattatttacccagtagtcattcaggagcaggttgttcagtttccatgtatttgtgcggttttgagtgagtttcttaatcctgagttctaatttgattgcaatgtggtctgagagacagtttgttatgatttctgttcttttacatttgctgaggagtgttttacttccaattatgtggtcaattttagaataagtgtgatgtggtgctgagaagaatgtgtattctgttgatttggggtggagagttctgtagaggtctgttaggtctgcttggtccagagctgagctcaaatcctgaatatccttgttaattttctgtctcgttgatctgtctgatattgacagtggggtgttaaagtctcccgcaattattgtgtgggagtctaagtctctttataggtctctaagaacttgttttatgaatctggatgctcctgtattgggtgcatatatatttaggatagttagctcttcttgctgcattgttccctttaccatgtaatgcccttgtttgtctcttttgacctttgttggtttaaagtctgttttattacagattagaattgcaactcctgctttttttgctttccattcacttggtaaatattcctccatccctttattttgtgcctatgtgtgtgtttgcatgtgagatgggtctcctgaatacagcacactgatgggtcttgactctatccagtttgccagtctgtttcttttaattgggggcatttagcccgtttacatttaaggttaatagtgttatgtgtgaatttgatcctgccattatgatgctagctggttgttttgcccattagttaatgcagtttcttcatagtgtcaatgttatttacaatgtggtatgtttttgcagtggctggtattggttgttcctttccatgtttagtgcttctttcaggagctcttgtgaggcaggcctggtggtgacaaaatccctcagcatttgcttgtctgtaaaggattttatttatccttcgcttatgaagcttagtttggctggttatgaaactctgggttgataattctttttttcaagaacgttgaatattggttcccactctcttctggcttgtagggtttctgcagagagatctgctgttactctgatgggcttccctttgtgggtaacccgacctttctgtctggctgcccttaacgttttttccttcatttcaacctcggtgaatctgatgattatgtgtcttggggttgttcttcttgaggagtatctttgtggtgttctctgtatttcctgaatttgaatgttggcctgtcttactaggttggggaagttctcctggataatatcctgaagagtgttttccaacttggttccattctctccgtcactttgaggtacaccaatcaaatgtagatttgttcttttcacatagtcccatatttcttggaggctttgtttgttccttttattcttttttctctaatcttgtcttctgtctttatttcattaagttgatcttcaatcactgatgtcctttcttccacttgattgattcagctattgatacttgtttattctttgcgaagttcttgtgctatgtttttcagctccatcaggccatttatgtttttctctacattggttattctagttaacaatttgactaaccttttttcaaggttcttagcttccttgcattgagttagaacatgctcatttagctcggagttgtttgttattacccaccttctgaagcctacttttttcagttcatcagactcattctccgtctagctttgttcccttgctggcgaggagttgtgatcctttggaggaggagaggcgttcgtgtttttggaattttcagcctttttgtgctggtttttcccccatctttgtggatttatctacctctagtctttgatgttggtgactttcagatggagtctttgagtagatgtgctaatcctttttagcacatctgtgtttgtttctttccttccaacagtcaggcccctctgctgccagtctgctggagtttcctgacccagtttgtgtggatatcaccagcggaggctgcagagcagcaaagattgctgcctgttttttcctctggaatcttcaacccagaggggcacctgccagatgccagccagagctcttctgtatgaggtgtctgtcggccccaactgggagctgacagtcattatacacgggggtcagggacccacttgaggaggcagactgacccttagcagagctcgaacgctgtgctgggaggtccgctgctgtcttcagagccgtcaggcagagacgtttaagtctgctataagcccctgactggggctgctgccttttttacagagatgccctgtccagagaggagaaatctcagttttatctttttcttatgtgggagtatacctgcagaataaattcatactttctctctttttatttctagaatggggattctaggaggacagtccatgttttattcatctctctgcgtctactgcccatcataatacctgacacataatgggcactctaaatgtttgtatgagtgaacttcagatttcattgcaggttgactcaataatttttaaacagaagattctatttcattacaaggactgcagatccaagccttgtcacctatcagacacacatgcacacttaaaaaaaaaaattctgggtgaaattcatcaccattactagaaaatttaatacttttctctgatattgagtttatagcatcctttttttttttttttttttttttttttaaacctagagcacttaagtttacacactgaactccttgtactagagtcgccttctttctcaggaattatttatctgtagccagatctcctgcctgggtgttatgaccagacagcccaggggagattcctcacacatgggttgttgaaagtatactctggtgggcatattagttcgtgttggctagactgtggtaacaggtaccccctaaacatgtactggctcagcagtcacagatgtgcagtggttctgcactgctggagtttgtttctcaatgacgtaattattctacgtaggtttcctccatgcagtcattcaggaacccagactccttgtgtcttctggctccaccaacccctaagtcttttgtcgtcatttcacatccagccagtgggaacaaaaaggagtagaggagtgtacatgagaagtttatgaatcagcctggaggtactacacctcttcttaaattttttaggctagaactcagtgatatgaccctagccaactgtaagggagcctgggaaatatagtagaattgtgtgcccaggaaggaagaaggaatttttatgaacagctagcagtttctgccatagtctgctcccccccacccacactggcaaccagtgtctgtatatacctgtgagcaaagggctttaaaaaaaaaattatttatggaaaaatgaccatgggttaacttaccagttcattttccctagaaacagataaaattggaatgtcagctgtgttaataaaaaatattgctgtattttaaaaagaggcccctggtttgtaaactgcatctgaactgagagaactgtgaatgagctctgaatactgttaggagcccatagcaatggtcttccctgagagcatgcaacccttgtagtggagtgtgccccctccttggtgactgtaaagccacattcatggaactgttgtaaacgatactggttctggtgtggagcttggcgcagttaagccagggtggctcctgcacccacctgctaactaagcagtcatttgggtagctagggaagaatccttggaatgctgtaaagacttctgagacacttgccactgcccagctggcatgtgctgtgtttcctttgtataaagctgtgtgcccttggctatcttgagctttgtgagtttttttttttttttttctttgagacggagtctcactctgtcacccaggctggagtgcagtggcgcaatcttggctcactgcaagctccgcctcccaggttcacgccattctcctgcctcagcctcccaagtagctgggactacaggtgcccgccaccacacctggctaatttttttttttatatttttagtagagacggggtttcaccgtgttagccaggatggtcttgatctcctgacctcatgatccacctgcctcatcctcctaaagtgccggattacaggtgtgaaccaccgtgcctggccgagttttgtgagtttgatggccaagttgctgcagagatcaacgatagtgggtgttgcagaatcctacttcccagacagaaccatctgtacccccaaaggatgcaagcaggatatccagctcagggtgcaggactgccacgtgactttcggttttctccgtcagaccacatgtggtcacttgtacagaaacctatccccaaagaagatgaataatttacccctcccacatttatgataaacacagcagggacaggatatccaccacaaaaactctcttcccagagaaggaaggaatgagaaacataagacagttactggtccctaacagtggtgaatcccactgggaaggcatgaatgctccctgtcctggtagcagcagaaatccctcaattagatcaaatatgtcccatccaatgtttggaacttatactaaatttaattgtgcgtcctacatctttatttgcaaaatctggcaaccctaaatggggtccgcagagctttcagggccaacttctattatgctggaagacgcaaatagtcaaaggttttttttggccaggcttatggtttctttggcaatgcaatttctttaaaaacttagaacataggtttctgagctgtttacatccaaacaattcaaagggccagtaacctgtctaagctcttccctaggcatagtttctaggactgctttatttcttcagtttctcacccctgttctgctttctgaaattaatgttgactactttgaggccatttgctacaaaagtttgggtggaaagacaacacccttaatctgatctttgcctcagggctgagtttgtttacctgggaaattttgctgggccttgtttctcaaagccttttttcatacttatttctgtaacttggggtctaaaagccagtggcttttctaaccctgtgaatcctgtttcttttcatctctgcttgaaaaccaactagttcttgcctgagcttttctgtttcttctactgccctgctaaatacattaggctaacagcaacatctactaacatttggcttttccagcctcttctcccagagctcgtgagtttaggagccccttgggctacattccaagttttatctaatattttgccaaggcataatattaggatttcgaacattcatgtgtttctttactgcccaaggcctgaccactaagctcatgcttcaaggtatccattccatatgtgtgaccacagtagcacccagaagtaacacataatggctcagcaaagtagaagttgatctcttgcccatatgacagccctggtggggtttagatctgcacaatagctttcttccaggtggcaagtcaaggacccaggcttcacctatcagtggctctgccatcccctgagctctcgccattatcttagttcatttagtgttagaggaacgactgcagaggggcattctgggtcagtctggatatagtcctgtcatttctgtttacttgccattggttaaagcaatccgatggctacatctggttgcaaggaagaataagaaacatagtccagctgtgtgcccaggaggagaagagtgagttttaatgggtagctccagtctctgccacaattgtcgaaaggaagcagttgatggattggttcttggtgctaccaagggaagtgatcaggttttttaatccaatttttttgtgtcatgatgaatccattttttaacatttctgtcacaaacaataagcagtaatacacagttgtacaaatatgttctgtttttttttctcttctagtcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaactctttc

SEQ ID NO: 36116 - DNA, 12097 bp, Homo sapiens
tcccgacgagcaacgcgtttgtagaggggtgggtgcgcacgctctgtccctgcgtgaccttccgaccccgctgtcctcaccgcaatggcggctgtgagggtcctggtggcctcgaggctcgctgcggcatctgcattcacgtccctgtcccccggcggtcggacgccttcccagcgcgcagcccttcacctctccgtgccgcgccccgcggccagggtcgcgctggtgagtggacggagggggtgaggtcagctcccgcctccagagatcagccttcgctgttctctgcccaaggtcggcccctcttcctaggtccgctcccgccgccccacgtcggctccttcaccccaagtcagctcctgcggcccaggtcggccccattttcccgggtcagcgcccgcggcccaggtcggcccctttccccccagtcaactcccgccgcccaggtcggcccctttcccccgggtcagctcccgctcctctcgcaggtgctgtctggatgcggagtctacgatgggaccgagatccacgaggcctcggcgtaagtcctcaggggcagctggtcctccaccccgggggcctcgagaaggcctctccaccagtgaagtttactcttttttgaacagcttagagaaagcatgtattttattttatttttactttttgtcttttgagacagcgcccagtctggagtgcaatggcgcgatcttggctcactgcggcctccgcctcctgggttcaagcgattctcctgcctcagccttccgagtagctgggactacaagcatgcaccaccacacccaactaatttgtgtatttttggtagatacggagtttcaccatgttggccaggctggtctcaaactcctgacctcaagtgatcctcccgctttggcctcccaaagtgctgggattacaggcatgagccactgcacccggccgagagagcttgtattttaaataccctattcttggctaaaaaaaagcaaaaacgacttgcaaaacccagggagacgctaagaaagaacagtttttaagtgtcgcttatgctgtcacctagagcctagaaatgacttagcatttcacttgagtgtttttcaggacacacacattttgaaaacactgagatcacactcacccgtgttttgcaaatgtttctgacgcatgggaagtaattcccattcattcagttctcaacatcattttaacagttgcgtggtatttctgggtcctagacaggttactgtttacgtaactggtcagctgttgctgagtgcttggtggcctgatttcctgtgctactggaaatgactgcaggccgaaccagtagggcaggaggccaccacgcgtgccaggtacctgtagttcccatgtggttcagggtgaactggagaggggagagctgggtggtggcgaaaggggtgtcaggccatggagagtggcctgaggctggtggctttgtgggtggcccaccttggctggttggagttggcactaggcagagtgagctgggggaaagggccaggatgtgtttcatgatttggccttggtgggatagaaaatagccccagaatagcttgagccctcccaggcagaacggcagggtcttgtgtctggggtgtctgggtggatttcttatgggtagcggaacccaagtgccagggccaggtgctgacctctccctctggcaagtcactgcacttcatgcctcggtttcctcctccacgtaaggggcagtgagggcttagtgtgtgggtgggcttagccacctatctcctgttggcactgggagttgcggatgccagcgtgagcccccataatgtcagctgttgtccccaggaggagcttctgttgcccttgcccttggggagatggagctgcctggcctgtggtgttgtcctggggtctcttgtgtctctcccaccatctgtgatgggaaagttgagggagactagaaattgaactaagtagtgaccgaaagccccgtcacaccgtctgtgcacgtggcactctgagcacactgctgcttctcactcttggtgcttgcagcaagcaactggaggagggcagccaggccctgggtgtaggtagagcactcagcagccggggacccgcacgcctccaggctgtgccctcagtggagtcacccggcccccataccccagtttgcaaagggagctgttgggaccagctgatctccatagcccacttctgagggtttgtcatagtcgtaacccaccaaccgacagtgaattggaatgggggtgtgggggacgtttggcttggtatggaaccaactgtaactttttgcagagcaagtaagatattaatatacattaggaatttgctcctggtacttagctaaaatcctgtttttaaaaatgtgttaacacaaatctgagtggggcacgttttgaagagttgtctctggttttcccccgtgcaggatcctggtgcacctgagccgtggaggggctgaagtccagatctttgctcctgacgtccctcagatgcacgtgattgaccacaccaaggggcagccgtccgaaggcgagagcaggtgtgggggtgggattggaacttgcttcttgtctacctcccacggtgcagcctttttttgctggcttagcttaaaccaagtcttgtgtgcaaatgaacgtccttctgagcagctgtgctcgggctgttccagaagtaatgctgccaaggctcaggagtgccttccttccagtactcacagaaggactgaaaatggcgaccggatcgcttcccactgagtcaggctgctcataccttggtcttaagcaaaggtggtggttctcagcttggtcgcccaccttcttcccctgtctgggctccagatctgttttgctggttcccagcagcatgtctgttactgcggtgtgtgtggttctggcctgtgtggcctgagatccccttcccttgcctgtcctgcctgacagccctgtgcaggccattccaaggtgccttccaactggcctcggaccacgagaggtcggagctggagattcgaggaagaagccatagctgcctcctggggctgtgcttctcaccagtggggacccctgtgatttcttttcctgcctgggaccctggcttctgcacctggacttgcaccttcggcccccacacctgggggctagcagcttcctgcggtggctggccttcgggttgcttcactggtcctgagtcctggcttcttaccttcccctctgagtcccaccgtcctgatgagtgcacagaattctgtctgctttagacactcggagagacttccatttcccatgggccttgactgcagaagattcagagtgatttggcgcaggttctgaagtgctgatcggaagagcccagcatagatttagcgttgctagaaccatgttgtctttccaggtagtgaccaaacatgctgacctggaagtaagtccccgtgtggctgagagccacgtgtgtggagcgtgttgcctgtgggctgtgcccctgccgcgctccacagtccttcacctgcatgctgaggctttttgccctgtgctctttcccaggaatgttttgaccgagtctgcgaggatcgcccgtggcaaaatcacagacctggccaacctcagtgcagccaaccatgatgctgccatctttccaggaggctttggagcggctaaaaacctgtgcgtatttgagctccaaggtcttccgctttccatgtggagcagatgggaagggggtgcacctgtctgctgtccaatgtggtcagtggagcggcgatgggagggggtggtgataggagcagtctctgggtttagggtctgggcagggcacgtgcctgccctctgacttgggagctgttcttagggttgggtcttaggtagcgttgtagcgagccatgcttttgtttctgcttctctgctgcctcttctctcagcattcctggtacccagcagcttgtcagagtgggtttggggctccctcttatctcatcactgtgctgtaggtctcgtcacgttgaaatcagtctctgagtatttactccttgcaagtgccagttttttttctctctctctctctttttttttttttttttctgtagagatgaggtcttggtctgttgcccaggcagggatgcagtggcacgatcctagttcactgcagccatgatctcctgggctcaagccatcctccagcctcatcctcctgagtagccgagactataggcgcatgtcaccatgcccatggttttgtttttttttttttttggccatgtatgtagcccaaattggtctggaacttctgggctcgagtaaccctcctgcctcccaaagtgctgggattccaggcctgagccaccgcgcctggccccaattctcttatggaaccttgcaggatcagaaatgggtttccttcttggtagtttgggcggcggtcctgacaggaagaagggaggccgccttggcgtggctgttttggtagctggaccgtgaatcatggaggcctggctggctcccacacggtggcgtccttgagttccagatcctctttctgttctctgtgtctcctctctctctttgcacattcatggaggttctctgggcaccgcccccatggccctgcctgagaggtggaggtggtgccaggctgaccctccagggacagctctgccacctgcaggagcactggccacagtgcatcggagcgtgcaggtggcttctgtgccatggtgtgggtggcagccccagcacggccggccccggtcggcagctcctgtttcaagggcaggttggaggctggctggccgcttgccccaccctgggcagcctgcacccagagtcgaggggtaggcagtctccatccgaagaatgcgcccctccttatcccgaaacctcagaggcctccttcctcagatgccagctgttttctcagtgcccttggccgtgccctcacccctctctcaccggaagccccaccccagcctgtcgtccccggtctcctgaaagccagcaagcctcgtcggtgccgcccacacccctgacctcacgcagccccacgtcaggctcgatcttttgtccagttgtccctgcgtcgctgccgtctccacgaggctctgaccactgacaccgtgtgtggcggggcgcaggggcagctggagggtgtgctgggggctccgtgccctggcatggctcctccacattttgccaacccagaggcacaggcgtgaggtgtgtggtggttctcagggtcagtgggtcttggccttggctttcaaggtgttgatgggccctgggactgatgtgcccgtgtgtctgagcccacgtcccctgggcgaagctcccattttcactgacctgtccagagcgttctgggtgagcctgccctgcgtgtccatggtgcggcgcgctctaatgagctgcagccgtggccactctgcaccctctgagacagtcacccatggggacggcgaacacccactgcctccagaagattcccagcactctgccagcaaagccatgtggaaaatgctggggcagaggactggggtgcgtgagggtggcgtagagcccaggggtgggttcgtgggaaggtgtgtccacttgtagatttggtggcattgccagatcacacgccccatgggcagtgtggagagacctcccctgccccgcgtgccctccacagctcctgctcctcggcctgaggtgtggatgctggtgtcgcaggtaaactggcgtttctttcacggtcatcgaagcaagagtgcttggtatgcctggaggccgactgcgtttctttttttgggaactcctggagtttcctgctgcccctttgttttaaggaaaaactctcacaccgtgtttctcctcctcccaccacaacagttgtccacacagaaggtgggtgtgaagggtcttccccatgcaccacgcaggggtcgctgctgccttctaattcagttccaacagtatggacccggggtagcgtccgatcgcacgggttgagggctccgtccccaaaactgccctctgacacataccggtaaactgtctgagcctctggaactgaccaattggcttcaagttggggttcccacaaccccgtttgctggcgtggctcacagtgctcagggaaacatgacgtcagcattctcccccggggagtgggggaccctctcaggagagggtcctgagacccacagtcagaaaggcggggaacattagagtcctgctttggggcaggtaaagggcaggcgggaaggtcagaggctgcccgaggcccgacacagccaacgtcgtaacagaaagctaacaagcagcacgggagttaggagccggaaaccagcgtctgagtctcagcaccgcagcccgggttctgccagctgctccggaaggttccagggcgtgggccctctcgccctggtggcctcctgctgcaccacttcctgatcctcctgcttcctatgcttatttctgtttaaaaaacaggaaaatatgttcacatcaaacgcgcatatgtgcagccatgcccatgtcccttgctgcagctgactgagggtctggagctgtgcctaggaagccccccaggaatagaccctggttgtgaggctgtctgaggaggccttttgtctcccggtaggagcacgtttgccgtggacgggaaagattgcaaggtgaataaagaagtggagcgtgtcctgaaggagttccaccaggccgggaagcccatcgggtgtgtacagccgtgcaggcctcggggagggagggaggagggtgcgtgggcccgcggcctctgttctcagccaggagctgccgctgatcctgaaaactcacagctgcttttcttgttttaactgaggggatttcacacgatgtcactggtgacttaacaggaaggagaggcacagtgcacttccctagaggaggcctggaattctcttggctcccagaggtgtccctaggcagtccctcaggacccctatcctttaccagaccccttctcccaagccccttagccacagtacccccaaccccgctgacttctggccagtcactgcagcacgtgctccatccctgacgccatccactcccagcggcctccctcctggggagccacagccaaccacgcccctttgtccctgctcagacaaagcctgggtcctgaggttggcggcacgagtagggcgcccactccttcatccacgtaagcgccttggcttacgtggcgggtcgcagccccgcagggagtgtgtgctcttcagcgtctgctgccgggaagtcactctcagatgtgtgagggtgacccagcaaggccgggttccgcctcggcaggtgtgatgcttccacgagcctcccggcacctgctccttggtggtcctggaacgcggcgctgtgctgtccaggtctcagctgcgtctggtgctggcagggcgagagccgcacttgcgtgggtgaacatcagtgaggcgcactcgcgatggccgctcactaccgagttctgtcagccgaacaaggatgaggatctatcggaatcctctgtctccccatccacagtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaagacagcccctggcaggtgaaccactgcctctgagcatgcctcccctgaaaacagtgtggggcgcaagcccatctcctccccaatccagccatgaggctcccctggaaacagcacagggcgcaagcctgtctcctccccggtccagccatgaggctcccctgaaaactgcagggcacaagcccgtctgctccccggtccagccatggggcttccgtgcacggtgacccacaggcttttttcctgaggaaacctaaatcctttcccactggccccacccacccctcagcctggtgtcagaggcctgcgtggccagccaggggctgttaggcggcccagccgctcactgctgggaccccttccttgaatgcagtagtcgaggtgggcgctgggctgtgccaggagccactgtggcatctgtagctggcagttgatggctgggcggctgcacgcagcgtcgggagctgctgagaacctgcttcctggactttctgcctgcgcagagggcggcaggggggtttcatctcataggcagccagaagttgcttcaggacatgcagttttgggggcgggtttgttttgagagtatcgctctgttgcccaggctggagtgatcttggctcactgcaacctccgcctcccggggtcaagcaattctcctgcctcagcctcccaagtagctgggattacaggtgtctgccaccaggccgaacttttgtaattttaatagagacaagttttcgccatgttagtcaggctggtctcgaactcccgacctcaggtgttctgcctgcctcagctgcccaaagtgctgggattacaggcatgagccactgcacctggctgtgaaatgtgtttttaacagtgtttcgttacagctcacggtagcagtttccacctgggcctgtcgggagtgggtaggactgtagacagcgggaggagggatgaagggtgcggggtgttgagggcagggtggggcctgacagctgtgggctacaccacaggttgccaggggatggggctgctgttaatgaggccgtactccttccactgttgcccctgggtggccatgaggcgctggacgacacaggtcactgaaggccctgctgtgggcacagtgcctggcacacaggggcctctgttgacttggcagggaggggttcctgatgaagcagaagcaggtcccaggggtgggtgtggcaggaccctcagtttcagggctgctgcggcctgtgcgtcagggtcaggggcgtgcgtccaccagcctgcacttgttgagagttgtgctgcaggtcggaggctggcgaggctgctcctggcccgttgtgcctcctgtagaaggggggctggtgtgaatgagaagtgcagctgtgttatctattgctgggtcacagaccaccccacaactcagggctggggcagccgcacatcattaccctctctgtgagtggactttggcagcccgggactctcgccagtctggggtgtcctggggcttggggcttagcccatggctgttgggggttcccctcaggggtccttggcctggtgcttgagtgcctgcagggcgtgcttggcggggagtggggctgaggacacctcactctcagccttgagtcacctggtgccacctccatcacatcccatgggccacagccttctggcagcgcaggctcacagggggcagggtcggcagggctcccgtggcagggcagcctggggtcatggcgagggtaatttctgttctgcaggccatgcagcctgcctgacccgtgttcttttcgcctttcagcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcatatccttcctggtagccaggcccggcccgctgtcgtgcttgtccctgagacgtgcatagggacgcccctccctccgggctgtcttggtgggtggcctcttcaccgggagctgcacctgctgctctccctgtggggcctcccccagtgggcaccgcagccatgtgtctaagggcagagagcagatggctgtgacagcccagctggtgtgaggtgggtcacagacacgtcagaagcgcagctctggtgcgtggttggcagatctggcagatccaggtcccttgcctgactgtttagtctgctcagcaacacccaggcagccacactccgggcccagcggggggagggtgaggaaagagtgtgtgcgaggtgtggagggagagcagccgggcgtgcaggaggcgggggcttcctgagatgctgggggaaagcggccgggtgtgcaggagaaggggcttcctggcttcatttgggcggaagttctcaggccagtttgggtggccaggtgattcagccagccttgcggcccccagcccctcctgttgaggtgtgtaccctgagttctgagatgatggaccaagaacaccagcggggctgttgcccagggagatttggagggaggctcctggaaggccctgcctggatctgggagaatgtccatgtgagcccaactgagagaacagaacactccggggtgccggaaggcactggaatgagtagagcatggacccggtcccctgcaggtgttgttctgaagggtgcagttcctctcaatggggcagcttttttctcacaggcagcttcagacgtcaggccccatctccctccctgcggctttcctgctgggcaggagcgcagtgcaaggctggccccaggcctctgactgcttgcaggaagataggggcacgtgtcttgggtggtgtggaggcctggccagtggttacatgcatggtgttggggaggctcaggtctgtggctggccggccccagttgtgccacctgctgccctgttgcctgttgccctgccccatgaggaccggctccttcacggccagttcttcatctgaaaagcggaggtgctgccactgcctcccgtggtggttgtgagcaccccaggcatgtgtgcgcccccatggcggggcagctcgtggccatgtgtgggtgttgggcctgtgtgatgctggcatgaaaggtgccccgttccctggaatttcccgctgctttcttcctctagaatgcatgtgaattgggaacaggttccttcttatgttgttcagcagcataaatcatacagaaagcagggtcctgccggcacagactgcaccaggagcgagttctcctcttccaagttatctgagaacaaagttaggacacgcggtgagggtgggggaggggccggggctccacacctgaaagtccctcaggtccgtgctgggtggctttttccgtaactctgcacacgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttag

SEQ ID NO: 36117 - DNA, 8361 bp, Homo sapiens
gtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccactcggctccccgctgagttcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagtgagggcccggcaccccagactcctctttctgcgggcagggcacaggaggctaggcctggggtctggggtcccgctgtcagcacctgccttctcccggggcccgggaccctctcctgccccatgtggagaaagggtcctccacctgtgtgtttcaaggggccgtgacctccaggtctctccccctgcgatcccatcttgcacaggagttttcttggggacatagatcagggggtggatatgggagaatttaggggacccggtgccctgtggacagccccgttaaaaagcattttaagatgctggggcgatatttatggggtcaggtagttgatgggcagaggaagggctgcaggaggcccagagggcagtgtagccagagggagaagggaggctgataggagacagggaaagcagggcaagggcccagagtccaagcaacagctctcagctcagctgtgatgaggccctgggggaggtggggggaggggggagcttggccctggggccttgccgagactgtgtctttttacaaggtgaatggacaggctggagaaaaagggagtaggtgggggtcacagctctcagagagcttgggaggacctgactgtagacttcaccaggctccaagaacgaaaagggcagcaagtgtagcatatttgttggtcccacttctgacaggccaagtgagcacagtcaccctcctgccaccaaagtcataaatattaattgagcagctatattggccaggctggagctgggaaccagaaacacagaggtggataaaatagacacagtttctaaccccagggaggtcacacagtctggtggggacatagacttcaagggtgtggctcctgggcagagattgggccacttcctgtgccctccctgggtgggtggggcctctccactccctgtctctcctgcctctacccagcagccaggccctcccgctctgtcctggacccaccccctggtcagcccccggccagtcgtttccactgccagctttatcacccgcaactgtctgtctttctgtctgtcccacccaggctgcaggaggagattcagttgaaggaagaagcagagaacaatttggctgccttccgagcggtgagtgcccttcttttccccttgcatggcctctggccttgctctgccccacctgggtggcggtgaccatgtccttctcgcttggcctctcccaggacgtggatgcagctactctagctcgcattgacctggagcgcagaattgaatctctcaacgaggagatcgcgttccttaagaaagtgcatgaagaggtataccttggcccctcttcctggggtcactgggccatggggaaagcagccggaaagtggggttggggtgaggctctggctgggaataggggtgtgagggtgctgtgtgggccctgagaggggactgaagcccagtcatgccctacaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgggtggcctcgcccggggactggcatctccgtccccctgaatcccagcttggatgtgctgcctgtggtaccatccatgggaggagagcccagaggcttcatgctcccttgctcatccctacccgtgccctgcatccttctcatttttgggcccctttctctgcccttaggtgtcagacctgacccaggcagccaacaagaacaacgacgccctgcgccaggccaagcaggagatgatggaataccgacaccagatccagtcctacacctgcgagattgacgccctgaagggcactgtgagtccctgcccacctggccaggccctgccccttcctgtctgcagttcacaccctcactttgtgaccttgggcccatcatagatcctctctgggccttcatctacttaaatctacaataggggtaaaaccagacaagtggattccagttggatgctaaggaatcaggggttcctgggcatctacctatgtggggactgtgaggctgaatgcaatgttcctttgtatctattttattctgagtgttcacatatagacttaatttgagttcagggttcaacatggcctggacctgaccatctggagttgcctgccagccccaaagctttctttgggctgctagtgtcctcttcccttccttgacctgggttccccctctcctgcagaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggtgaggggccaggcaggagcccgagtgggaggtgcggggtgctgggtggtccatttctgtccccaggaggctcgagattactgattacctcaacaagacctggaaacaattttttttttttttgagatggagtttcgctcttgtcgcccagtctggagtgcaatggcaccatcttggctcactgcaacctccgcctcctgggttcaagcaattctcctgcctcagcttcccgagcagctgggattacaggcgcctaccaccacgcctggctaatttttgtatttttagtagagacggggtttcactatgttgggcagctggtctcgaactcctgacctcaggtgatctgcctacctcagcctcccaaagtactgggattacaggcgtgagccaccgcacccggcgtggaaacaattttatacaagaggccactgctctattaattgcagagaattaaccaaggccacctgggtaaaaagcaatttaattaacagcatttataaaaagagaaatataagtattcccttatccaccttcagaattaagaaccagcagcaaaaaaaaccatattcagcaaccaataataaaatattactgccagtcaagggagagatgaaagcagaatggggagtgatgaggagggaaacggagggagcagatagaggcaaatagagagagggagggagagaagccttgcacagggataggctaagagaaggtaaagagatgcatacagaaggcatgagtttgcacacacatgcacacatgtcagcatatgcacatgttcggaggaaaagacacagacgtcatgctcagagcaacccacctctagacacagaaaacaacatacaactggaaagggacaccagggaaccttgtgggataacagaaatgttctatatctttttttttttttttttttgagacagagtcttgctctgtcacccaggctggagtgcagtggtgtgatctcagctcactgcaacctctgcctcccaggctcaagcggttctcctgtctcagcctccctagtagctgggattacaggcgtgtgccaacacactcagctgattttttgtatttttagtagagatgaggtttcaccatgttggtcaggctggactctaactcctgacctcaagtaattcgcctgcctcagcctcccaaagtgctgggattataggcatgagccactgtgcctggcctagaaatgttctatatcttgatttggactggtagttacacagacgtggacattgatcaaaactcattgaattgtacattaaagatctgtgcatttcactgtatgtaaatttaacctcaatttaaaacagatcagttactccaaaaactggtaccccttgatactcataaaaataatatctgaaatttttaaaaaggagcagacatgtttagatacaggtacaaacataaagagaaacttcagattttgtaaaatcacgtctacatatgatggcctttgaaggtagctaaaggcatgttgcattttcccagcattaggcctaaatagtaagctctcagaactggcctggctggagggtgggcatgagcaatggatatcacccacagctgctactagtaccaacttcagtgccaggagcaagaaggaaatcctggtgctctggagggcgcggtggggttgcacatcctagtgtcgtgccagcagttcacagttgaaataatgatccttccagaagagactattcctgggacagctctagctggccttcgaccccattccttgagcagtatgggtggtgggagtgctggggtccgtgggactgggacagctgaggatggtgtttagaaaggaccagggtgagccttgatgggcggtctcagggaaagatgggagggttcttttttttttttttttgagacagggtcttgttctgtcccccaggctggagtgcagtggtgcaatctccgctcactgcaagctccacctcctgggttcgcaccattctcctgcctcaccctcctgagtatctggaactacaggtgcccgccaccatgcccggctaattttttgtatttttagtagagacggggtttcactgtgttagccaggatggtctcgatctcctgacctggtgatccgcccgcctcggcctttcaaagtgctgggattacagctgggcccggccgatgggagggttcttaactcttaggaggttttgtctcttcccttttaggatcaatctccccatccagacctactctgccctcaacttccgaggtgagtgtctgctggcaggcggaggctggagttgcaggggccaggagtccagcatgggcactgcccaaggccagccaggagggaggatgggaccctggggctagggacagacctggagtctggggaagaaaaaggggaccactgcgggtaggtgggggagtttaggtagaggtggatgaggcaacttatgacagagagagctttttatgtgattatattgtattgtatttaccatgtcccctgcaccttcttggagtattgggcctcaggaagcagcctctgttctgaatcccaaactctgaaagcaggagtgtccttggggacctggcttcaggagcatctcataccacctgccctctaagacacccacagcccattgtctgtttggcacattgccaagccccaccttggctgcttgtcgaacacctccagtttgctggagcaagatgttggatgcacgtttggaaaaaaatgccaaatcttagcaaagccaaacaatgaaaagaacgagctcttagggcactctgccattttgacattagtaatacgcagatcgggtggctttccaaccccagagagcagagaaacacacgataatgatgcattaggaaagcaagtcggagtccttggcagcttctcctttcctagatcaaaccttttctatcttcgatgtacatttccatcaggaaaaaaaacacgctgcgctccagcgagtcacaacattcatcacaggctggttgctagctaaggaaattcgtaagcaccaaactcataataccaaggacctccatttgacctttcctacacaactcagagcctctcttttcagttagttgtttatacagacaccaagtatgagtcttgcatttaaaacttcatagtacaaaaaactccacccacattgcacagtgcttttccaaatcaatagctttgtggccatgataaggttggtaccacttcactccgtgtcctcagtgaggaaactgaggcacagaatggcaagtgactgagcatcagcacaatgagtcagtgccttattcctgctctgtctcactttaagacatcaagttgctcatctgaattttttttttcttttgaaacggagtctcgctctgtcgcccaggctggagtgcagtggtgcaatctcggctcaccgcaacctccgcctcccaggttcaagcaattctcctgcctcagcctcctgagtagctgggattacaggcatgtgccaccacgcccccctaatttttgtatttttagtagagacggggtttcaccatgttggtcagggtggtctggaactcctggcctcatgatccacctgcctcggtctcccaaactactgggattacagatgtgagccaccgcacctggccctgaaatcttaaagggagataggtactgtaaggtcctctaaagagtgtcttgagactgggctttggggttctatcttgaagaaggggagtcccaggagacaaatgtgtgcagggctctcctggggcctgggggtggagaggaactaggagggatggggaatgtcagtgctgtgcagcctgggcctcaggtgtcccctaccctcctgcaccatcctgcacatggagcaaatctgttggctcctgagaccatctaaactatgggacaggcgctggggactgcagaaccacctgctgggtgctgggctgaaggaaaggtgttaaagtcttgaagaagtaacaagcctgtcttgaggggggttggggtctgctagggctctgcccaatgtggccccagatggactcccagcccctggtatagcccagcctggacttggtcaggctgagtgtgcgatggaccctgttacagaaaccagccctgagcaaaggggttctgaggtccataccaagaagacggtgatgatcaagaccatcgagacacgggatggggaggtaagtggtctgtctgggctccttacccttggtgggggctatggatgtgtctggggggactgtcttccacccagctgtgctggtctaggtccctggctagtggggcaagagagatcctgcggccctggggtggggatggctcagggctgaggctccattctctggctagcacatggttggactgggcttctcttcctccccaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaagcc

SEQ ID NO: 36118 - DNA, 143418 bp, Homo sapiens
tcccagggccaggcctggggcaggtgactctcaccagctccagccctggtgaatcctgccatcaggactcctttccttcgcccacccctctgctgacccagatgtggctccattcttcccagaggcttccagagccttgaagtcaggagagccttaagaaggcctgtgatttctccgcccccaacccctccagtgaacatccccacctccccgttatctttctccctatcattaggaggcaacttgctgttctgggagattgaaggtggggccagattcggagctcccaacccctgccgacagaagcagaacccccctcccccaaggggacatttaagcaaagcaacctgtggggcttctctggggtgtgatggtgacagagctgtgcgcatcctgctgcagcacggggttgcgcaccaggcagctgtaggtgccatttgcacccagcaccacccgcaggatgctgtgcacatcaaacaagccctgctcgttggccatctgcgacgtggtcacgttgccagtcaggggcacaccctgcccatcctgccagaacacctcagcctcagggtagccctggtagctggagcacgtgatggtcaccgtgtcccctggccgcaggtccttgttgggctccagggtcatgctgggcttcgagtagggagctggaggtgacagagggcaggggtcaagggcagggcaatggcagaggacgaaaaggatgcatggggctgagtacaggaatcagcactggggttctgggagcagtggtgcagcagggggtgggctgcagggggaatggagggtgaactaaggggaaggcgtccccctcctggtgctcaccggccacctgcaggctgacggcagcgctgccgaaatcccggatgctcacgaagcaggtgaagctgccctcgtccgccacacgcacgcgctgcagcctcagggatgcgttgccctgtgccagcaggtccgggaagagggccgtgcggttggcataggcgctgccctggtcctggccctcagcaaagctgtgcaccagctgtttggtatctgtcagctgccagatgaggttgagctgtgccaggctgaagccaggctcaggggagaaggagcagcacagggtggcatcggtgcccaccagtgccaccactgggtcttcagggacctggacctccagggctcctgggggtagggggagtggagaacatataagggggactgaggaggggtgggcctccctagtcccgctccctgcccctgctaaccccaggccctgtccacccctccttttaggcctgagacccaaagtaatttattgtcttaggacctcattcagtcaagaatatagtcagcacctacaggtgccaagcataaaagtcagaaatgcaacagagagcaatactacggtcacatccccacagaacttacattttaatgggagagagagacaaatgggcacacagattctcgtcagcatgtgactaaggtatgtgaggaaaaggagccagcaggttagtaagtaaagcaacagcttttcaaaaatctggcaggtactttacacctgcctgcaccatgtgcatttccccatgagcgtaagtaatgttataaattggggagtccaaaaaagtatccaccaaaaatgtcaatagtggtttctctggaggagagagaatcacaagtgctttttctttttttctttttttttcttttcctaacgaaacacgatttgtttttatacaagaaagaatacccgtacctttaaatatggtggtgaggcacatgctctttaaagcaattaagctgaaatttatagggaatgaaaaagagctgacatacagagaaccccgtagaggaaacagcaggtggaaggccctgaggcaagactggccttgctgtgtgaaaatatcggggagcgtccagtgtggcagacacatctgatgggagggcatgtcccacccagaccaaagatgacttgaagagaccagtgaggaatctaactttttctatgagtaatgggaatcactggggagtgttttaatcacgcataatctgagtagcaatgcttaaaactcactctagctcctctgtggagactggactgtggcagggcaagggggaggccagttaggggcggtttcagctgtccctgtaagaggtgagggtggtgtggcttcaaagggtggtagtagagaagaagagagggatcagattcaaggtttatttaggagggaatcaacaggacttgctgatgagtcagaagtgaggggaaaaggcccggcatgggaggccgaggcaggtggatcacctgaggtcaggcgttcgagaccagcctagcagatatggtgaaaccccacctctactaaaaaatagccaggggtggtggaacacacctgtaatcccagctactcaggaggctgaggcaggagaattgcttgaacctgggaggtggaggttgcagtgagccgagatcgcgccactgcactccatccttggcaacagagcaagaccccatctcaaaaaaaaaaaaagaggaggaggaggaggggaggaggggaagcgaacccccccaccctggcactaccattctccggtaatggttagattgtgtgcttcgagcactagcaaagcaggcacactcaaaatgtgggaagatcaaccttgaaacaatgctaattgaatacagcactcattaaaggtttcctgcatttagaaaaataacattgactttatggttattatttttattgtgaatcatactcagtatcataatctttgcagtacctagagatctctaaagttcttaagctagccttggatctcttgctgaaacccctggtgccccaggccagttctcatgccctgtcagtcgaaccagggtgccccttggaggggacatttgggggaatgaaacctggtaagtcacccagacaaaaccctttcttgctctagagaaatcagagcagccgtgggtagagacaggcacttctttatggccacaagatggcgccagaccctcagctttgtcttccccacggaggaagccgtctcagagcagagatgctgatgagaatttgaaatgtgatgaggatattgttattaaagtagctattattattgagtgcttcctgtgtgccaagcaccgtgtggggagagtcacatcgtttattctacacagttattgggcacctactatgcaacagccgctctggccctgagatggaccctgctctttgaacagggaggaagcaagcaaacgccaggtgggggcgaatctaggcagaataacgcagggaggccagggatagggagggaggagcggaggtgtgctattttatacaagggagctaggagagccttgagaggaggtgacattgagcaaagacctccacaaaatatgggatccagtcatgcagacgtttaggggcagaaagttccaggcagaggaaagagcaagtggaaaggtcctgggagggggcgcacacagtgtattcaagaaatagcacgatctcatttagcactcatgttcccattttacagacaaggaaatggaggctaagaacagtaacgtgagttgcctactggatcccacaggtggaagtaaggtatggccctgctagccagagctggcttggcaggacccctaacaggcgtgggcaccccctccccaactgccacaatcactgtccctcccctcccgtccccatgctgctaccctcacctgtgaggcagaaccacagtgctcccagggctgcacccacatgcacacccatgccagggctgccccgccgacgcagcatcttcctgtgaggcggctgacagctgggctccccgtggtggaaggctgcccctgcctgggagaaagaggacgcaaggcctttgtctccaaaggttctccccagaccatctcttgcctcatctctcctggaccagagtggggaaggctgcaactgcccactgggaggtcctcattcccatatcccaccgggccccctgctgaggaatcttggtgacagatgcttggcagggagtccctggggaggcctgacagggaagatggggtagggggcagctgggatccaccctttcagctaagatgttagtatccaaatataaggaagaggaggcaaggcggcaagtgaaggcaaggttggcttgctctggggctaggatgtgtgcagatcaatttggcagacagtagctggtagggcagagcaggagctcctgtgggggccagacttagagatgggctgacaggtgtgaaatgtatcctaaaggcagttgagagccactgaagcttcctgaataagggaaatacacggtcagagctgagcttcatgaagattaatctgacagcacctccacccgctatctgatgggagggtatgtttcagccagatcaagcagggctttgagagaccagtgaggaatttgggtttttctatgagtaatgggaatcactggggagcattttaatcacacataatctaggtaacaatgtttaaaacccactctagctcctcagcatagactggattgtatcagggcaagggagaggccagttaagaggctatttcaggctgagtgcagtggctcatgcctgtaatcccagcactttgggaggctgaggcaggcgaatcacttgaagtcaggagtttgtgaccggtttgaacaacatggtgaaaccccatctctactaaaaatacaaataattagctgggcatggtggtgggcacctgtaatcccagctacttgggagggtgaggcaggagaattgctagaacccaggaggcagaggttgcagtaagccaagattgcaccactgcactccagactgggtgacagagccagactcgatctcaaaaaataaaaataaaaaaagaggctaatatagccatccctgtaggaaggtatagtggtggaataaatgaagggccagacaggagacaaagcatgtctgggtaaaagtgacagtatctgaggacttgggtagagagaaagagcagtcaggttggccgtggttttgagcctcagtgacagggtggagcattcactgaggcagagaaaatggaagggttcagtatagcttgtgtgaaatcagcagtatttgcaaagaagcttctaggacagagttttaggaggcgactaggtgtatgagtgtgggaatgcagagagagaacatttgctagcttaacacatctgtattgagtgaccaagacagatcagaagtggaagaggcaaggacttggggatgacctcaaggctggagtcaggactgagtaagaggcaagtctgtggctgcaggtcaggcctgagctggggatgagaagggcagacatccctaaatccagccctgctcccaatcccagccaccctccaggctgcacacaccttgtccctgagtcccacagctgctgcctaaacatttgtgccatgtcctgatcaagccacatctatgccaaccaacactgatcaacaagaatagaaatgatttcacgtcctcctaataccctgggagataggctgtaacacttggtcctatttttgcaggactttaaaaaattaaagcccatggctgggtgtggtggctcatgcctgtaatcccagcactttgggaggccgaggtgggtggatcacgaggtcaggagtttgagaccagcctgaccaacatggtgaaaccctgtgtctactaaaaatataaacattagctgggcgtggtggctcaggcctgtaataccagctactcaggaggctgaggcaggagaattgcttgaacccaggaggcggaggttgtagtgagtggaaatcgcgccactgtactccagtctgggcgatactgcaagactctgtctcaaaaaaaaaaaaaaaaaaattaaagcccagataagtgactttgttaatgtcaagtaatttgccagtcagcacagccaaaaagagtccaattctgctacacctttccacccttccacggagcaaacctcatcaacagctgctagcctcaattccattccaggcgcccagcctcaatccttccaatcccagccaggcacacccgccccccgccaccctccactcctacacacacacacccccagcagctgggccaagggagtccctcagccaaaccatgtgcatcctggccagccccccttctctcccagctgtctacagtggggaagccctgagcagccacttcctttccagacgcttccggcctcaaagccttactgcctgctgagtcagcagccttccccggctccattcataaagcacctttggcaggcaccacatcctgccccacaagggccaccctgaggcccacaggaagatccagcaggcagctgcctgcaggacctgcccaacccctgcgggaagcaccagggctaaggatgaacgaacgcccagattccacatctccctgcctctctttaaccccagacagaaccaaggcctgtgggttcttcctgggccgcctccctcactctccacactgcttctcaagcttccatctcccaccctgacccatcacccccctcactggccctgcttgctcctctctttccctgccagccccattctctaaggtgccttctcttaggacctaagacaggaatctgctcatgtccctcccctgctcaagaacttcccatggctccccattcactatagaagtcagaccccattcctctgcctggtactcaagactcttcatataattgtctccttcatatatcaggctaattcctgccactctgggcaggtacagggagcagagggcacctcccctgatcagacctacccaggctctcccagggccgagctgcgcttccctccagagggaagatgagggacttccagggctgcgccctggacttgctccctttcattcctttcctagactctggatcctggaaacctgccctggagagaagcagtttgacagcccagaagcaaagagaccagaagagtccacggcacccagagacccctacgctgacagctgggcctggaggagctgaggacaggagaaagagacagagctcagaaaggaagtgctccctggagaatgggagagtgtcctgtgaacacagagctggtcggcccgggacccagagccacgtggagccacgcaggcctcatgctgcctgcgtaccaccccctccacccatgttttccacaaaggggaatctcatccccagccgggacctgccctggagtcagcatgtgccacccgtcccggtgagtcacctgccagtgcccactcctcgtccttctccttcctgctctatcccaaaaccacagagcaccttcggctttcacagagcagcaggagagaggggtcaggctgtcctcagcctaaggtacagcaagggcatccaaccctgcagaagcagggccacagggaggctcccaagagatgacccaagatgtgccctcagaaagctacaacaaatccagactgcacctgggctcagggccaaaatgccctgggcctggggatgcccaagagggtctccttgccccccaccataatcacccacatcactccacttcctcctaaccccctacttcctcccaatccccgcaggggctccttgggcaacacttcccacaaagggacaaaaagggtcagaaagacacaaagttctgaaaatgtcagacaagtccctggatccagctatgcctgaagcaagctgcagacctagaccgcccagatatttgagccaatcattttttttcccttaaaccagtttgaactaagtttctattgtctgcaaccgaaggagtccttgaatccacatgcattcatgtctttagtaattcatttcactacttacggagttcctggtagggacgtactaggggcagagagataactaaggtacacgtctgtcctcaaggagcagattctaatagggaagggggacatgcagttagatcactgcagtttggtatagtatactatttatgatatggtcagggcgaattggaggcacctcagaggcatgataaccccagagatgatccctgaaaagtcatgagcagctccccaggtagccgcgctgggaaaggtaaccctttcctgaactccagagacccgtcctcctgacactgcctgtctgcccctcagccagatcaccctggaattctagaaaatgagcccaaagtgtggggttctggtcccagctctgacactttgttatgcaatcttaactaggcaacttctctgagctcagtgttcctacctataaaagaaaagctttgtggatgctagtggaactttatcagtacttgaagctttcagggactatatccttaaggcttaaccagttcacagccacacagttcccactgaaatgcacaaagtgactgtggcagaaactgctagttgttgtccacttacacccattttctccctttttaagagacagggtcccgctctgtcacccaggctggagtggtaccatcatagttcagtggtgcaatcagaacccactgcacccttgtaactcctgggctcaagtgatcctcctgcctcagcctcccgagtaacagggactacaggtgctgccagcacacccagctctccccttcttccatagcatttttagttaggcacacggccactcagctaacgactgcagatcccagccttacttgcagctgagtgtggccatgcaatgtgtacactgatgtgtacagcttctgggtcatgccctgaaagagagaagcatgccctcccctccctttcccctcccccttcccactggctggaacatagatgtggtgtgtgtggcgatcatactgccaaaggcaacaccctgaggacggcagagcagcagacagaagaaccctgagggactgtagtatcagccctggatatacccagatggtcacatgggtgagaaataaacatctcttccagcataagtcattgctattttgggcctttcttacagcatctgaactaactaaggagccatcccacccttactttccctccttctcttccccgtctccgtacccgatgagcattgccactgctcagagccacaaaaggaaaccacatctaaaataggtatctcaaaatacgaacaggagactatctcatcagagtcaccgagtgatgcctgagcccagctttggacaaatgtcaagggtagaagtgaccaggcttggggactgtttgtattgagggaggggctgaaggtgtcaagagggcactgaaggcttgagcaatgggcaaacatggacacacataacaaggagacctggagatgaagcacgtggagggggaagatcagttcctactgagctcgactatggatcatccacaccaaaatgtcctatggactcccagacacactgagctgcagctcagaacagagggacatggcagtcattcgtgcagtggtggtgacagaaccaaaggtggggtcactgagggagatgatgccatgagaacaaattctggggaaactgcagaaattaatgatcaagtatcagaacagggaacctttccctgcccctccccccacccaccgcatacacacaatctctgtttgccctcccgtgatgggcacccatggcctgcatgggctatccacttgcttttggacagcgttcatcggtgagaagctctaccttatacttagcccaaatttgtctcccaatacagcccacaacagtcctcatgtgaccccttggaccacacagaatgagtctgcccccttccttatcaaagccctgcaagtatttgatcttccttgacgaagtcaccattgagcagccatgtcacaccattcaccaaaataacccaaaataacagactatcaaatctgtagccaaccatcagaagtcactcacactcattgctgctaatccacacctctgccatcctcttctgatggagttcagaatggggaggagttttacaggatatttcatttgttactattccatttcacccagttaaactgagtccattcctccaactgccacaacatttttttcattgttgtaaaatatatataacatgaagttggccattttatccaggtttaagtgtataagtcggcagcattaactatatttacaatgctgtgtaaccctgtcgtgatcttttgaagtactcttttgactgttctggtgcatagacaatgctcaataatttgttggtggattaaaaaaagaatgaatgaatatcatctgaaaaggttactctcctctctctgctggtgtctgggtgtcatcaaggtcctcagggagaggacaggaataggaaagcccacagcaccatctgtccctggatgatcaatgtccatccaccattcagtacaccggggttaggagtgttcctacctgtgctgctacccagctcccatctacccatctcatccccagggctgtcatgagaagcttcactgcttctggctggggaccaatcaactggagaagaacaagaaaagaagtgcattttcaaaaccccagtgaagccatgcaagtgcctactagtgggctcttcttcaagtgctcattggttccaggactttgtcaaggattaagaacaagattatcgatctgttgttcccataatctaccatcttccccataaaactggttatttccctgtctcaagtcttctggcatttgttcatttattcattcaacaaatgcttattcatgatccacatgccaggcattggccatgcatgcaatatgaatggagatgaagaatcgtacatataaatattcaactacaggggttctcattctcaagttgggaggtatgtttattattatgcttcaaaagttacccatgttatatatattattttgcttttatcaaataataataacataggccagttttgttgaaagccatgcaccaggctctgttctaaatgcttttacacatattaactcatttaagcttcccaacaattctgtgaagtaggtactattattatcctatttcaccgaggagtaaattcagggatggagagatttaataacttgctcaagattacagagctgctaaatggcatatttaaaatcccacattttcatattaaaaatagaaaaaaggtttaggaaacaaatatatcattaaaatagaatatgaccagttttttggtacacatttatacaaggtattgtgggaatggacgaggcagtaggcttaaacctggatgaaagggtcaagccattcactgggggctggggaggctcagtaaggactgcacagaggaggagacatctcggctatctggcggaggggacagcatgaaaagtcacagaagaggagatgtccacagcatattctgggaagatgggactccaggagaggctgagactcaggagaggaggcaagggaggtagtgagggacgtagatggggactcggattgaatctgtgcacagcaggaaactgtggaatactgtgacccacgtgtccaaccctcttctaccctagactggcctgaaatatccctgacagcttctcagagattctgtctccaagttcaccccacaccaggacaggcaatcccaggggccagaagacaaatacagttaaaacagatgagcacctccccgtatggcctaaacttcaattccttcttaacatcttctgctccttctttccttgacaaagaggcaaattcaatgccgagcagatcgtctccgtctttggtagctagtcttaacacagttattttgctccatgtcctttattctacagtgcccttctcttggtctatgctggccccttctggtagcaaggctccgcactcctgcagggagcccagtccatgctgtactggtggagctgtcctcccagcctagggcctgggcatgttacaagacctggctcatggagaaacctgccctgcccccactcagtgattagttcgagaatgagctgtaagccaagccacacccaatcagagacttccccagagccttgctgctgcagccatcaaaaaagactctttcttgttgagattactaagaaggatacggtctgggactgttagcaataaatgtgtctgctaccaacaatctaaagaattgatccaaacaaatgaacagaggcagagatggaagctagaaggatatagagccctaaaaccatcatttaagcccctattcctgaagcaagctgcacacatagactgcctaggtacttaaacaagtcttttttttttttcttaaatgtgcttgagctagttttctattatctgtaactgaaggactcctcaaatatgtctgctatatcttcactatctccatttctctctacccctgcttctcttcctggtcttccaagtcaccatcatctcttgcctggataactataaaagcctcttcaccagtctgttcaccttctctagttcccccacccaattctgttctccaatctatactctatacaacagccagaataattgctattaatataaaagcataaattatatcactgccttcaatagttaatcatagggctgttcactttccttgtgataagatcgcagctcctccatagcctacagagccccatctgccctggccctgcccacctgcccagcctcacctcttcctacttgcccctcaccacagtgggctgcttccagttcctacaacataggactccctttcctacctcacagtgttgctgcaaatacagtttcttcttcctagatgacatgggtgctttaagactcatgttgaaatttaattgccactgtaacagtattaagaggtggggcctgtaagaagtgaagagattaatgctgttatcacaggaaaagtgggctcctgataaaagcgtaagtgctgcccccatactgtctgtactgcacgctcacatgcccttccacaataggataatgcagcaagaaggccctcgccagatgccagcaccatgcccttggacttcccagtctccagaactacaagccaaataacctttttttctttatatattacccaggctgtggtattctgttatagcagtaaaacatggactaagataaaaggtaacacctccatattctgagggtcaccttgacagaaaagccaggtaagagatctgccactctaagaaggaccctgtcattcattgcacccagtctgttttcttcatgatatatgagaacctccctgagaaggaaccacatctgctttatttaactattgcatccttaattctagcaatggcttggcacataatgggttctcaatgcacgattcaatgagtgaacgaatgaatgcatgtgtgtttagatagagagatggatagatatatggatggatggatgtttgtatatggggaaaggatctggatgcctgagagtgaatgcaactctggagtgtcagaataagggtgagagtttgctactgttttctacttgatacacttctctgtttttaactatgaacatgtaaattcttttgcaattaacgaaaaaaggaaaacagcaacaacagagatatcctggactttagaccaggctctgtcactcacttgccaggctccctaggccaaaccccttgcctttctgggtcttcatctcctcaaccatcaaagggtcctgaccaccatcccatgctgtgaccatatcgcatgttgggctggtgtaatcacaagaagcttcatggaagaagttagcactagtgtttaagaagatgactttggagttggagagacaggttcaaatccagactctgtcacttcctagtaatgaaactttatgaaaatatcctctctgagcctcagtttgctcatttgtaaaatggggattataaaccttaccctcataggatgattataggactcaatgagcaaaattatcaaaactgacctagttaatactaggtgctctataaatgggcagcagcctcagaaaagagatgggagggtccctagagttccctgggaacagcctccctgtttgccttcctttttcctgataatctgagtcagtttgggccttttatgttcaaggctgtccactgggcaccactccccagtcccgtgatcccacccaagagcaggaatcagttcttcctctccaagcgatttctgtgtgagtcaggacagtagtatgtcatcagggctggccagcaaagcagggctaaggtctccctggaactagaggcatgtgcaggggctgcaaaactgacctatacatgcatgtggaaatgtgtacacacacacacacacacacacacacacacacacacacacaggaggcacagagccctgaaaaaagtgaaagctacattgggcccagaggaggtccagccaaaagaagggatggcaacaaggagaatagggagaggaaggaaagggatgagagcacatgagaccacatcagagcgcagatttcgggtcagacactggcaggcccagggcacacacatctgcattcactcaatatctgctgagtcctgctaggtgcccacctaaacatatctggaaatcctatcctttccagaagcctttccagactgcactcaaggaagggtgcattttctccagatgtgatctgcctaaatgcctccttgcctccaaattcctttggtttctaccctgaaagaggctcagcttagcagaacaactctgccgacccctctccatctaagcaccagacccctctcggagtgtagcaatctccaccagtcctcagagctagaaggcctcttacggtacacctggtccagcgcctagctccaggcccattgtacagatggaaatctggacccagagtggtggccggctggccaagggcccacactcaattatcagccaccagcagaagtgactaagagccagctgatgctcctatctctcttcctcacttattgaatggaatcaccaggctgccttgcctgcccagggtacagcatgagctcagaagccagcagccttgggtttcaatcctgacaccgatgccttgctgaacacatgaccaagtttaaatgacttaacctatttgagacccaattccaaatctctaaaatgggggtaacaatccctaccccacagggctgctgtgagaataaaataagacaatagagagagaggacttaggaaagtgcccagtaccaaaactgcagtaataattattattattgctgttattattgccgcaagcatggggacaaggcctcctagatggggcctctgcactgagcgaacactttgcccctaccccactctccctggccaagacctcctctgtcaggccacacatctgggcctctgggaccattactccttctgtatccctacttttcacctagagccctatcagtgccccagctccaaagtagcaaatgcacaactcgactccatctctggctctgactcattctagtggtcctgggccccttcctcttcgcagatgcttggtcacagttccaagtaccatgagctcctaccgtcctgctgccatagcccctagcacagagcattcccacagggacacattccaatgtctcccacaaggcagccccagttcctaggagcctgcattgcctctagggtaacttgggacccctgcctcccagagacagtatctctccctgctccaaggctcccagcaagaaatgcttctcactccacttcccgcagattaagctccctatgcctagagaaggtcagattcccaatggcataaggtgtgtggagcaggcattcattctctggaccacaaagagaaagaaagggagaaagggggcagctggctgggagcactggtcagaactggagggtggagggggaactcctggaagccccagcatgataaagtccagggctctggaagagaagaactctcagcaaaggccctgactatgctgtgaaggccactagtcactgggtcacccaggtcaggcctgccccttctctggttccccagatgagtcttccctgacttactaaggagacccttggcacatcttaccgggctccagaaagaggggtaaaacctgtgcctacctccagagcagcagaaaaagccagttctggaagcagacaacagcccagctccaccatttgccggctgtgtgtctttgggcatgtgacttaccctttctgggcctcagtttccccaactgtacaatggtgttaatgataccctacctcataggattactatgaggattacatgagataatgtctatttagcctccagcacaaccctacccactcccaaacctgaaaacccaatgctcctatctggcacactgcaagggcggtagaactgggggtggcaggcaagggttgcataactgtacacgtggcccccttccaggtgtggggtccattctgagccaacaagaccaaaggcaatttctcaaaaatcatgtggaccagtcctcacccctctccccctcccctaggccctgggtgtgccctcccccttttgctggtggacttccctaacactcctgccctggggatgtgggaaaaggacaatgagaagtcgccacccactcagaggataagctcatgggcagtaacgtcatcctccttgccatttttcctctttccctgaccctatgactcagatccacagcttaacagcccccatgtggtcataatctcagaggctgcttggatttggtcatttttctgcacagaccccaaaccccgtatgtgcaaccaagtaccatccagccacttgttctacaacattttctaggagtctctttaggtgctgtggaattccaactcacagctctcttatcacactgcatctctgactccaaacagcattgtccagctccttgtcaaactcaaatcctactccaaagaacaaagatttacccctccagagaaagccaaagtttaatgatggaattctcacaggaagtttcagaagtcaacctaataaggacacagacaccccagaggactactttgaagggaccacacttctataactgtcctttccataaatattaaagcaccgaagccagctgtcaggtatatgaacatgagacattcagccaaccctccatcgggtggtgcctggacagagctgaagaggggacaggaaggaaaacagggtcctcagattccaacaccccttctcacctgagacttgcattaacacaggctccttacctctgacaagctcatgtctcacagcacaggagtctagagtaagctggaaagcttactgcaggcaggagaaaccaccagtaatgccataaggacatggaagaactccaaaggtcagtcatgggaccctgactgcatcactgaggccacttaatgcaggaacgaagctctctcccgccagcgtccccttgccatacaacccctcagaacaaaaactgaggtccacagggctgacccaaagtcatgaaggaaaatttcattcacatcaggatactccagtaagctgacggtgacgtatgtaaatttccacggtcaacagttaccctaagtgttagtgcttaatctcaagaactccagatatcaggaaaatgtactcacccaaaatactcccttgaaatgagccacttcataccctacagccccatagccctccatcctgccctgcactcagatcagctcaacccatcggacaggtttagacttcaagtttagacttcagttcccctcagcctcaaactgtcccacctatttgcagtcccccacactacaaggaaggctgcacagcatcagatttcctagggacttctgggaggccagagggaactagaggaggccgcactaaataaagaactctcttaaagacaaagcagcttcattactttctaatatagaaactaactgctgaagacatgcttataagaaaaggaccccgggctttaatgaagagatcagactcatttacaattatccacatccaatttgaaggtaaatcgtttttctaaattaagacaactaacacccccccacccgccacacacacacacacacacacacacacacacacacacacacaaatcttttttgctttactatttgcttaatgttttccctcagtgatagatcccatatctgagtcatctatcacgcttttctcattagagcaggtttggcttagaaataaatcccctgccttaggctgccaaacctgccaattcgctagctaaacggtcgcagggagggccctgggcgctggaattcaatcccctcccttctagtgtgcccccactcggggtccccacctccctccaccgtcgcccgcatctcctctccatcccacctcaccccccacctccctgaggcttcccaagcccaaactgcccatcccaattccctccccacccccaacacctattcaccccgtggcccctgccagccgtctctacctgtccttcccggaatctgacccctcatgctgcccacggctgcctgtggaagtgcaccagtcgcccacaccttcgccctgctgggccctgcagagtggacacgcctaaccactcgccttccctccccgccgctcccctcccggagctgggcgttttcctctgcaggacccgagaccccgctaacctcccagcgccggccggtggcttcgttaagcttcaacacgggacagatctgcccccatgcccgctccagacccggggcctgcaaaagcgcattcacccacccggcccggtccgcagcttccggggtctgcaggtccgacggcgcccgggcccctctcaacccgaggaaaggggggcggggtaggatccgggagcccccagctctccgcgggccccacagcccagggcaggaggggcgcccgcggttcccgggactcctgtgcgaggggggccgcccggacctgggggagggcaggggagcaggagcccggagggaaggcgccctgctcagctcctgcagccctgagcgggaacgtgcggacctccgcgggatccaggcccggcccgcagcagacaaaggccgccccaccccgcgccgcccgcgccacgccagcactcaccgcgccgcgccgactctgggactcagggacgcggcccagcctggctcagtcgccgccgcagcgaggcccggcccgaatgggggccgggggcggcccggggagtccgaggggcggggcgggccgcgccggagaatccgcctgaggcccggaaaggcggctccggtgcgtccctgaggccggattggccccgcggtggcggctgctgaccgaggcctgagccagcccgctgggcagagcacacggcctggcccccgcccccgccccgccccgcccccaggcctgaccctggcggggaaaaccctcggctcccggagcagggcgctgcccatcccccaccccgttcccacacttccaagagccgaatcttcctttctgcgagaggggataggtgactgactggtcatcgactggcggcagaacagggctggaatcctgctgtccaaccccagtcttgggttcttcctccacaccatgctggcaccacagcccagaaagggttaactcgactgcgaggaattaagagctgcaaggagctctctataaatacagtgtcgtgggcgcctgagccaaccgcaggacaatttccactgagctggttttcctcttttccttccacccacggccatccgaccagccctgcccccagccccaccccagactgctggccggacttggctccaacaggcctgacacctagtggccttgggctctgtccttacagggccccgctccagcctgggaggagatgggggtcgggcctgtccagattttgctgtggtgcagcccatccctgcacctgttcttggatctgttcttcctcacagggacagtgacagctaaaacgtagggagacttttgtgggccagagttaggttaggagctttccatgctgggcctctttagttcctccaaacagccccgccggctagatattattattcccatttcacagatgagaaaaccaaggctcaaagggatgaagggactccaaccttgtactgctgccaggctcaccaccagtgccagtggcagtactgggcagggcttgggaaatgagtatgaaaacatgtgcgtctctctgcatgtgttgccactgttgtaagctctttaccattttatctcatttaatcttcacaacaactcattgaggtgaataccattattctcatttttacagatcggaaataaggaaattaagatacaaagagattaagtaacttggggacacatagctatgaagggaggaaccgggatttgccctctgaatttaagtgtgcgtgtggtgtatgggtaggggtggtggtgcatgggtgtgtatatttgtggggggtttttgtcttttttttttttttgagacagagtctggctctggagtgcagtggctcaatctcggctcactgcaacctccgcctcctgagttcaagcgattctcctgcctcagcctccagagtagctgggattacaggtgcgcaccactattttggccaggatggtctcgatctcttgaccttgtgatccacccgccttggcctccaaaagggctgggattacaaacgtgagccaccgcgcccggccgggtgtgtatatttgtgaacacattcaagcaactctgtatttgagtctacgtgcatatgtgtctttgaatcacacagcagctgtgtctgtgtaattgctgactgctcctagggatgacagcagagaggcccagctgtcttgtccctgaccacctccaggaactctggaccattccacgctgctccccactgccctgccaggccctgaccagcctcgtccagcctgggtctggccttacaggtctcaggatgagtagcctccagttggcccagcaacctggggaagtagcatcacatggagaggtgtccttgggctgagggagctaggagccctgctgcaggaccctggaggtggcattgaacagatctagagaaacttactttccttcccttcacaaagagtcagtcctgtgccttgtgccttgcggtggtgacgctggtcctgtcctaagggatttataatctggcatgactcagccatggtggacagtgaaggaacatcacagagcagtttatagtgtgtctatggggggagattttaaaataatcattcaagagcagaggtcaggagggaaggaaatgtgtattggctctcattcctggaagcagcagattgagagggctctgatcccctaggagggggaaacagcttgggcagggcacagatagcacatgtgtaggaccagctcatctgagactcagacacttggatctggacacagatagctagaatgaccatcccatcatgcaggggtctccttggttcagagaatgtttgcctgattgtccctgggaactcaggaatggaggtgctacacagagattcccgtcagaaccagaaaaactcaggatggaaggttgtcttcatgcattctttctggacagcagccctacccctctcacctctatccctcccaccccccacctccccacaacctgcttcctaggtcagcacagtagtagatgactcagaatgtgctatctccagttttgcttcaagttccccaaggaggtcacaaaccaatcccaaaagacccagattgggacaagccttatcccactttttatctacctaccatcctgcaggttcctcaaattcaacatgtgcaaaattgaattatcacatgtccccaaaacctgtttccccttctagatatacaggaaggactatgctcaaaacctggactcatccctcgttccctcccacttccccccacttcccactgccaatatccaggcaggcttgaaggggtgccctagaatatgttaggaatccctccctttcctgaataccctactgccacaccatcctcatctgaacccccatcactcctcactggattgttgttgaagcctcttaactaattctgctgactgtgactcctcagtccatagctgccagagagagccttctaaagcgcaaatcctcccacaatgtctcttgcttacctgaagcccttcagtgttctcatttgcccttaggctgctagttgtccactaaaattaattctctacttcttccttaccaacagagtgtagcatttgttctaagaagttctatgcctagttgaaaatacgtgggttctcagacccccttgcagctagaggcagtcacgtgacccagtgtggcaaatgagatggaaatgaaactcactgattgaggctttggggaaagcttgttaaaggagcagccttgagctatggaaaccagtctggtagttcctcaaaaaattaaaaataggccaggcaaggtggctcacacctctaatcccaacactctgggaggccaaggcgggaggatcacctgaagtcaggagttcaagaccagcctggccaatatggtgaaaccccatctttactaaaaaaataataataatacaaaaattagccaggcatggtggcgctcacctgtagtcccagctacttgggaggctgaggtagaagaatcacttgaacccaggaggcggaggttgcagtgaactgagatcatgccactgcacttcagcatgggtgacaaagtgagactctgtctcaaaaaatagaaataaaaatagaactactatatgattcagcaattccacttatgggcatacctccaaagaattgaaagcagggtctcagagagatatttgtacactcatattcttagtggcattactcacaataggcaaaatgtggaagcaacgcaagtgtctacatctccagatgaatggataggcaaaatgtggtgtatccatacagtagaacattataactttcctcagggcagaaattatgactgaaattaggagaaaacttccttttgcctcctttgacatgcaaaagggaaagtgtctctctcatctatttaaatacacttagataatgcaaactgtacagtgtaagctatggagatatttctgtctttttagagcagctaagcagtccatctcatagaaagcggctcagaaacattgagatgcctctcctaagaatgatactgaaaatgtattcattttgactgcttccataagaaacaaaaatcaattcttggcagtgtcagggatttaaggcccaagtggcgattggggattttatcgaggatccctgcgacactaagccaataccttggcactggcctcccttccctcaggctggttggtgcatattacttcccaagttgtttgcatttttaggcctcaaatccttgatgtcttggcaaaagccacccacccgcactccactctgcccactcacttaggactcatagggtgccatcaggaaccattccatccagcctagacttaaggcaaccacatttctctcaaatgactgaatccggtgtaaaactgaatatggtgcatagcaaccactgcaggttccggcttcctagtttcttagtcctgggaattgagtcttggaataggcttcaaatgtctagaaccaactactgccagctggaagcatctggcaagcaaaataacaggagcagcctaatgaaagaggagcaggtcctccagggaggatcgcctgggaacactccgtaaccctaaggccctaatacacacacaacaacataacgaaagagcttctaagcagtcttttctaactagctgcttctatctgactcaccagcctctgctcttcttccctgttcaccctttccattatctgtcttcctccccatccccggtgaaactgaaccattcaatcccctttccctttccaatttctttactataatcttggctgacaacactcccaataccgggaagccatttcagagtttgtgtcctgctgctggtgagtcggaaggaaggtggcaggtcctccaaataggagggttgtacagagtttaaaaaacaaaacaacaaaacaacagaacaaactaaaaacagcaccatgctaccaggggaactcttctatctcattgggagttgtttttttctaatagctctcacatgcaaataattgaacaggctccacccttgcgctgacctgaaagtgagcacctccttcagttttgcatcataggtgcaggtacctcatgctcgtcctggccctgctcctaggcttgccccaagacaggctcagagaagcaggcactgaccagaacaactaagggttcctgctagatgaataagatcgagtgcccctggcttggagaacaaggggccctgcctcacaagccagtggtgatggccctcttaaggaagatagtggataaaccatatggaatccagaaatctgaatttcaatccaggagtttaatccttttttattttatttttattttttaagagacgggatcttgttctgtcactcaggctagagtgccgtagtgcaattgtagctcactgtagccttgaattcacccctgggcacaagaaatcctccttcctcagcctccctagtagctaggactacaggagtaagccaggtgctgaatcttaagtgcaaatattgctgttttcagagtcacagggtctctttgtggtattcgttttcagctgggtttgtgacattatgcctaggcatcttcagggcaccttaccaaagggactcaagggaaggtttaactgccccagtggtgagaacagtttatctaatcttccttaatggagcactcttaacctgcagttcttcatgtcaaccctaatccctgaggcaggacaactgactgcaaatccctgccctttctctctccctggcttctctcagtccactccccctcttctcctggagataggcattttgcagtgaaagtgacccttcttgggaacatgtcttggctgctgctaggtctccacttgggttactggtgctagggaagaacccagttcgagacaatccaggccacgaagcaggatgtgtgaatcgcaacatcctcagtcagtgaccaaggctcagttctcttgcagtttccttcccaccctgcttctgccaccagacatggggcttcctgcccactggcctacctctcccaaggttactacatgaagtatggggtattatatcttattagcttaactgcttcttccattattgtggttagcagttgctcatgaatacaaccttgcgtttgttttcttaaaacaggactttcagctaaatgacatgtgtggctcctgttccttcctcagttttcttgatgagaccatcacaaacataacttcaaaagaaatcctttataagcagactttctgcaggaacctggcaccttcacaggcaaacagggatgggctctgggtttccaaacaggaacttgagcagcagcactgatgccgtccactcagggagatgtgcagccagatgtgtggcttctgaggagtgactccagctggagtttctcccctcaccctagtagttccttgaccagcccttcattattctttagggtcagcattgctgtcaaaatgtggcccgtctccatcaccctccacccctccataaatattcatgtagtccagttcctcccagcttaagaggagggagtctatcagaggttgtcctctcaaactggaccaatccacttacttccctaagcctcctccaaggagcaggtgccagcttcagccttggtctgttctgatgtgtgctgcccacagtgttctccacttggcccaagccacatgtcatatctccccaggcactttgagggctcccttagggcaggaactctggctcattctcctccaggctcctcactcatgctccctcactcccacctgggatgctatagctgaatgaaggcttgaactctggagtgaatgcttgaccctggctggcgggaaggggcattgacagtacagcaggctgaaaaccaggacaccaggactcacctctcatccctgccacaaactaaccatgtggcgggaggaggtagcttaaccgttctgggccttttcctctcagagtcctcctaaagctcctctgcagccctgagccaccatttctcactgagagcatcagaatttcctcctcggccctgcagcagacaggactaatgaagcaggctagcgccatggacaagcggcctgcagagccagaaaggaactaacagtctccaacttccctactccttttccaagttctttccatcatggttgacataggcacttgctactctgagccacctcctggtgataagtggaaatgcagctgaaatgggctcctgtcctcacctgtcctaggtctccaaggatgctcctcaatgcccagcttgaagaaggaaatgggatggaaggagaggggaaagctgtgtggactgaggctgtggaggtcagggaagggttcgcagaggagctgggttatagctgaccttgaaggatgggaagaactcaataagtgaaaggcatcagggacctgcccaggtctgaccttctctaagacaacacacacttgggaagacatcgatctaattaccctggtagtgctgcttgcagagtctggcaccaggaaatgggtcaagtgcagggggcagaaggggaaggccacctcaagaagagcaggtctgggagcagagaaaagagcacctgggccacaccctctgccttccctccttgtgctaccattcaggtcagccctccttttgcgcaacttgcctactcaaggacatcacgccagaaattctcctctcctgcatcatcaatcttttcactgtctccaaatcattcactacctttcttgaaacactttctgcctctagaacagaaagttcttgcttttcttctcaccttgctggttgttccttctagtctcctatgctggatccttctcctctccccaaccccttaatgtacaggaactccaggacttagtactcacactcttttcttctgggtctagacccattccctcggtcatctcatccagtctgacggctttaatactatctatgtgctgagaacgctctaattcaagtttccagcttggactgtatcttttaattctgtatacccgactgcctactcaacatcttcactaacttgtcttgaatcaaactcatgattttcatcctcctgcctacccactgccactaaaacaaacaacaaaccatttatcctgcagtcttccccatctcaggcgatggcaacttcattcttcttttggctcaggccaaaaaccttgcggtcatccttgatttttctgtttctttttttcttttccttttttttttttttttttttttttttgagatggggtctcactctgtagcccaaactggagtgcagtggagcaatctcggctcactgcaacctccgcctccagggctcaagggattctcatgcctcagcctcctgagtacctggggctacaggcacctgccaccaggcccagctaattttttgtattttagtagagatggggtttcaccaggttggccaggctgctctcgaactcctgacctcaggtgatccacccgccttggcctcccaaagtgctggcattacaggcatgagccaccatacccagctgatttttctgtttcttgcaaaacccacaccaacaatcctactggctcctaccttcgaaatatatccagaaccagaaccacctttctggtctccactgctaccaccctaatccaagccatcctcatttacctgtattgcagtggctttctgattagtctctttccttccacttctctctatagtttactttctacacagcagctacagtgacctctttaaatgcaagcaaatcaagtcattcctctgctcagaattctctagggtaaaaattaaatccttcaattgttctatatgatcctacatgatctggctctgtgctttccttctgatctcatctctcccccacttgcttcctctactctgcgttcgcttcctttactgctccttaaatacaccagtcatgcttgcctttgggcctttgctcttgcccttccctctcactgggacactgtttccccagatgtccacagagttcattccctactttctccaggtctctgttcaagtgttacctttccaggaaggccttccctgaccaccctatataaagtggtgcccactatccccagccttggtcatccccaacttctttactctgcttgattttttttccttagcacttatttaccctctgataatattatatattacttggttatgcatttattgtctatctccctccatagaatttgaatcatgactttgttgtccactgctgtatttctgcacctagaatattgcttaataactgcttgtggcatgagtgtggctaaatgaaaagaccagaagttgacaagtacatggatagaaaatgttgtggtgttgttttaaaaaatagattttattttttagagcagttttagttcacagcaaaattgagcagaagatacagagatttcccatataccccctggtcccacacaggtacagcctcccccataatcaatttatggggtacatttgttaccatcaatgaacctaccttgacacatcatcatcacccaaaatctgtagtttacatgaaggttcattctcagtgttatacaaattatgggttttgacaaatacataatgacatgttcccaccattacagtatcatatagggtagtttcactgccctaaacatcctgtgttctacttattcattcatctcttcccctcaactcctgaaaaccactgacctttttactgttttcatagtttcgccttttccagaatggcacatagctagaatcatacagtatctaggcttttctgattaacttctttcacttagtgataggcatttaaagtctcctcaagtccttccatggtttgctagctcattcctttttagcactgaataatattctgtggtctggatgtaccacagtttatttatctgttcacctactgaaggacaagaggatgtccttggcaattgtgaatgaagttgctataaatattcacgtgcagagttttttgttggggtgtaacttttcaacttcctttgttaaataccaagaagcatgattgctcctcggtatttaacaaaggaagttggattctatggtaaaggtatgtttagttttgtaagaaactgccaaaaacagtcttttaaagaggctgtaccattttgcattcccaccatcaatgaatgagagttcctgtgcctctgcatccttaccagcttttagtgttgttagtgttctggattttggccatttcgataggtgtgtagtcatgtcttattgttttaatttgtattctccagtgacacttgatgtggaacatattttcatacgcttacttgccacctaaatgtcttccttggtgaggtatttgttaaggtctttggcccattttttaataaggttgtttgttttcttgttgagttttaagacttctttgtatatttttggatacaagtcctttgttaaacatataatttgcaaatattttcttctatctgtggttggtgcttttttccagatgagagacctaaacatatttatgtacccatgggaaggtagcaggagagaggaaacaggtaagtcccatgagggagaaggggtatgataattgacatgcagagatctctaaggaagcagaaaggggcagggcccagagcctggggagaccaccctttcttgggctggatgggaggaggtgaggatagggtaacaaggatatgagatgtgaaactgatgaaagcttcccaatggcttcattttcgttttttctgtaaaggacagtacgaggcaagatcatctgctgagagtgagggaggtgagagtgagcagagcccgagaagaggggtgaagatttaggggaatggctctaagaaatgggggagattgatcttctgggacacataacattgattttaagcagtgattggaacagcaataatcacacagcctctcccagctctgcttggagggttgcaggcaaaatcataattgggcaggtgagctgctgtggagaggcgggaatccaggcctccaggtccagggtctatgccccacctcatgacccatctctcttcagctgctcccccaccacgactgaagccaccagaccctggctccttcccaagttcaggctttctcatgactgtaattcaatccaagtgtggcaggatgggttcttcaggaagcagactctgagattagaatagggagtgctctgtggctcaacacctggggaagaaaagggagaaaaatagaattgggcaggggagaagttaggccacagtatagactcagcaaagaccttggccaaccgcatggggcactctgaagctggaacaacctctttcgagttgtcctgtgtcagggacagatctggcctttaatactcaagcacagatcagtcattggatgtggatcttctagaaagggggaagttattttgatccaggttgctttcttcagcagatgcaattcccaaagaggatttacagccgtgagctgtcttcctgcagtctttctagcacctggagggctaggtccttcaaccacaatggggatccacagcatctgccacagtactgaacatttaattagcccttattctatgcctgacctagcgtttccttcaaaagcagtggggggcttagaagcttcaggaacttacttgaggcatccaggtacaggtatcagactcctacacagcagtaagaggccttgggttctactcctagttcagctactgactcactatggtgatatcagggaagtctctgagctctttcaggctatttccctgtctgtatatgagggtcgagctgaagtccttgcccaatagtctatggctttatagtacctaaaatcatggatggcatattgggctgttctcaaattgctataaagaaatacctgagactgggtaatttatcaagaaaagaggtttaattggttcacggttcagcaggctgtacaggaagcatgaagctggcatctgctcagcttctgaggagacctcaagaaacttacaatcatggtggaaggtgaagaggaagccagcatcccagtgttcctttcaactcctccaacctttctcaaaatggtttttagctcttcccagaagcatgaatggtttctgcctctacaaagagacatgactggatgctgtatttgataggcaaggttcttggaggtcattctgtctattgccttgttttctggcatcagaggcagagatatccctatttcctagagagttatagtctcacattagtcattggcaactttggggggcttcatgggatttgaaagaggccagagtgcaagataaaaatgattagaagtctgcttttgctttgggaaggaataaaaaaccctcgcaccatcccccactctagataccccattccgtggaggcaagttcattcacatttctcaggacaatcttctgtccacctgcctcagctgctcattataggaacaggtttctgtagatggtttgtgctttttgtttttctaagaagaaacaatcttcatttttcagctctacattttgctctctgaataccaatgaccagaatgaaattagaaagaaagcggtgccaccactcacgtttctgaactaatgcagaatgtacagcagaaaatgagccaaacaacagttgggcctgatccttggagccacagcacggggagggtgaaaggccctcaaacatcacctactcctctattcccattttacagacaagaaaacaggaaagagtgaatgggatgaatgaaagttacaaagttgcacaagaatcactgcctctactaagtaggagattctttcttcttctttgtcttctttttttttttttttttttttttttgagacggagtttttctcttgttgcccaggctggagtgcaatggcgtgatctcggctcactgcaacctccgcctcccaggttcatgagattctcctgcctcagcctcccgagtagctgggattacagttgcctgccaccacgcccagctaattttttgtatttttagtagagacggggtttcaccatgttggccaggctggtctcaaactcctgacctcaggtgatccacgcatcttggcctcccaaagtgctgggattacaggcgtgagcaaccacacctggccaaggggattcttcttaagaagaaaagggagggtctcagaacatgctctcatatttgaaaatggcagaaaagaaacaaatagttttaaaaacaatcaaaacataacagggctagaaaacaaaatgaagaaccattagcaaaccagaaatattggagaatttttagaagacagaaagtagatggggcttcagatttttatcttggtgctggatggagtggactgcagattccctccccaagacttggccctagagatattgtataagggagagagggatgatgtacccagaatctgaccctgagaaacaaaaggtagatgggtcccagtcggctgagcactgcagcctagagtggtgacagccagaggtcatgggtcgatataaatctgggagagggctttcttattgcttttctgtcccccatacttctctgggtggagggtagcctgccctttcacctctgtgggcagaaaatatcaacacagcaccagccgaaaatagcaaggtaacctcaaggcaattctggggccagctgaactggctggtggaaaacagattcaatagatgaaggctggccaggagccatggagcagcctctccttcctcttctacccttggttgggataaaagacaaagcagagtgaggcagctcttggaaaagagcagcgactagggcagagggtctctggaaggtgaggcacttcactctggcttgtctgtggacaggtggcaaatggcgaatagctgccagaggctctgcaccctgaggcactcccctcatacctttgcctagaggagccaaagctggagccccgtctttaacctcactccttcccacggagtatacattattcaccaagatagctgacacttttaagggaagatgaactcagagccaaaacaaccaccaaatgaatgactagcaaaaggggtagtatgggccgggtgtggtggctcacgcctgtaattccagcactttgggaggccgaggcaggcggatcacgaggtcaggagattcagaccatcctggctaatacggtgaaaccccgtctctactaaaagaatacaaaaaattagtggggcgtggtggcaggcgcctgtagtcccagttacttgggaggctgaggcaggagaatggcatgaacctgggaggtggagcttgcagtgagccgaggtagcaccactgcactccagcctgggtgacaaagcaagactctgtctcaaaaaaataaaaaattttaaaaagtcgtatgaacagactaggcagaagagggatttaccataaggacaatatacatcctccaagacataagggaggacactgtaaatatcaagcaagataagcaatgatttaaaaataactagaaatgttggcaatgacaacatttaataaccgttacaacaaataactcagtagatggagtaaatagcagaatgtattcagccaaaaaataaattagagagttggaagatcaggcagaagacaatcaccaaaatcaaaaatattggggccaggtgactcatgcctgtaatcccagcactttgggaggctgaggcgggtggatcacgcgatcaggagatcgagaccatcctggccaacatggtgaaaacccatctactaaaaatacaaaaattagccaggcgtggtggcacgtgcctgtagccccagctacttgggagcctgcagaggcaggggaatcacttgaacccgggaaacggagtttgaagtgagccgagattgtgccactacactccagcctggcaacagagcaagactccatctcaaaaacaaaacaaaacaaaacaaaacaaaacaaaaaacagaaaaggtctaaaaatagaaaatataaagaaaagtgggccaggcgttgtggtggctcacacctgtaatcccagcactttgggaggctgaggcgggtggatcacctgaggtcaggagttcaagaccagcctggacaacatggtaaaaccccatctctactaagaatataaaaattagctgggcatggtggcgtacacctgtagtcccagctactcagggggacttgaacccgggaggcagaggctgcagtgagctgagactgtgccactgcagtccagcctgggtgacagagcaagactctgtctcaaaaaaaaaaaagaaaagttatatggatgataaaagtataagggcctacatccatttaacaggagtctcagaaaaagaaataaccagaaaaatattttaagacacaatgtccaattatttctcataattaaagatgtagggtctcagattgaacagagcccttgaagcatggccagcttttcccatggaacatttgccgagtgcctgaggggcatggaaggctgtgggagggacacagaataacaaagtgaaaatttccaccctcacagtaattaggagacaacaatctgtagaggaagggggacttgtgtcaaacgcacagctggtcccgctctcctatttgccaaaattgaagtcgtgttaagtgggaagctaaagagccaagctcaaacctctaagaggcataaatgaatgttccgtcgtgtgatatgtctgaggaggtagacttgacaagctctccatcaaaccagagactgagtctagcagaactacaattcaacctcaatctagtttattctctgatcatattgttgtgattggcctcttaccttacctgcctaataagaaaagggtaaaacgtgccgggcacagtggcttatgcctgtaatcccagcactttgggaggccgaggtgggtagatcaccaggtcaggagatcgagaccatcctggctaacacagtgaaaccccgtctctaccaaaaacacaaaaaattagccaggcgtggtggcatgtgcctgtaaccccagctacttgggaggctgaggcaggagaatcgcttgaacccaggaggcagaggttgcagtgagctgagatcgtgtcactgcactccagcctgggcgacagagcgagactccatctcaaaaaaaaaaaaaaaatgtataagttgtgtgaaaaggcagaaaaatataacctcactttctcaggagatgaaaagataataaagacccacagatgactcagatattgtagggcagaaaaaacattttaaataactattacaaatatgtttaaatatgataattgaaaatgcaacaaaatagttaaaaagaaaactttgtcagagaattgtaatctataaatatagcaaatggactttctggaactgcaaaatacagtatctgaaaataaaaattctttggatggatttaacattagacaggattagtgaactcaaaagttcatgcttgaatataaattatgcaaactgaagcccacagagaaaaaaaggatggaaataacagagcacatcagacatacaagaaacaatcaaaagtttgaatatatgtgtaaatggagtcccaaacagaggagagaaagaataagacagcagcaaaagtggaagagctaatgatcaagaaccctcccaaactgatcgaagacatcaatgtacagattcaagatgctgggtcaaacccaagcaagataattacaaagaaaaccacacctaagcacttccttgtcaataagccaaacaccaaagctaaaaggcaaatcttaaaagcaactagagaataaagacacatgactttcaaagaagaaaaagtaagatttgatgattttgcatcaaaaactttagaagctggaaggatattgaatgacatctttaagatgctcaaagaaaaaaactgcaaatattctatatctagcaaaaatacccttcaaaatatgagggcaaaatgaagatactttcagacaaacaaaactgcaataaagataatgggctattagtgaaaggatagtcaaataaactactggaatcaaatagagagtcacagaaacagacttatacacataaaatcaaatgatttttaataaaagtatcaaaacaattcgatggggaaaggaaaatatccttaaccaatggtgcttagagaattgaatatccgtataggaaataaaggacatcaaccgttgtctcacactatacacaaaatccaacttgatggatcacagacctaaacataagagctaaaataataatgaagctactagaactgctagaagaatatctttgtgatctcagagtaagcagttaattcttaaggaggatccagaaagcataaatcataaaagaaaagattaataagttagacttcatcaaaatttaaaacttctcttcatcagaaaccaccatcaagaaaataaacaagaaagctgccaagagaaaatattcacaacacatatatctaatgaagattcttgcatccataaaatataaagaattcttgcaacccagtaatttaaaaaaaaaaaccacaatttttaaatgggcaaaaactcagacattttataaaagaagatatacaaatggccaataggtagatggaaaaagtgcttaaaatcattattcatcaaggaaatgcaaataaaacaacaattaggcaccactacatacttgatagaatggttaaaatgaaaaagatttataacactaaatgctggagaagatgtagagcaattagaactctcatacattgctggtaggagtgtgagatgaaataattgctttggaaaactgaggtaggaggtgggactcaactccgaaggcagagctcagacaccagcccaaattgaggagtagctaaaagagaatggaagcagctttccataagacatgcgcaccagtgtgccatgtcagcttaccattgccatgacaactacccaacgacccagaagttaccaccctttttctagaaatttctgcatactctgccccttaatttgcatgtaattaaaagtgggtctaaatatgaccacagaacggcctctgagctgctactctgggcacactgcctgtggggtagccctgatctgcaagaagcagtacctctgccgctgctgtgcactgctgcttcaataaaagttgcgaataccaccagctcaaccttgaattctttcctgggcgaagcctcaaaccctcctgggctaagccccaatttgaggctttgcccacactacatcaaaactaatggtttcttaaaaagttggccaggccgtggtggccatgcctgtaatcccagcacattgggaggctgaggcaggcggatcacctggggtcaggagtccgagaccaacctggccaatgtggtgaaaccccttctgtactaaaaacatgaaaattagctgggcatggtggcatgtgcctgtaattccagctacttgggaacccgaggcaggagaattgtttgaaccctggaggcagaggttgcagcaagccaagactgcaccactgctctccagcctggtaacatggcaagagtccatctcaaaaaaaaaaaaaaaaaaaacaaaaagaaagaaagaaaaaaagttaaatatacatctacactatgacccaacatttccattcctagagagataagagcatatgtccacaaaaaagctttgtataataatgttcatagcagctttattcataatagtactgaagtagaaacaatccagatgctcatccaaaggagaaggaacaaacagtggtgtattcatacaatgaaatactactaagcgatgaaaaggaacaaactgctgatgcaagtaacaacagggatggttctcaaaaatactatgctgatggaaaacaaccaggcacatcaaagtacattctgctgtaattccatttacatgaaactctagaaaggcaaaactaacgtaataatgatagaaatgagggtggtggttgcttctggagggcagaaagattaactgtaaaggagcactggggactttctgaggtaaagaagatgctctgtgtccaccaaactgagtacagagtttactgaagatctatgaatttcactgcatggaacttatacctcaataaaaaatgccatgcttgatgaaggcacaaagccttgaaagttacagatgaggcaaggatggacaatatccccacccctagtcaatgtggacactgaagtaagacaataagaaatgaagatttaagatttgaaaagaagagacaaagctgtcattatattcaggtgacagatgtgatcatatgcatagaaaactcaacagaacatcatttaaaaaaaataagcacagttgcaatcttttaaaatatttgaaaataagtagcattcctctacatcagatattaccaagtagaaaatataatataaactgagataccattcgcagcagcaaaaaaaaaaatcccatctatactatatagcattgaaagataaacataggcacgaccaccaggtgcagtggctcatgcctgtaatcccagcacattgggaggctgaggtggggggatcacttgaggtcaggagttcaagaccagcctggccaacatggtaaaaccccatctctactaaaagtacaaaaattagccaggtgtggtggcacaagcctgcaggtcccagctactcgggagactgaggcatgagaatcacatgagcctgggaggcagagtttgcagtgagccaagatcatgccattgcactccagccagggtaacagagcaagactctgtctcaaaaaataaataaataaataaataaaagaaaagaaaagataaacttagacaccttaaaatcttaatgagtttatttgagcattctgcgattcatcagtcaacaccagactataagcaggtcagtgctctactgagaagatacaaaggagaaattttataaggtgctcatgaaagcaagacaaagaaaatatttaattggttaaagttggaaagtccgttagaagtttagctaacagtttctgattggtttagcctaagtttcattttacagtttacagtgagttggggtttggtttctctggtaagaacctcatgcattagagggtctcatcctaatgacatcccaattatctattttaacaatataaataagcctatcaaagaatatacaagaaaagttttaaaactctaataaaatacataaagactagaaaaaatggaaagacatgtcatgttagagaatggaacatttggggtgggcacggtggctcacgcctgtaatcccagcactttgggaagctgaacgggggcagatcacttgaggtcaggagtgaccagcctggccaatatagtgaaacactatctctactaaaaatacaaaaattagctgggtgtggtagcaggcacctgtagtcctacttgggaggccaaagcatgagaattgcttgaacccaggaggcggaggttgcaatgagccgagatcgcgccattgcactccagcctgggtgacagagcaagactccatctcaaaaaaaactaagaatgggccaggcatggtggtttatgcctgtaatcccagcactttgggaggctgaggtgggcagatcacaaggtcaggagatcaagaccatcctggccaacttggtgaaaccctgtctctactaaaaatacaaaaattagccaggtgtggtggcacacacctgtagtcccagctacttgggaggctgaggcaggagaatcacttgaacctgggaggcggaggttgcagtgagccgagatcacgccactgcactccagcctgggcaacagaacaagactccatctcaaaaaaaaaaaaaagaatggaaaattttaacatcacaaagacgttaattgtctttcaaaatcatctatacatttagtacaatttatatcaaaaggttttagcaacttaaaatattctgaaatacatagggaagaatagaaattcacagataattaagacaactgtgaagaagagcagagattctctacaaagcaaagatattgatagcgacaggaggcagagaaattctgcctgaacctgcagcccaaaatgaaaacttacatccctgttttcctgcttgaatattgccttttcaaaaaccacccatggcccacactgtcccccatcctgtgcacataaaaactccaggctcagccagtagagagaggagaagcagttgaatgtcagagactacagctggaagtcagagagaagcagcttgacttcagagggacagcttgacagtgtagcttcagagaggagtccagccaaggacagctggacttcaatggaagattaccttcccactttgtctccttttcagctcccctacccactgagagccactttcattggcaataaaattccccgcatttaccaccttcaattcaattcatttgtgcaacgtcattcctcctgtatgccagacgagaactcgggtgcctcaagtgtgggtgcaaaaggctgccacactgaccctccactgagctgttaactcttaagcagtccacagatggcaaagctaaaagggcactgtaactctccttctggggcttcagaggttgcagggacgacccccagtcactgctacagggcccacatggagttttgctcctatcagcacccaaaagcactcaccctggctcctgcacctgctcacatgtgctccccttcctacgagcggtggagcactgcgggctgagtaagtgaaacacccctttcgcaaggcctgggaaggggtcatgaaaatatcctgtttcaatattctacaaaaatatagtactatactagaaagaattggaacaaacatatagactagtgggacaaaaacagatttcataaatttgaaatataaaaatggaaccataaatcagtggagaaattattaattttatagttgatggtattaagaatattcgctccttttatggattaaaagaaaagatccctacttcacaccttaagaaaaaggtgaactctagctgtattaaaatttagatatggaaagtaaaatacatagttaataggagaaagtatataattacatattgtggctttgggatggggaaaggatttttaaaataagaccccaaaagcaaaaactttcatctggaaaaattggtgaatggatctacaccaacataaaggatttctacacagtgaaggaaggatgctatggacaaaattaacagatgaaggatggagagaagatattttcaatgtttaaaactgatgaggggctgggcgcagtggctcacatctgtaatctcaacactttgggaggccaaggtggacggatcacaaggtcaagagttcgagaccagcatggccaacatagtgaaaccccgtctctactaaaaatacaaaaaatgcagctgggcatggtggcacatgcctgtaatcgcagttacttgggaggctgaggcaggagaatcacttgaaccttggaggcggaggttgcagtgagccaagatcgcaccattgcactccagcctgggcgacaggagtaaaactctgtctcaaaataaaacaaaacaaaacaaaacaaaacaaatgtactccctgatgagggagtacataacattttctagatcctacaaggaactctaacaatcaacaacaaaagacagaaacaacaataaaaaataggcaaattatgtgagatagtaccattccacaaatatttcttcttctcctcctggatacatggctatgattagcggccatatttccacttgcctgcctccttgaagttaggtgtggccataggacttgctttgtccataaaatttaagtgacaagtatcacttctaagtagaagctttaaaagccaatgtgctgtttaccacattttctttccctttggtgtgatgacaagcaatgttagagatggtggccactccattggcctgggcccctgagtggctatgaaaggagaccactgctgacttgcaatgaccaagaaatactctttggggtgttaggccattatgattttatggttgtttaaggttgtttgtcaccacagcataatccatctatcctggttgatacagaagtggagtcctacctgccgtaatataatcaaaaatatggctttgaaggcttaggagctggccatcaggttgcaaggaaactgttagcaactgttgaaaggatggcgattcatgtttttgtcattctttctttcttcctttctttctttttctttctttccttccttccttcttttctttctttctttctttctttctttctttctttctttctttctttctttctttctttctttctttctttctttctttctttctttctttctttctttctttctttctttctttctttctttcttttttatggcatcttgctctgtctcccaggctggagtgcagtggcacgatctcagctcactgcaacctccgcctcccaggttcaagtgcaattctcctgcctcagcctcccgagtagctgggattacaggcgtgtgccaccacacctggctaatttttgtgtatatatatttttaagtagagacaggctttcaccatgttggccaggctggtctcaaactcctgacctcaggtgatctgcctgcctcagcctcccaaattgctgggattacaggcatgagccactgtgcctggccagtgattcatgttatgcagtggcaaaatattggaaggtagatctgcaaaaacttggaaggtagctctgaaaaggaagacaggagagagcataagtttttattgactgtatttgagataagctcagaaaataattggcaagtttccaagtagcaatgaaaggaaattgagaagaactagaaaactggagtcttgcaaagttggaagttgtgaataactgcttctcaaccctaacaagtaaaaggaaaaatgagcaggactttgaaggacaaagaccaattaaaatttcaggctttcaacaaggatcaaatttatggctgtttcatccagtgataaaaacctttgaatggatgaagatgtctcaaagtgaatgtcaactaagggtgagatattcaataattccttttaatttgacaaaatggttctgggaaaagagactaaatgtgtggcttttcccccaaagcctgataagcttaacaccttacctgcaattaagtgaaggggaagggttggggaaaggaagaaacaagaaatgtagcaaattcaggaaatatatctagaaaataactatagatgagctctgccatatggaactgactggaatcaaataaataagaaggctactaaattttaggagtgttgccaaagaaattatgagtgaaaaaaagtttaaatttgagtcttaaaggggctagggcacccaaccaccagtgggcaggaaatgggctgatggtttcttcagataatggagaagaaagaatcttccagaaggtagagccagaggaacaagaagaagaacaaaggacaaagtagctactcccagggcaggaaatcagggccaaagcaagaaccatgtgcatcccgaggagaggaggtggggaggactccatgtgatgtttcagacaactcccttagatacagaaggagtgtattttttctgaggggaaataaagcaaactgaatatttgttgaccaggaggacaaacaatggttgttattagtgctgttccccaaatatctccaggcctttttccttctgcacacacagtaggattgtacattttaaagcattaattagaaatttataagatgtcacggatgtatatttaaaacacaatgttgactaaaaaagaaaacaaggcttttagtaccatttatactagttaaaaatacaaacatacatgaggcaaaaatacattcatcctaagaagaggagcaggagttgcgatggtgcatgttaaagaagagatgatccatgacacttgtcaaggatgccatggtgataggtatagggaccaccgcaatgaggtcttgcagtaggggagagagactggacccaaccccaactccaacaaggacacgcaggaatttataaccaaggagcagggtggaggatcagggaattgaaaattactaagcagaaacatcagggctactcaacagaattcttgctgaagataggccagggtggtcagatatcagggatggtgaattttcattaaactgacttgaggattctagctcaaactggattcttcaatgacagagagaaaagcccaaggacgggccaggtaagcagaagactcaggggagtctgactaacattttggtgaaaagagactgcctttgtcatgcatgaagaccaaaataaataaagtaatagtattagtaataataatcagagaggaacattatagattgatgataattgattgctatgaagattaattcaatctaatgcactagaggtccataaaagcaaagattaattaatgaaggtggtatttaattggtggagaaatcacagcagagaaattcacatccgaaatagatgtagcagagatttgaaatataagttagagatgttttttcctcaaagagtttccaggagtcagcaaaggcaaggagcagaagtggaacttggagtcacaaattaaaggtctgccctggagcaactgagccagtcatcattctatataaagcagttggctgcaatgtttcactgcaggataaagccatgattaccactctctgattacttggagaatctgcctgggggactcttaggtcttgagatgagagaatcagatcaggacccagataattctgtaaattcaaaatgtaagtggaagaaagggaaaaatagaaaggcagcttcacccatgattgaaataaagcactcacctctaaaataaaaccttccttttatagcaattgtgggagctgatctgactgttactgaccttggcacactgagagcctcccatcaatcttataattaaggagaaatgtcagctgtggaaatggagtttcaattgttaagagaatgaatgtaagttatgaatcagcctagatttgtatttataaaatataaatggacaattaagaatcaatagacattttaggaaaccaacagtatggaagagaaaatccaagatgaacaaacaggatgtttaattatggaggaaacagagttaattcagaaaacagaagaccttaaaaatagtttttaaagtgaattagtgtccttggggataatcaagagcaaacttcacctacaaaataagaatatgctggccaggagtgatggttcatgcctgtaatcccaccactttgggaggccaaggcgggcggatcacctgaggtcaggagtttgagaccagcttggccaacatggcaaaaccccgtctctactaaaaatacaaaaattaaccgggtgtggtggcgtgcgcctgtaatcccagctacttaggaggctgagacaggagaatcgcttgaacccaggaggcagaggttgcagttagctgagatcacgtcactgcactccagcctgggtgacagagcaagactctgtctcaaaaaaacaaataaacaaaaaaaaaatgaaaaaataaaaataaaaaataaaataagaatatgctgctgtgaaaaggtagcaatagaaaaacaaaagaaacgttggcatttataaagctaattgccaaataaaattcaaaattaaatattagaagccaataatgcaatggccatgattaaatgccaattaaaggtctgaataaagtcaaggacatctctcagaatgaagaccataaaaatagagatgcagaatactggagaaaaaataagagctgtggaaggtagagctagaacagtgctgtccaatagaactttctgtgatgacaggactgttcattctgtgctgtccaatatggcagccacttgtcacgtgtgtctactgatgatctgaaatgtggctaatgtcaccaaggaactaaaattttaatttacttaattttaattaactaaagtttaaatcttaatagtcacctgtggcttgtggctactgtactgaacagcacaagtgtagaagagccaatggatgcttcatagaaatccaggagacacagaataataaacaggtcattcaaaaatagtccggggatggtggctcatgcctgtaatcctagcactttggaggccgaggtgagcagatcacctgaggtcaggagttcaagaccagtctggccaacatggtgaaacccatctctacaaaaatacaaagattagccaggtgtggtggcgcaagcctgtaatcccagctactcaggaggcggaggcaggagaatcgcttgaacccggaggcagaggttgcaatgaggcgagattgcaccattgcactgcagcctggatgacaacagtgagactccatctcaaaataaataaataaataaataataaaaaatagagaaactcggccaggtgcaatggctcacacctgtaataccagcactttgggaggccgaggcaggcagatcactggaggttgggagtttgagaccagcctggccaacatgacgaaaccccgaagctactgaaaatacaaaaattagccgggcatggggcacgtgcctgcagtcccagctactggggaggctgaggcaggagaatcgctccaacttgggtgacagagcgagactctgtctccaaaggaaaaaaaaatagagaagctcttacaactcaataacaaaaaaacaaacaactcaattttaaaaaaatgggcaggccgggcgtgttggctcaagcctgtaatcccagcactttgggaggcccaggcgggcggatcacgaggtcaggatatcgagaccatcctggctaacacggtgaaaccccgtctctactaaaaatacaaaaaattacccgggcgtgccagtgtgcgcctgtagtctcagttactcgggaggctgaggtaggagaatggcgtgaacctgggaggcggagcttgcagtgagccgagatcgcgccactgcactccagcctgggcgacagagcgagactccgtcttaaaaaaaaaaaaaaaaaaaggggagtgggggcaaaggacggccgggcacggtggctcacgtctgtaatcccagccctttgggaggctgaggtgagtggatcacttgaggtcaggagtttgagaccagtctggcaaacatcgtgaaaccccatccctactaataatacaaaaattagccgggcgtggtggtggtggtggtgcctatggttccagctagtcgggaggctggaacaggagagttgcttggacccgggaagcagaggttgcagtgagctgagattgcgcactgcactccaacctgggccacagagggagactctgtctcagaaaaataaataaataaataaataggcaaaggacttgaatagaaatttctccaaagaagataaacaaatggccaatatgcacatgacagatgttcaacatcactggctattagggaaatgcaaatcaaaaacacaatgagatatcacttcataccggttaggatagccattatttaaaaaaaaaataagaaaataagtgttggtggggatgtgaagaaattggaacccttgtatcttgtgggcggtaatataagatgatgtcacttctgtggaaaacaattggcagttgctcaaaaattttaatgtaaaattaccatatccagcaattccattgctaggtatgtacccaaaataattgaatgtaaggactcaaatagatccttgtgcaccaatgtccatagcagcatgattcacaatagccaaaaggtggaaacaactcaaacggacatcaacagatgcatggataaacaaaatgtgatatatacacactttatgggatattactcaacctttaacaagaatgaaagtcagatacaacatggataaatcttgaaaatattatgttgagtgaaataagtcagacacaaaaggataattattttaagattccacttataggaagtgccaagaataggcaaatttataggaatagaaagtagaacagaggttagcagtggctagggaaggaaggaatggacagttactattcaatgggttcagaatttctgttcaggacgatgaaaaagttctaagatggatagtggtgatggttgtacaacattatgagtgaacaaatggcactaaactgcacacctaaaaatggataaaatggtaaattttgttatatatatatactttaccacaataaaactttttttttgaaaaacagagtaatcacaaatactaagaataagaaaggagttcaaaataaagataaaaagggtaagtgtacagctaataaaaaattagtagatctaatttttcactaataaatttaatagaatggatgatttcccaggagatgcataaaataccaaaattgacggtaagagggtgggagctttttcctctacccacataggttctctggctggggctctgaaaattaactgagaaaaaacagattaacaagggaaaaacaaatagtttattagcatgtacagtgggcgtgtacccaggagaaactcagtgatatgatgaaaaactcaaagaggtggttagaatgtgggtttatgcatcttaacaaagaacaataaattcgtagagaagtgacaagtcaaaggaaaaaaaaaaaatcttaggctcccaaaggcagtaaaccatgggaaagtaaatatatgagggaaattaatggagtaaggtttgtttgtgcagatccatcttggcgccaacttcatcttctctgtggccataaaacttccctagaagaggagatttacagcagtcctcatttctcagaagtttctgcttctcatgagataagggaagctctgagatggcttctttctgcatctgttgaatctgaaataattgtatgccaaagtggcatgttttggagtggcatattttgatctctacaagacaaattgtaaaaaggagtcaaagaacgacattccgtccacctgccctgccctcccccaccaagcctcagggctgtggggttctataggtaagtacttcacaatttcaagaaaaaactaattcctataatatctatactaggggtttctaaacttgattgcatatcacaattacctaggtacatttttaaaaacatatatagatttcctggcttcccagactcaacaaacttaagtctccaaaatttggcctgggaatctatatttttcataaagatttttttttttcatttcagaagttacatttagtggttgtaaaaaacatccaacaatatacaaaagaaaaattgtctccccattttctccctgatcttactcctgctgaaacaaattttattagtttgtgtataaatgtaacaacttatatacatccttccatatttttcctgtgattatacgaagacaagtgaaatatgtactttaaaatatattcccaggtgactgtaatgcagtaagttactggatcaatatgtggatgaatttaaactatcccagggcatagaaatacatggaatgtgaaccaaccattctttaaagttcctgtaaccctgaacccaaaaccaaagaaacatgacataaaggaaaagaaaagctatataacaatctcatttatgaagatggatgaaaaattaaaaataaaattttagcaaagatgatggaccaagcacaaacatttgccttctctccctcctgaaactcaattagaatgccagtaaaagaaaatgagaacaggcgtggtgtctcacgcctgtaatcccagcactttgggaggccaaggtgggcggatcacttgaggtcaggagttcaagaccagcttggccaacatggtgaaaccccgtctctactaaaaatataaaaaattagccaggcgtggcggtgcacgcctgtagttgggaggccgaggtgggagaatggcttgaacccgggaggtggaggttgcagtgagccaagatcatgccattgcactccagcctgggcgacacagcaagacttcttctcaaaaaaaaaaaaaaaaaaaaaaaagcagaagaaaatgatctgattagagcagagaatgagagtagaccatcaccaaaaagagacgttctgagatttgcagaaaatagtaagtggagagaagccgctgatggatgagaagtagaagtgggcccactgtgcagagtaagtgaaggaagctgaggggcaggtacacccagcagagcccaagagctggctggtgaggaaagaaaagttatgagagcagagattaagtggaagtctttccataacaacttcccaaggtgccctccttagaccacgccctttgctatctctagtcatgtagagctcagctagatgggactaaccatagagaatacccttcccccagtgctaaaagtcaactcctagcccagtctcactatagtaacaaacttcatcttatgcccggaacaaacttcatgaacaaacttcattattatgcctggccaactttttccttccaggagatactaaatgggaaaacagacctagcttcatgcagtacccaggaaactcaaaactggtacccagaaaaatcaacacggtttctcttttttttttttttttttgagatggagtctcgctgtcgcccaggctggagtgcaggggcgcgatctcggctcactgcaggctccgccccccggggttcacgccattctcctgcctcagcctcccgagtagctgggactacaggcacccgccacctcaccaggctaattttttgtatttttagtagagacggggtttcactgtgttagccaggatggtcttgatctcctgacctcgtgatctgcccgcctcggcctcccaaagtgctgggattacaggcgtgagccaccgcgcccggcctctctttcttaaatataaaaaagcaaatgtatatcattgcacatacaaataaaagaaacagatcatgataaaaatatattttttaaaaaactggctcaaaaggaataaagaatgcagacaacagaaaaccgttacaaactatatttccagagagacttttaaaatataacatatccataaacaagtatagattgctatggtaaaggaacaatcatagaataagaaactgttccttgttattattaattttgtcgttgttgttatttactaagaagacaaggtctcactttgttgcatgggctggtctcaaactcctggactcaggcaatccttctgccttggccttccaaagtgctgggattataggcatgagccaccacacccaaccaagaaactgttcttaaaattttaattgtaatggctgaaattagaaatgtaatggaagaattggcagataaaggagatctcttagaacatagaggaaaaagcaaaagagatgggaaatatgatagaaaatataagagacaatcaatacagaaagtcaaacattcagaaagagaataaaagagcacagaaggtcataatttatctcaagtaataaagacataatagttttcagattgaaagagcccagcaagtattgcacataatgagtgaaaaagacccataccttgacatatcattgtgaaatttcagaacaccaaaaataaaattttttaaaagctcccccccaaaattttttaaactacttgcattggtgcaaaatcaaattaatagtggacttctcatcggtaacattaaatgccagaagaaaatggagcaatgtcttaagacttgtgagagaaaattgtttttaagctagcactgtataatacatccaaactatcaatcaagtatgagaacaaaataaggaattttcagacagacaaaggctaagaaagcatctatctcacatactttttaagagagagaatcttgaggatatcatcaagcaaaatgaaggtgaaaaccaaggaagaggaagcggttggattcttgatgtattatctatattgcaattaatggcagcttaaagaaataaggttttatttttcccacatcacagaatgtctggtcacaggcattttatgactggcttagcagctcagggatgtcctaagttttcctgacatcttctttttccatttctgccatccctagcatttggtcttcaccctccctatcacaagatggctgcagtaattccaagcatcaaatctccattctcagtgagaaggaaggaggaagtatgaagaccaaatttattcccattaaaaaggttttcctgaggccctactcagaaatttgtatctgtatctcattcgctagaattagatgggtcttagagtcatctctagctgaaaaaaggaatctgaagggcaaagcctctttctctccctcccttccttctttccttcttgccttccttcttgccttcttgccttctttctttcttttcttttgtataatgcctctctgtgggaaaaaatgaggttctcctagtaataaagaagaggagaaaaagtattgtgcaagaaactaacagaattttttacatacaaaatatttggttctaagagacaggaaactggcttaagcaataaggaaacagaaagtccagatgcagggcttccagaattagttgagtcattagctccatgatatcatctgaagctcaggttgtttccatatctctgttctgccaccttagtgttggcttcagcttcaagctgacagcaagatggctgccacaattccaggtgtcatatctaattagatatgacaatgtccagacaaagaaaaaggactgtgttttctgttttttcccgtcttagggacgaaaatctttcccagaagtccccttgctaatttattcttgtgtctcattagccagaattgagtcacaattctgaaccaatcgctagcaaaatgaatgggattattattgttaatctagactaatcctctgagtgggatgtgagttggggaatctaccagtgttcattacaatacttcctgtagtgctcatctggggaaaagagtttcactaagaccatactgtaacagatctagaagccaatcatttcatatcagaaaaacagatcagttggccaggtgcagtggctcatgccagtaatcccagcactttgggaggccaaggcaggtagatcaccagaggtcaggagtttgagaccagcctgaccaacatggtgaaacaaaaattagccgagtgtggtggcaggcatgtttgtagtcccagctactgtggaggctgaggcacgagaatcacatgaacctgggaggcagaggttgcagtgagccgagattgtgccactgaactccagcctgggagaaagaacaagacttcatctcaaaaaaaaggaaaaagaaaaagaaaaagaaaaacagatcagtagaatccaacaagaatgtcttcaggaagaagagtagaattgattctcagcaaaaatggtagataagaagctggaagagcttagtggcttagtcttacattagttttctcgacaagaggaaggtaattagaaattttaggaaagaatgtgtacaacaaagtcatggtccaaatatgaagcaaaatagaatccattggacctcgactcattcaagtattacgggtttgtattattgacctcataaagaaggaattgtaagttgatcacacagcttggctctgcagtaaatatttttttcttttcttttctttttttttttttttgaggtggagtctcgctctgttgtccaggctggagtgcagtggcgtggtctcggctcactgcaacctccgcctcccaagttcaagccattctcctgcctcagcctcccaagtagctgggattacaggcacatgccaccatgcctggctaattttttgtatttttggtagagacggggtttcactgtgttagccaggatggtctcaatctcctgacctggtgatctacccacctcagcctcccaaagtgctgggattacaggcatgagccaccgcacctggccagtaaatattttcttaatgacaataatatacattattttctattagttttcaacttttggaagtaatccctaggcaaagcacagaagatttaaatatgtttacacagcaaaatataaatggtaggaactacagcaatgtgggaataaagggtataggttattaaataagcagggagttggaagtcaggaaatagaaatgaagggaagggtagggtgttagcctcattttttttttttttttttttgagacggagtctcgctctgttgcccaggctggaatgcagtggtgcgatctcggctcactgcaacctctgccacccgggttcaagatcttttttttcaaaaaaccttttttttgtgacagtcttgctttgtcacccaggctggagagcagtggcgtgatcttggctcactgccatctgggcttactgcaatctctgcctcccgggttcaagtgattctcgtgcctcagcctcccaagtagctgggataacaggcgtgcgcccccaagcccagctaatttttgtattttttgtagagacggagtttcaccatgttggccaggctggtctcaaactcctgacctcaggtgatccacctgcctgggcctccgaaactgctgggattacaggcgtgacaccttgcccagccaataacctcatcttacacagtaattgaagatccaaagatattatcaaaagatgatggagtgactgggtgcagtggctcatgcctgtaatcccagcactttgggaggtggaggtgggcgaatcacgaggtcaggagatcaagaccatcctggctaacatgatgaaaccccatctctactaaaaaacacaaaaaaattagctgggcctggtggcaggcacctgtattcccagctacttgggaggctgaggtgggagaatggcatgaacccgggaggcggagcttgcagtgagccgagatagcaccactgcactccagcctgggcgacagagtgagactccatctcaaaaaaaaaaaaaaaagatgacggcgtgagaaatacattgtcaagtatactactgaatacttgaacacagtaaatgaagaacaacaacaaaaacatcacgtaactattcaaactgggaagagggatggagaaagtggagggtaggctgaatcttcatcattcatagcaggaagttgaaagattaaaaaaatgttggcttcagaatattatttaaccttatgaaagcaactagtagaagaactaaaagagaaacagttaaaagtagttaactctaacttgtacttcttcctatgaaggattaagtgctacaaaaattgcaatcccattataaacaactagtaaaccaagcaaaatatataaaacaacgtgggcagcacaggactgcaatccctgagtgaaggggcacaggtattgggagttctgcaattgctgccttcaggcagttttctggctctagcgcagggagagggacccatccagaaccaccagccttgttgagtttagaagacagagactggaatttggggaggctgaggtggaacctgtggggcagcctacagggaaggaggaagctgcacaccagaaagctctagagatctgcaaaaggatcctctaaactagtctttggctgagtgatgatctgtacatgcctggggtgaaactccaggagggtggggtaaaaaccactggaaaacagttgttcaaataattcctggagctcacacacagctagaactcgtttttgttcccatgagccagagtaaagagactttgtaaaatagagggcattctcagaagcagaaggccttgacagaagacataaatacacctagaaaaatggctgttctgattccgtaactgcagaaaaacaagcctcaaaaagatcaaactgatatgcaatagtttaactgcatgccaaacaaagcccaatactccttaaagaaaagcaacaaagggtagcaatcagcaaggtaaaatttaccatgtagagcatccagtgaaaaactaccaggcatacaaatcagcaggaagatgacctatagtgaagagaaaaatgcatcattagaaaatactagaaatgggctgggcacggtgactcatgcctgtaatctcagcgctttgggaggctgaggcgggattattgcttgaggccaggaattcaaaaccagtttgggcaacatcatgagaccccacctgtccaaaaaaaaatttttttttatttagcagggtgtggtagagcatgcttgtagtcccagctacttaggaagcagaagcagtaggatctcttgagcccatgaattggatactgcagtgagctatgattgtgtcaccctgtacgccagcctgggtgacagagtgagacagagattttgtctcttaaaaaaaaaaaaaaaaaagccaaaaacctgcaatgacaaagatgatagaattagcagacaaggattttaaagctatttttaaatcttacaaatatgcttaagatgaaaaggaaaacataaaaataacgaggagacaaagaaaatatattaaaagacccaaatggaatttctagaatgaaaaacacaattatctgaaatgaaatctatacaagtttggattgagagcaggttaaacactagaaaaaagaggtcagtgaatgtgaagacatagcaatatttacccaaaatgaagaaaacagagaaaaacgagaatgaaaaaaagtgaacgcctgtaatcccagcactttgggaggctgaagtgggcagatccttctcctccctttcccccctccccctccccctcctccatgataaatgtggccgggcacagtggctcatgcctgtaatcccagcacttcgggaggccgaggcaggtggatcacctgagctcaggagtttgagaccagcctggcaacatggccaaactccatctctataaaaaatacaaaaattaggtgggtgtggtggcgtaagcgtatggtcccagctacttgggaggctgagatggaaggatcctttgagcccagaaagttaaggctgcagtgaactgtgatccactgcactctagcctgggcaagagtgagactctgtctcaaaaacaaaacaaaaacaaaacacaagcctagtgattctatgggatgataacaagtgatctaaaatacacgtgacaggctgtgcgcggtggctcgcgcctgtaatcccagcactttgggaggccaaggaaggtggatcacctgaggtcaggagttcaagaccagcctggctaacatggtgaaactctgtctctactaaaaatacaaaaattttctgggcatggtggcgggagcctgtaatcccagctactaggtaggctgagacaggagaatcacttgaacccgggaggtggagagtaagccaagatcacaccattgcactccagcctgggcgacagagcgagactccatctcaaaaataaaataaaataaaataaaataaaataaaataaaataaaataaaataagtgtaactagagttgcagaagggtagaagaatagaaacttatgagaagaaataatggcataagattttccaaattcgaggaaagctataaacctatagatccaagaagctcaatgaactccaaatggaacaaatataaagaaaacaataaacatcaaggcacattataatcaaattgctgaaaaaccagtgataaataaaataattgaatagcggccagaaaaaaaacgacgtattatgttcaatggaacaaaggcaaggattatagtagaattttcaccgaaattatgccaagcaaaaaataatggaatgacatctttaaagaattgaaaaaagaatctgttaacttggaattctatacctgacaaaaaaaaaatacccttccttccttccttcctttctttctctcctttttctatttttttaagatgagatgtcaccatgttgcccaggctggtcttaagctcctgggcctcctgtcttggcctcccaaaatgctgggtttacaggagtgagccgctgtgcctagccaaaatatgtttcaaaagagaaggtgaaataaagactttctcaggcaaaagtttagagagttcatcaggcagaaggaaaatgataccagatggaaatttgcatccacacataagaatgaagagtatagaaatgataaatgtggctgggcacagtggctcatgcctgtaatcccagcactttgggaggccgaggcaggtggatcacctgagttcaggagttcgagaccagcctggccaacatggcaaaacaacatctctactaaaaatacaaaaaatagctgggcatggtggcatgtgcctataatcccagctacttgggaggctgaggcaggagaattgcttgaaatcgggaggtggaggttgtagtgagccgagctgggccactgcactccagcctgggccacagactgagactccatctcaaaaaaaaaaaaaaaaaagaaagaaaagagaaaagataaatgtgaatataagtatactaaatatgtttcctcctcctccttcttctttttttttttttttttttgagacagggtctcactctgtgacccaggctggagtgcagtgacgccatctccattcactggaacctctgccttctgggctcaagggaatcttctgcctcagctccctaaagtagctgggagtacaggcacaagccaccacgcccagctaatttttgtattttttgtagaaacggggtttcaccatgttgcccaggctggtctcaaactcctgagagcaagtgatctacctgccttggcctcccaaagtgctaggattacaggcataagccactgcgcctggccctaaatatgttttcttattttcacatctctttaatgtaatggactattaaaatatttttaaatttccattattatttattctttggtttctttttagaagtgtgttgttcaatttccaattctttgaggattttcaagatatctttttctttttgacttttagtagtatattcctttgtggttagacaacatagtttgcatgatttcactactttttatttatttttttttagatgggggtctcactatgttgcctaagctggtctcaaatcctgagctcaagggatcctcctgcatagctgggactacaggcatgccccaccgtgcctggcaataaatttaaatttgttgagacttattttatagtctggaacacagcctatcttagtgaatgctctgtgcgcacctggaaagaatgcatattctgctattattaggtagacgatgctattagatccagttgatggattgtgttgtatgtctcccatatccttacagattttctgtctactttttctatcaatcactgaaagaaaggtgttaaaatagccagctataattgaggacttgtctattttgcatttcagtttctgcttcatgcataataaagcactgttgtacacaccatttcggattgttatgtgctcctggtgaattgaccccattatcattatgtaatatcactatgattccctgataatatttcttcttctgaaatccactttgatatgaatacagtcattctggcttctctttaattaatgtctgcatgggatactttttcaattctcctactttaaatctatttgtggcttcatatttgaaatggctatctcagagacagcatatagtcgggtattatttttttaattcaatctgaaaatctgtttattagagtgtataaatatgtcaaaacatatcaaattgaatactttaaatatgcaccgttcattgtatgtcacttatacctcatcaaaactgtgtataatatttatttgatgccctgctttgtgccactaactatgctaaacactgagaaatatggcagtaaataacactctgtccttgaggagctcacagtagagaggaaacctagtttcaccccaagtctcacatctcatagcttataacacggagaagagagaaactgactctctttcctcagttttaacccaaaaattttccagggcttctggatggcctggcttgagtctggtgaccacccctgaacgaaacagggaaacagggacttgtaagaatggagtggtccaattagagctacgtagatgggagcacttctcaagagaaaatgtcaatactcagaaggcatctctgtttcaactataaccaaccattaacctggtaaaaaccagaaatgagtttcccaactgtgagaaggagagcaccaaaataaagagcatcttgggcattctgacactagccacgatgaggcagctcttttttaaagtcagaatctatgaaccctctttaaaacatcatgtaggccaatgctactgactttggcatatttttctgtggacctgcagggatgaaagttatcacatcaggtcttaccatggctttctcagctgatgaaggaaacgcttctctgcacaccctgtgaaggagcaggtctcaaagtgtggtctccaaaccagtagtatccacaccacctgggagcttgttagaaatggagattctcaggcccccaacccaaacctactgagtcagaaactctgggggtgaggcccagaagtccatcttttaacaaacatttcttgtgattctgctgaacactcaaatttgaaacgataacaacaacaacacaaccacatttgagcacctgttctcaattttggctgcatattggaatcacctggggagtcttaaaaatatactgatgcctgggtctcccctccagggattctgatttaattggtgtggtctagggttgggattttttaaggttccccaggtaatccaatgtgcatcaacattcgagaagcagtgcattacagcacattaaagtgcattactctgctatgcaagctgggccccatccccagatcaattgcatttaaatcgctggggctggaacctggacattgttgtgtatatctattttggcactggtgtttttttcaagctccctagttgattctaatgtgtagctggggcagagaatcacttcattattgtgacatgtgtggcctccttttacttgcttcccctcctggcttcaggaatgagttttctggtggacaactgaggcggaaggacttgagcaagcctgggaccggcgtcctacagagagcagatgagtggttctgcttctccatgctgccctaagttttccagtggccatgggagacttgtggttttcctgcactaccaacatctctgaataagtctgccaaattcaggggcaaagtgttagcaagctcacttggccagcagactaagccatgttctccaccattttgacctccatatgcctgactcctgtgtccgtctctcagttgtttccaagtttgagaagggattaaaagaatgccttgtattagccactaaaaccccaaccccaacagtggagagagcctacctcagctgtttagttgccctgccccatttgagcattggccatcatagtagagctggtacccaagatgctccctgaagaaattatgagcacctcaaacttctggggccaggaggtgaaacaacattataccagccttagcagatcttgaatggagaacttgcccaaagagagtgctttatcttcagataagactcatggtgtctgaggagggtcattgcaagagatcatcttccccaagaaagtgactcagccaccctcagcatatttcctttgaggtccaaaggacttgggttcaaattctggctctattacctgccagctggggaccttgaacaaggcattctccattctgaagcctagttatcttgtttatgaaatgaacatgattggtcgttgtgataaccaagtgaaataatgggataatgaatgctttatttttcctattgtgggaaatgctttgtaaactgtgaaaagctgtagcatgtaagacgttgttataatgaactcgtgttctagatggggagactggatgtggagaggtgcaaaattagcccgtcatgcaaggcttggtaacatttttcaatggtatagggaggagctttataggtattgggaggcagaaggaagcattgagggctggacatgcagccttggcaattgctagagagtctccttgtgtggagggagaactggtcctccctcacaattcattgcattgttctctgtgctgcattcactttctacttggagacaacagccaccacaccatgaccttaggggaggcttcctggccatttatgttctgacccaaaggacaaatggcccttcccttaattctgtgcagcacagctgagcctggaggaacagctaagtaaaacgttactaatagaaggaaatgatgatggagagtaacatgtgatcaggcttataggtagcacagcttaacgactcattctgctttaatatattacggtatttacagatagatttcttttattgacaaataaagaggttctggactagattttgttaaagaaagctacaggttacctcatagatgatcaacatcttaaacccttaatatggtcctcaaggcattgcctgatatggccccaatgcccctccttcagcctcagctccttttgccccgcttctccttgctgtttgagctctaggcacactgggatcctccgcagaccttgacaatctccttcctgcttccaaccctttaaacctgcctggaacagacctcccctacctaggcctaccttatctgtgccaggctaattcttttttgttcatttgttttttattttttagtttatttttgcctctagatataattttttgttgtttattattttttagcctgactaacttttttttttgagatggagtcatgctctgtcacttaagctggagtgcagtagtgtgatctcagctcactgcaacctccacctcctgggttcaagtgattctcatgcctcgatctcccaagtagctgggattacaggtgtgtgccaccatgtgcagctaatttttgtatttttagtagagaaggggtttcaccaagttggctagactggtctcaaactcctgacctcaggtgatctgcccaccttggcctctcaaagtactgggattacaggcgtgagctactgcgcctgacagcctggctaactcttaagcatccttcagagcacagctttgctgtcccttcctccaggagcctttcttgaccactcctcccacctcagacatagttaggtttccctgtaacatattcccttagcatccaatatgtctactcttatcatggaccaaaattatcattaagtaagcaatggtatcattgttgttcaatgtctatgttccctgtcatcattgtataccatacccttgcacagactatgcacccaacatttgtgaaattaatgaggactgaatgaatggtgaacagagatggttttccagaataagtggaattagagtcgggccttgaggcagaactggactccaacatcatagtgacagactgaaaggagcactggattgagaggcaagagtctgagattctgagtctagctgtatgctttgtctattcattcaggagatattcactaaatgcccactgccaggcactgtagtaggtactggagatatgctgcagtttgccatggttactatggttaccacaggactgaacgaaggaggatgaatacagaaatgaaaacttaaaacaaaagaaaccgttttaaagaaggggtccggggaagaagaaggctccctgcttctagtgagcaaaggcagccctgagcttctacagcccttcgtatttattgggtagaaagagcagggaggaggaggtaacgattggtcagctgcttaattgatcacaggttcacattactgctaacaggcttcagatgtgcctaaccacaagaaacactgcttggggcgtgactgccctcagcattccttctgggcggcagacgcagtttgtcagtttgccaacatcctgctttcatgaaaacagtttgctgtttactcacagagcctccagtggtatactgagttgatcatgaccctcattctttcagcctgcaacagagatacagtggtaaataatactgataccattggtcatggttccctcctcctggaggtctagagaaggattcagatgcaagttgaataaccacacaaataaatgtaaaatcccagctgtgataagagccatgaagatatgcatggaacaatcagtgtgtttaagaatgagatttaggccaggcatggtggctcgtgcctgtaattccagcactttgggagactgaggtgggtggatcacctgaggtcaggagttcaagaccagcctggccaacatggtgaagccccgtctctactaaaaatacaaaaattaaccaggtgtggtggtgcatgcctgtaatcccagctattcggaaggctgaggcaagagaatcacttgaacccggaggcagaggttgcaatgagctgagatcatgccactgaactccagcctgggcaacagagcgagactctgtctggaaaaaaaaaaaaagaaagaaagaatgaggtttaactgagttgtggagcccaggaaaggctttgataaggagatgtttttgttttcatttttaaattgaggtgtagcttcgataagttttgacaaatgtatacactaacgtaactatcacccagatcaagatacagaaaatttttatcacccagaacatcccctgtgtccctttcagtcaataccctccctgtcccaggaaaccactgaaactgatctgatttgtgtcaatgtaaattagttttgcctattctataactttgtagaactatgctatatatatacatacattttttttgtctcactttcactcagtatcattcttctgagattcatccgtgttgttgtgtgtcaataatttatttacttatttatttttcctgagtagtattctatcatatgactagtccacagtttgtttatccattcatctgttgatgagtatttgggttgtttcctgttttggctattatgaataaagctgctatgaacattcttgtacaattcattttgtagacatatatttcacttctcttgggcactgagattcgggagtagaattggtggtcatagattagatatgtatttaacttgatggaaaactgtcagcagttcttcaaagtaattttgccatttttatctgcatactagcaatgtatgagagttcctgttgctccacatccctatcaatatttggtattttcaggtttaaaaaaattattattgctattattattttgagacagaatgtcatcctgccgcccaagctagagtgcagtggtgtgatcttggctcactgcaacctccgcctcctgggttcaagtaagtctcctgtctcagccttctgagtagctgggattacagatgtgcgccaccatgccctgctaatttttgtattttaagtagagacggggtttcgccatgttggccaggctggtcttgaactcctgacctcaattgatccacccaccttggtctcccaaagtgccgagattacagccatgagccactgtgcccagcatttaaaaattattgaattaaatatgtgcatgtgaaatggcacttcactgtggtttaaaatttcatattaggagagatgagttgaagctgagatctaaaggatgagaagtagaccaggtaaaaaagatgggttgttcagtatttggggcaaagagaacaaaatatgcaaaggcccccaaggtgagatgaagcagaaccatcacaaagaactgaaagggaatgtggtgtggggtgaggctgctgggggaagtggtgggaagcactgagccattcaccttcaaggaatcacgtggatctgctcaatgttcctaccagcagtcaccatggtgaactaaaaagcaaataaaaaggaatgtcctaggctgtgtaaaacaccaggaatttcatattatcctgggaagtagtcacggaggctcataaaagccaacattgaatttcttgtcatctcagcagaaaggtactcagactagattaaatctgatttatagaaagaaaaaaatgaggcatttctggcaagtgaccattgtagttgcaaattcatgcttatcgcatatgaaagagtaggattgctgagtagtgttgaatatccttttgaagtttgagatcatgaatttaaaatgaagtcatttagaaggtttgtatgatttttctctggcaacactcagctgctcaggtacaggcatggtaccttacttcagactatagtgctcagtcaggtcgtggtttttccaggaaagtatgttgaaagttgaggtgggcaagggaatgattataatgatgaatcatgggctctaaattggaccaagaaagaaatgaagaatggataaagacaaattggtggtattagcagattagtggtctcagtgaggttgaagaattacagcaaatagggtattagcacaaggaactgaaaggctaggtgttggtgaatggacagtggggtattacattttcatatttcaaagatgaagtactttttgggtgattaaagtgttgacagtgtgagctcagaagtgttggtttaattgaggagaaagttgttggacgtgagaaggtaaaaggattaagagatcaggatactgaataggtcacgaacatggatgttgaactcacccaaggatgaagttcaaggatggtgccagcaggcatcggaaggggcagggaaaagattacattgactgggaggtcggaggatgacaacaatcaagatgagtggggtggtcatctgaatagcaagagctttaaaggggcagagatatttacaagagggaggaaaccattaggaagttcaaggtcaactctaggaacagtacaagccttttgactaacatccttgagtgaatcacgttcaaaccaaaccacgcgaagcctttcagttgggaatgctgtattccagacctttccaccagggggcgcgatcagcaacggagagcctaactacaagcagtccctcgaggccaggtaagtgtgtctcagcttgagctctgaggacccctagggctcttctaaggtattgcaaagagctcagccatcctctggcacagccacacacacttgcagagattttttttttttacagtgtatgtaaatcttgaacaacaaaaaaatacaaattcctaaattcttttaaagaagttactgacttaggccgggcgcggtggctcacgcctgtaatcccagcactttgggaggccgaggcaggtggatcacaaggtcaggaaatcgagaccatcctggctaacacagtgaaaccccgtctttactaaaaacataaaaaattagccgggcgtggtggcaagagcccgtagtctcagctactcgggagggtgaagtaggagaatggcatgaacccgagaggcagagcttgcagtgagccgagatcgcgccactgcactccagcctgggagacagagcgagactccgtctcaaaaaaaaaaaaaaaaaaaaaaaaaaaggaagttactgacttagaccaggcatggtggctcactcacgcctgtaatcccagcactttgggaggctgaggcaggcagatcacctgaggtcaggagtttgagaccagcctggccaacatggcaaaactcttgtctctactaaaaatacaaaaattagctgggcatgctggcggatgcctgtaatcccagctactttggaggccgaggcacaagaatctcttgaccccgggagacggaggttgcagtaagccgagatcccgccacttcactccagcctgggcaacagagcaagactccatctcaaaaaaaaaattacagaattattaaaaggtcttagttattatgtattttctcgatgaaaagtgacaaagtacagctactatcatgtggaatttggtgacatttctccctgggtaaaagggttttttcataactgcaggttttgagagttgactggtaacacccatacttaaaaatgttcttcccagatcactttttgcaagcatgagataagaagaagaatacaaagctggagtcagaattgtagtagcagcatcaacatcaacatgagtgtttactatgcaccagaaactgttctaaacattgcacataaatttactcatttattccttctataatcttggaaggtaggtgctatcattagcaccatttgacagaaaataaggtccagagagattaggtcatttgcctaagatgacagagctcctggatggtaatgttggtgttgtggacttgaatttcatctttccattagccggaacagtctatgttatgtcacaggaacaaataccccttgaatctcacagtttaattcaacagagggtacctgttctgtatgggttagcaggggggttaagcttattatgctaactcagggactaatgctgacacaaggttcgttttgatatatgctttcatcgtcatgatcagtaatcactaccaagacgaaagagtatgggaaagagtctaaactggaaatgaaatgcttctgcttgaagcaatgcatgttactttacacatttcactgacccaagcacatccaatgccactcccgacttcaaggggacaagaaaatgcacttctaccatgagtctattaacaagcaaaccagattgttggcattaatgattaatacaaacattctgagagctggagccgttcgtgtcctcctttggcttcagcttccctatccacaaaaagaccatgatcattttgtaagaatctcttgttgtaaggatcaaagagccacatttgttacagctataatgaggcagaatggttgcatccaaccaaagcttccatcagctgaaaatcttgatcccaccacaggcagccctgtagccctccttactgggctgtctgcagaatggcctttgtccagatgaaggtacatgccaatctttttgtcactcacacacctgaggttttgaaggacatagttttcacttcaatcaacaacatgccatagtggtcctggcctttgctagaaattttggtctggaaccaccagctgttcagttcctgttgaaagttccagaccactttagcttgatagagattgcgagggtctccttcttccaggtcctccaaaccctctctttaaatcaagtcaggccaccaggactgtttacttggcccctcagagtttccacagacactcccaggacgtctgctgtgagtcagggatgagctaagccatagaaattcctttgccaaccacaagccctgagggtagtacaaaaaatacccctaaaaagagcatttcccaaacttctatgcaaacagtagtaaccacactgccaatcaccctccagagtgctttgctagatcctttcctatggggccatttgacccttcctcactcctctgctagcctaggcagtgcactccatgaggacggggactaccttttcatgtgggtttcactatgtgcctggcacacagcacgttctcaataaatgttttccgcattaagacgcttcttaggagtcttcatgtaagttcatacacgacttccttgtagaattgtgtcaatgaacatgcaattaggctagctgaacttcaggccctgagagtctatgaagctaaaataaggcccagatgtggggtgggagggggagtaggcagaggcggcaaaggaggacatttcaggcaaagggagcagatgtccaggcaggaaagcacaaggtaacgggggcacagggggcgcaccacttttcctggaaggaaaaaacagcagatgagagaaggaggttggagccagttaccagtagaggtctatgttcaaagtccagaaggaagaaacagcaggacggggacaaagagaggaaggaggaaaggaggcacggtgtatgaaactctgtagccaagagcgctaacaaatgaaaggcaggatgggtggaggaaatgtactgtgttccaaagcttcctcttatttatgggtgctcccgggccacagaggagtaaactgaaggacttcccagctccccactgcccagagagctagcggagtcccgcctcgccccgtcacatggccagaggcgccctcggcacgtgacctacctcgcgctaggccaatcagcctctgcaggggcggggccaccgagtccgcggggcgggagtctccgtcggagccgcctcttctcgcgatccttgcggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacggtaagcggggcgccgggggcgggccgggcgggggttgaggggcgccggggccggagggggcccggctctggcctgaggagacgctggagctcggggaagggggccgagtgggcgtctgaggggctgcgggtccgagaggaggtaccggctgcgggtttgaggaggcgcgggtgtgaggaccggaggctcctatccgagcggcgggggcgtccggggtgagcccgaggtgttgcccactcggaggctccacgtcgtggggctcgtcgtgccgggtcggcgaggggacacggaggaagccgacgtggggagctggagtagcgggggcggatgaggagggggcgcagctcttagggagggtggcacaagaccggcgtttgtgttccgggcgacggggatggtggtgtccgtcaggccccccgggagctggggtcgtccaggattctactgaggccccgtaggactggtgacatccttaaaaataagggggaaattggggggaagagagtcctgaggaacactaatggtgagctgagtactagagaccaaaggagggggtaaagaatcagggaaccttggatctagggatagagggaaggtgggtgggaagatgagggagtgggttgactgcagtaggggacctggagagagaagcagcagtgtctccaaatgagctgggggaagagggctgggtttgctaaagagggtggagtgctgggcattctagggtagtggttgggagagcaaaaaggagtttctaaataaggagaggaaaatgagcagaggatggagggaaagggttggaactgaggtgggggaatatttattagagaagtaaggaggcctgggtatagagatgggggtgggggaagacgaaaaataagggaagggagtaaaatgcaggaagtcgggggtgtaatgttggtttgcagtgtggaggataaattagggaagggaggagttgggatgtggcaaatgctgtatgatattggtcgggcctttgggaaaacagggacacatagctgcaactaattgcagtggtgggattgagggcagtgactggcgacagggagatggggaagtggatttttgagatttaaaagtttcaagacagaagagacgttatttccgaggaacatgaaagtggcccctgggaggtggtacagtagaaagcagagaattactgggttttgaattgaagctcctttgagaagatggagaagtggtggggaatcatgggcatagggacctaaacagagcagattctgattgaagacatgtgttagcattcagctgctgaattgatctttcacaagtgagtctaggattgtgaacctgtttctgcccttgtggaaacagccattaagaggttaaagaatattttttctgtgaaggaatttatgagaagtcagtactggagagtgaactataaattatttttgctaatctttcattgtttattgttaggccagaacaatttatgattactcttattagagaggctgcaatttaaattttaaaaaatcagtgatagagccagtggagttttttgagaaactgggtttaaaatgctgaatgttagagtttgtttcattattcctaaaacgaataaaggattgacaatatccatcagttaaatatgtgttcgtagtaccaaattttatgtgtgcttcatggccttggatatcactgcaggggtcaggaaggaaacattttttctgtctctagcattgaatatgctaagtgtattgggtatttttcctgttttcctctaagcatgagtccactgtggaaggcagggtagagttagtcttatttgtcttatcagtttttcgactgtgtcaacatgacttaaagaagcctaatgctaattttagctattcagtttatggtaatagcatagtttcattttgcacaataggtgagagattcttgatcttaacatgtttaatctctgctggcttagcttttttccaatgatttataatacggtaaaattgtagtttcttagcaactaaagcaaggtttctggataggcctataaagactcatctgtctgctcagtgatatgtgttctaaatacagcatagaacggcctttcccttgaaatgagcttgaattcagtcacatgacatgaccgatgaaatgaagctgagctgctggttgacccaaatgaatgtaaatttaattcaaggaagagatggctatttttgagtttgagttcctatagttatggatgccattttatagctttctatataacatgtcttattataatattcaagctttcagctggtaataaatagccctgcagtgatctgacttcatgtcatggagtttgtgttttcttacagtgctttcaaaaagggataccttgcttgtgcatgatgttgaaatgttagaaatgttagattttctatttaaatgactggagaaaaaaactcacaagtatctctgaattgggaatgtagtagtttagattgaatatagatgtttttcaaaaggcatttgtttcattattcctaaaatgaagaatttggcctgtatgactctcaaggtctcttgaagctccagtgagtttctgacccattgttgtggacattcagggctttcattcagatggattttgtttctcatccaagaatttaaacttgtaagaccaattccaagtaaaatccttatttgttgacttctatatgtatcatcaaaatggtagtttaaagaggaacttgttctaaaaagtaaccttataagacattcaaaagcattagactgcaattgagtgagtgtaaacaaagcagtataatgtgatgatcaagagtgcaggctttggacggtgacagactcaggtttgagttccagctgtcagtagctgagtgatcttgagtaatgcaaacttcagtttcatcagttcatcatctgtaaagtggagattacaatcatgtccattccctagggatgatgtgaggattaaatgagataatgaccgcttagatttcagcctgagtctcagtacatgttagctattactactatcctttaaaaaggagcattattttttatttatttttcttcatgtgtatattgaaaacttgattgttaatgctgctgtcatggtaaataggccatttgaaggccccacatagagatttgtgcttttgcttatgtaactttctcagaaaagtgaccagctgcactgtgtctgcaattgccaattctggtgaggaagttaatatttttatttgagtttctgggagagactttatggcttttttttttcttttttttctgtgaaccaaatctttcaagtgggccaggtatcactttctcatagagtattattgttgtgaataagagaaatagagtgtggtacccggcacacagtgggagtgttatagatgttagctgaattaatgaatgtggagtggtgtgtaaaaacgtaatatattcatatggaaaatatgacatcacaaaattaacactgttcaatggaggaaaataaggaatctaatgaatcttatttttaacgacctaaattttagaaaccattttgtttgggtgatactagatagttgtgaacattgtgctttgtaataatgccagtatttgcattagatgattcatggatctttttcttttctgtcaagggctgtttgcttcagtggtttagcaattttctctcactgagtacatttttagaggtgtatttgctaattgattgcgtgtttcctctttgaactgaaatgagcaacagaagacacatcttatctatggcagctgtggcacaaatgacatgccgaatgtcaagcaaaaaattttgaaataatccaaataagatttgaccagaagaaatagtttgccttgacataaagcccttcctaaggagatcacaggctttcagtctctcaggctactggctaaaatgtcactactgatataatgcagcacccaggcatgagaaattggttcggtctgggaggataggccatgttactacatcaggacccattccctgggtttgttttacaaggttactggatccaaattagaaagagatacagatgggtttttgtgttgccagacgcagtagagcttaacttgtgaatataccaagatttaaaaccacaaaaggaaataaaaccccttagatgtgaggttggaattcattacaggtctgacttcgcttgattaatacagatccttatgagaaattagactgttttaagggaatcccattgttttttctcattaatacagatttgatgtgaaacagtttcttttgtggaatatgcctttagacattaataaaaagcaacattatattatctttattttaactttaaaataaagtttaaataaaaataattatttaaattaaaaaaagatttaattgggccttgaaagatgaccaaatgtaattagaaaagtgctctgtcagtttgaacattgtttttcattagtctgaggtactttttaaaagtaagatgttttgtgtgtaaactctgaaacttgctgggtctgtgtaaaggttttttacaacgattcgggaaggagataaagtgctaatatctattaaaatgaagtatgtagagaaacagtgagtgaccatgttggataccatacaagagatgttcaacaaaagtttgaataaaattatgcagagtagttttggaaaagtgaattttatgaaaatcgttctgatgtattctattcaatttactgtttgcagtgagagtacaatctggacaggatcagaagtagagaatgaagttgtaagagaaagggaaagacagaagaaaggctgcagtagtacaaggagaaaagcaggatgcaagaatgaggaatgaatctttgtttgaggagcatccggaaaaatataagctgtcagaaagagtaaatagaccagggacctctaaagtaaattcacacatcaaagttaaaataatgttggagaatcacctcctgtgaaaaattggcttagctttcagtatgcctctttaaacaaaacattatcattttatacaaatttttaaaatgttgttcataatatggagtttaattttaagcaccttagataatgcatttgtaagcttgtttgtgaaatttttatggattttttttttcaaaattcctaattttagttggtaaggattaacttcgggaagacaggaaacccctccagtaaaattaattggttataaatggttacatattttaggcttatatacataacaaaacttcttactgaatttaaaagtgatcttgtgtaaaaacattattctagtgatattgatgtctaaatttaaaagagtgaatacacaagtaaaatatatctgctttttaaggatctattcagtttaggaaggagagtcaaaatttgtatttaatttcaatttattatattgtctgaaactgaaagtaggcctaacttttgtttgcttttgtgtatgtacaaaggcaaacatttatcaatcaactcttattaatttgagattattttgacctgattgctcagaacttttgtctatctgtatagaaatggggttttctaaatatttaaagaatttcctacgtatgtaaatttacttgcacacagtaagttaggggagacatttaatattcctcagatacctgctgttttcttgttgtgtttcttgtttttcaaataaataaactgagtgttatctgttcattaaaatagaatgtagtcagctcgagggaaacattttgtattgagtttcttgtactaaaaagcactaaatggtattctcttgcatttctgaaacaattatggaatgttttaagactagccttcctaccaaataatcttaactactggagctttatgatatactttatggtattttccagaaatatgtcaatttttttttaaagatggagtcttgctctgttgcccaggctggagtgcagtggcatgatctcagctcactgcaacctccaccttctgggttcaagcaattctccctgcctcagcttcctgagtagctgggattacaggcgccagccaccatactcagctaatttttggatttttagtagaaatggagtttcgccatgttggccaggctgatctcgaactcctgaccttaggtgatctgcccacctcggcctcccaaagtgctgtgattacaggtgtgagccactgtgcccggctgaaatatgccaatttggatatccttctcttgccttattaaaaatcatcggtcacccaggtattacttcaaatttactagacagtgaaatataaatgagatggtatgaaatcactctgaaagtattagggttggatatattatgtaagtttctataattagaaagcattaagtcccaaatcgtaccaatagttttaatcatatctaaatggatactcacatactaaatgtgattaaatataaaatgcataacgaaatgtcacatcctttcctgatagaatactaataaggcatagtatttcatgtgcaggaagatacaggaaaacacacaagtaagagtttgttttgcatatataaattgttatgcctttgagattcttttcttcctgatggtaggatttggaaaccattggactagatgatgtctaaatttcctttcagttctaaaaattactaaatatcttgcccttatagcttagatactgtctccaataggttaaaggctcagagatgataacactttctgtttaaaagtttttagaaacttacttttgaatataatgaaaattaactttgaggcatgcactgttttgaaatctaaatgcctctaaatctacttcagacaacccttgcagttcttgtttcaagggaggcagaaccgtgtctgttatgcagagatcttatattaaacttgctgggaaaattgccagtgtgaataaagaagtgaatattcctgccaggtaggtaggtattttatgatctttctgttggctgaaagtggttgactaataaagagacaatgaaacacacttaactatttgtatttttatgttatctttcgagaaagtttgttttctatatatgagttagtttctgcagtcccttatgcattttttaagacctggaaatccgtccattatagtcgaagaaggcaaccccaagtgttaactgaattaaatcctagcaagttccttgattgttattccttagaaacattgtgtttaaaggtctcaagttgtaaacattcatggtactactttgttatctgttaggtccatttcttttcctttttttcttttagatctttagaatttcaaacatgtacaaaaatagattaagtaatgaataaacccctgtgtattcatcatctagtttcagctacacccttgctacttattaatttaaaaataacctaaaaattacattgcaaactagaattttctaggacctgaaatgtagtcagtaggggttagtttatatgagtaaaagataatatttggttcacatgtaatcatgttgaaattacttgaaaaataaagctcttggccggacgcggtggctcactcctgtaatcccagcactttgggaggctgcggtgggcggatcacgaggtcaggagatcgagaccatcctggctaacacggtgaaaccccatctctaccaaaaatacaaaaaatcagccaggggtggtcgccggcacctgtagtcccagctactcggggctgaggcaggagaatggcgtgaacccgggagccgagaacatgccactgcactccagcctgggtgacagggccagactccgtctcaaaaaaaaaaagctctttagaaaaaggctttcaaacttttttgtctgtgacccagatagagaagtagtttttgactaatagaaatttataacaaaattacacaaatatgtaatatcttgtgaaacattacctattattaatctgtgtgaggtagttaagagaaccatagtgaccttctaaattgaattcacaattcatgggccgtgaaactcagtttgaaaaacagcattttcaggtatggagtagtttggggcttttgtttattttttacatgccatgttagtctggaataattatgatttttgttaacacaaggattttcactagacatttatcagtaatatcagcatatactgttattagtcattatgagtaaagaaaataaaacattttggatttatacattagccattatatatagcgattttttttccttttagaactttagaaaaaggggaagccacagtaatttgaatataatcaagacataacttttccagtatattcagttgaccttccttttaaattagaccttgtgttccttattcctgagcctttgagtttgcagggctgggagtactaatgtttattctaagccaaatgctttacttggttgctgtagtctgaggcacatttctgttgagtacagattgacttgaatactggccaagggaagagagagagagggtaagcagaaccatcactaaagaatcatctgccgttcatgtttaagatcctagagtagtgggattatttcctagtttttagacactgcttcctggaggaaaaaaaggcaacaagatgtcctcctttgttggcaactatctgtgaaaaacttctaaattcatagattgaaggaatgtgttaaatttaacttgggatttttttgattatacgagtttagcaggtttgggaatcattgccgaacaactggaaaaaaatagcacaaggagctccagcattgaaattatattcattaatgctgaatctcaaatcgtgcatcaagggagatgaaataaatggccttaatgcaaaccaggaaactgctacctggaaaaaagcaagtataaagaggtttcaaatagcttgcagtgaactgtcattgaattacccttacacaaataacatagtgatcacgtatcaaaagtatggtgctaacctaacagcattactgttttctactaggattgaactccaaataagaatactttctaaccacattttggaagagacatagaatctatgttgatggtagcttaagatttaggagaaaagcctgaaggagctaaacttaggaacagggagcactagggggatgtgattatctattaatactttcaaggtagcagtgtaaatgaagtaagggaattaggcagtctccaaagatggatgggctgtatcaaagagcaatggcctagagcacagggaagaaagcataggtttagtattaagatgattttaatgaaactagcggaagaatagagttatttgcactcatcgtcagaaccattataagtaggacaaagagctggttgagagggtactcaaaaacagaaatgatctctttcttacatagtactgtgcttgtttagaagctcaatgagagaaaaatatggaaatgaatatgaaatgaaatggacttttcaaaagttagtgtgtttttctgttgtttgttttgttttgaaacagggtctcactctgttgcctaggctggaatgcagtggcgtgatcattactcactgcagcatcaaccttccaggctcaggtgatcctcctgcctcagctttccaagtagctgggaccacaggcgcatacctccatgcctggctaatttttgaattttttgtggagatgaggtctccctatgttgcccaggctggtctcaaactcctggactaaagtgatcctcctgcctgtgcctcccaaagtgctgggattacaggcatgagccacagcccccctgccagccagaagtttttaaagatcagaaattagtgtttctagctctaaacttctatgattatgaatccaagtaaaatggtagattaactttggaatccattaaggtagcttttaggacttgcctgtgatattagaacagaattttgcttactataaccttcagaagcaacttctttttgttatcaaaaagctaaactatgaaatccttccaatacgtgttgaatacaaagaagcctagataataaagagcccgttagactttatatgaaacctagtaaaagtataacctttggccattagaaattaagctttttcttttatatggtaaatgtatgctattaaaaacctggaaaaggacactttcatcctaactcctaagacttcattagttaaaatcctgctgtgatagaagccacagcctgtctttagaagtgggagctggtgctgtaataccttggtagaggtgggagctcactttagtttgaagagtgtagggttgtcagataaaatataggatgcccagttatatttgaatttcagatcaaaaatgaagaatttttatttacgtaatatggcaaccctggaagaatgtatctttgctattttggccttccagttagaacttaaaagacagccttgtaatttggtgaggtttttgtgtattaaaagaaaccttcctaaagtagatttaatatggacaaaatcatgttgcattgcaaattttgtatgagaaaatataggttagagtagcattgttttattttgataacctcacatttctatatgtgttttcttcagttcagctaccttatatctgacagtaatttttttcatttattctctgaaattaaagctgttttcgagaagaaggtgggctgagggcgtcaggctttttttttttttttttaaaacaattctccctcttcttacctaaaatatttaaaaatttagggcattattgcctaaagggtatatgataaggatgtttctgggacttctcgtttaaggattgcccttttccatatttgtgcctgggggcttggaatatatttgtattcttggtttggaagaagaaaaaggtataaatgaagatgtgattgaccacacccttttctttctaatgggttcaaaataattttcacttgctgaattgtaaccacctgatttagagagtcagaaagtggatgttaacaatgcagacagactagggatgtgattactttgtttttttgtttggttttttttgtttgttttcagagatggagtctcactctgtcacccaggctggagtgtagtggcgcgatctcagctcactgcaacctccatctcccgggttcgagtgattctcctgcctcagtctcctatgggatgtgattactttatacctaaatttcagtactaagaaaatcatggtttgatgagtttttagtagtggtttgtccctgtttatcagtaattcattgtaagagctctcccttttgtccttttgttatgggctaaggcaaggagtggtgcctataagaataagaggactcgaacagtggaataggttccagggagaatgatattaaggaacatgaaacataaccctagttatacttacccatatttatttgaaatatatttaaggtaattttaaaaagtactaaaagtaacttgtagtttttatgaaagtaggaaattaccattgtaaatataaaatgtgaataagaactatactgaaaaggtcatcttgttgggtaatgaagttaagtagaaagaacactggatttggcagtagccctgtaatactgtctgtttgcattttagtactctggtttctgttttaaaaattagtgtaatacttaacccatagagttttatgggattaaattacaatgtatgctgaagtgcttaataaactgctatatttttaaatggcatgcttgtttagctttgagttatagggcatggtatttatagtgtttacccttaataggttaactgcaactctggtagttcataagaaagttaagaggaaaaataaagtactaatgagaaaggccagattatttcaaggttggctcttttgacaaatgatgagcatatcattaaaatgtgcattttagatggttgttaataggccagtcttttcattgaattaattattcctctctactagggaaggttaatatcgaatttctgtaatctttgtagtgtgctcactgctctcacttcaagttaaatttagtcacagggacccttgttatttttcatccccattctctcctccccgagataggtgactgaaagtgaaatcagatgtctatctgtgttaactttttatagcaaatttttgtagctcccttttactatcctgaaataaaattcatagatgttttgacctacctacatgttattgaagaaaaaacaatctgatgtcctaaatgtaatataaaggagaaaataagggtaagtaactctaataatacaatgtttagatcagtctgtaagtgctaagagatggctggacagaaagacattgaagtagcccattgtttatattagaaaaaccaagctacaaattcagaccgatacagttgtgctgtaatggtgaattgaatactatagacagtgttgctgttgataatgtgattttctgaaaaggtgaacagctcttggtagagttccaaatgaacgaaagaacagtctattctcactttacacagtaattacattcctggaaaattaagtgatgattaaaatcatgcaagaatactttgtgttatatttaaaacagagttgggttctgggctcagaacaagtttttcatcttgaatgtcatttgaaagtggtataggaagcgggacaattctttactgtgcaagacttttccttactttgtgggatgttgcaaatccttggtgcctgcccactaaagactagtagtttcacctcagtcattgtgtcaaccaaaaatagagaaatttccaaaatgccctataaaaggcagggcaacccccattgagaatatcttcattttgttcctgtacttgtaagtgtcctctgaggtaggattatagtacttagtccctaggactatcagtagtcaaagccacatgccttctaggaatggaaaggcaaggagaacagctgttgacttgcctttactctttttgttgacatgcattaaagcagggtttgcaaactcatttaccacaagagctaaacaagtaccatttgctaaactagagaatacatgctttgaaaacactgaaagttggatttaaaaacactgtgctgatgaaataaaattatcagtgggcctctaagttgtgtccctttcaccaaaggattatattatgaattttggagcctgagagattaggttgaaaccctgatttttggcaaatctcttaatctctcttagcctctgttttctcagtcgcttattagacataacgcatacctcacaggatggtggttagaatgagactgcatatatacaatgcccagtacagtacatgacacaagatacatgtgcttagtgaacttttctctttgccctaatacccattcagttatcttggttactttttaatctgttgttttaaagctagctatgtgttctatagtaaaatgattataaaatttgaaatctttaatatagaggatattagtcccttcttatttttaacaagctagaaagtaattacaatgaacttttttggttaacacacaacttatttaccatttaggatgtgtgaagcctgatgcttataacgctaaatatgcttattccaaactatttcagtagatcaccctccttggtctttcaggttagcttttaacattaatgtatccaggtagcagtggtctttatttttgaagccgtcttgcagcaggtaattttgctaatactacagtaatgtattgcaccatcaaaattaagttgttccatagaagtgacatgttttggtagttgttgcttgacttagaaatttagcagcatgagttttactaggaaactatgatatattattttcttccagttttccagtgaatgttttgaaagttttacattttcttgcttcttgtaaaattttgtagagacgtacatagcttgctgtacatcttgttttcagcttttagcagcagaaagttttctttttaaacattagtaattaagacaatgatctaaatagttaaagcaatagaagctttattcccatcaccataattctgttgtccctctttgttttcctctacaatatgatttggaatccttttaaagacctctatgccttagtttaaattttttaatttaagttaatttattgttactatttttttttttttttttttgagacagggtcttgctgctgtgtttgcccaggctggagtgcagtggtatgatcatagctcactgcagcctcgacttcccaggctcaagcaatcgtcctgtctcagtgtcctgagcagctgggattacaggtgtgcaccaccacacccggctaattttttaaaaaacttttttgtagagatggtgtctcactctgttgcccagggaggtgtttttgttttgttttgtttgagacaggatcttgctctttcatccaggctggagtcagtggtgagaccacagcccactgcagcctccattgtctgggctcaagtgatccttctaccccagcctcccgagtagtgggaccacaggtgcgtgccaccatgcccagctaatttttaaaaatatttcatagagacagagtctcactgttgctcaggctggtctccaaagtgttgggattacaggcttgagccactgcacccagcctgtaatttcttataaagttattttatttttcctatcttaattttattctcttcttacacatactttcttgatcctgtttcttctggtatcttcagttgtttctagataaacatttgccacttaaaatttttaaattctattttaatcctttttagacagagaggtagtggttccatattctaagtgtaatataaaagtttagatgactggtgtttattgagcaggagtgtttccatattgtgagtgggtatttttgcatttcctaatagctgtttaatgactttctttgtatggtagagatctttctaacatatattttttttaactcttttaatccccaaagggtcataatgcccatgtttctcagaaacagctcagctggtcttcaaggcctagtcacaaaggaaattaattcctgatggaagtgaggacatcgaggcagaaagaattccaggcaggcggctagtaatgaatattgattgtgagctatgtggtacttgcttccctgcagagctaccacttactgtggagtagcatacgtgaaacgttgtgaaacgaaatgtctgcccatggagcatagaatttgctactcagtggcaagtagacattaaaaattcaattatgaggtggagtggtgctaggggtagtcagactttacagctggaggatgaaagggcaaattttgatatgcattaaagggagaaaaaaacaccagtagagtatataaagtagtagttcttgctgtaggaacattaggttatagtgaaaattgctcagaagttatcagaagaatgagctttcctggcatttgtattttagtaacacgtgtgtgtatttcagcagctttgtaaagccgaatgggagtttgagtggaatgtgtttttagtagtgtcttagtagagtgtcaccttaccattctgcaacactatctgtttgtcacagaaagaactaaagaattgtgtcaagtcttgaactctcaaaatataccactggaaaaacttgacaggcccagtagtaggtgagcctgaggtaaccagatacataagcttgtcagccatctgtgcctagaatttagtgaagttttcatcaggtcaaatttccaaagaatagctgtaactaaccacaggagggaataccagtggttagttaggaaggatgaatcctcctgcattggatagtggttagccaacattttgatactgaattatttcattcagctttttgaaagaaggaaaaagttattggatttttaaaaattatgaaaggatttgcttacatgataacttcaaataatactttggtgtttaaaatgttgaagttcttccttttactccttgatattcctgctttttagttagcagtgttagtagtttgttgtgtatcctttcaaagcttggtttatgtaggcatgtcatttacatactgtgatgctttgcatttagtagtatgttacaattcatcttggtatttatagtctttttttgaatatagtaattggagtgacagatattttcatttatgtaaacgtatggaactgctggaatacatctgttgttactaattgtcaccaaagggaattatgttgatagtgactgcattcttgatattgaaattggcctactgagagggaagcagggaaaagcttcattaaatggaatagaaaaatatactacttcaattttatccagtttttggctgaagtcttcagtgttcacacatttaatatcttagccatgtgggtaactcctgggacagctctgctaatttttagcgaaagcattctggaaacaattttgctgtcccttttcaagacaagcagcaatattttttactggtgtttgggacactaggtaagtagtataacctgactctctacctcactgcagaggtgaaaattctacttaatcatgtagttacgaggtaatacagacctgaaacaagttgaggagagtagaaataagaagtaattgtgaagggagaatagaatagatttggacaattggctgaattttgggatttcctgagggactgaggaggcagcaggttttagtggatagagcattagtgaacaggagtcagaatatttgaattctagctaagggttctgcaactaaagtatagcctctttggcccgtggtatatctgagtgttaatttggggcaagaattagatttaggagttttcaacctttagctgcagaaagtttgttgttgttaattagatacaagtagagctgtttgaggggtagagggagtcccataagtgttccaaagaatctttagggtctgtggagccgggtttttaaattgaaaaatggatgacccctttgtagacctacttttaaagtttttgcataagagtgttttgtacctttggttcataatgtacttggtcagtcttgatacctgcacggaagaggtcctgtgcatactttgtaaaactgagaattaagatacttatatatatgtccattgttgaaataagaccaacagaaaagatgacccatttaagatagaatgtataaaatagcacaaatataattaccctatgcaaaatggattcagtaaaataatttttattacaaggcttgccaacctctggggaagaaagagctacctgtcacttacccgagttttgaaatccaggtatatgtacatgatagagtgcagaaatgtgctgttaagtctctggttggaaagaggatgaacctgctattttcatctcttcttggtgggaagaaaatcttaggggcgtatcattttagtaaccatcttggagatctgtcagtaagaactggaaacctactgccaagttccagtttactagttaggaacatcagcttttaaaaatcggtctttgttagtaatgccaaatgccttttaaactcataggcccacatagactttttgtataggtaattcagatcggggatgaaagtgtagtgataaaggcctgaactgttaaccttgatgacagagaagtggaactcactgtgtacagtctttctaagataaaatgtgtttggattaaataatgtatataggatattgtttagttctgattgtttatagtaaaagcattgctgtcagtgaggcagtatagtgtagtgattgcaagctctggaagtatactgccaaggtgtgcatcattcctctgtactgtgtagaatggcaaaagcaaccttaagaggtagactgtatctttatgtagcaaattaaattatgatatactttgcgttatgtctaacacaaatgatcaataaaggctagctgctgttataatgaatttcctttcagagacattagttatgtgctcagtaatctttttgaaatgttcttttttattttttaagaatagttaaaaagtgtcctattccctgtccatccctggcccaccatggttttcttcaagattatctttaaaaaaaaaaaaaaaaagattgttaagctgtttgtttttgatgctaggagtttcacagaaactgtgaacatccatctcttttagacctagtgatgagcagcatcactacctaacttggaaaacagtggttaagttgaaacctaactgtaaagtaaaaactcaaataagaaatctattttaaactcaaatttattcccttgcttgttagaaaacaaactgacattagggatttgatttttttaaacaaaaggtaacttctaaggtatctgtggtaaattcaaatataacaaagtctagtcttttagaatgtattaatatgattctgttgatattaagaaagatggctctgatggctacctttctatgaaaaactccactaatcaaagaaagatggtttcatttattatacatttattaacatgactagtacattttaagtttttaataggttgcaatttaatgaaaggatttttttcttaatccttcattaataagaatcttattcctcacctttcttttaacaaatattgagtataatgtgtgcagcaaggcactgtggggaaacaaaattagagacatatcctggtttccaaataatttataatctgttaacatatattctttcttcttaccttgtgcatcttcatggattcatagaatatggcatttgaattaattcatcaattacatctacaaatacatagatttgctgaatattaaagctgaaaggaccttagaaattgtccattccagtcttctggttatatacacaagggaactgaggtttcaggttttaatatatgtgtatgtatttattaaatggaatgatttctataaatatgcattttttttttaagacagggtctacttctgttgcctaggctgaagtgcagtggcacagtctcagctcactgcagcctccacctccgaggctcaaatgatcctcccaccttagcctcccaagtagctagtactacaggtgtggaccaccatgcccagcttttttttttttttttgtattttttgtagagatgaggttttgtctggttaccttggctgatcttgagttcctaagctcaagtgatctacctgcgccagcctcccaaagttctgggattataggcgtgagccaccacacctggcttaaatatacttttcaaaaagttacaatttaaattggtatgtccaggccaggcacggtggctcacacctgtaatccccgcactttgggaggctgaggcaggcagatcactcaaggtcaagagttcgagaccagcctggccaacatggtgaaaccctgtctctactaaaaacacaaaaattagccaggcatggtggtgggcgcctgtaatcccagttacttgggaggctgaggcaggagaatcgcttgaatccaggaggcagaggttgcagtgagctgagattgtgccactgcaccccatcctgggcgacagagcgagactctgtctcaaaaaaaaaagatatgtccagcattttgttaccgcgtagcttcgtattcatttctgagacactattagagagtatatggtaataaattctagagcatcattgctagctgacacaatcttggcctgtttttttttaaccagagtttatgattttactaaatatgataatctgaaattactaagtggagaactaccttttgtaaatattactgttcattgatctttgtatactaccatttaaaatcaagagaggcattttcttttggagcagtagggccttgaattgtgtactttattctaagacaataggttctagttaatggaaaaattagctaagggtggtatagttaccaattaatattgaatgtagaagaataaggtggaagatttataattttaatagataaaaataaaataggaattttggaggtgctttggaggacttgatacatttgaatctgagactcagatatttaacaatcaaagggattcttggaaaattattgctccaggttttggggaaggtttttaaatcacaaatatactgtatttagaattggaagtttattgacctagaattttattctgggatatctccactctaattgcttaatcttacataatacatcctccaggttccctgtaagttgagtaatcataattctcagtttgtgcctgttgccctgtcagaattattaacagcacccctttcactctcagaaggattcaggtttagatgacaaattatatggttaccttacccataagtgtaatttattctcctgggcatttaacgtgataaaggcttaggagatttcctcctatgacattcttttccttatgatgggagatttctgtttaatggagttaggagagcattaattaagatagcctagttgaagtctgatagatttgtttatttatttatttatttttgagacagagtctggctctgtcgcccaggctggagtgcagtggcgcatctctgctcactgcaagctccgcctcccgggttcacgccattgtcctgcctcagcctcccacgtagctgagactacaggcactggccaccacgcccggctaattttttgtattttttttagtagaggcggggtttcaccatgttagccaggatggtctcaatctcctgacctcgtgatccgcccacctcggcctcccaaagtgctgggattataggcatgagccactgcgcctggccagtctgatagatcttaaggtttaagagtcccatgttttcttttcttcctttttttttttttttttggagacaggatctcgctctgtgggcctaggttagagtgcagtggtgtgatcacggtttattgcagcttcgacctcctgggtccaggtgttcctccaccttagcctcttgagtagctgggactataggtacataccaccatgcctggctaattcttcacatttttgtaagacacagggtctccctatgttacccaggctggtcttgaactcctgggctcaagcgatcctcctgccttggccttcccgtgttgggattacaagcatgagccactaggcccaacctgtcccatgttttctgtgcttgcatcagaaacacaagataggtgaccattactagcttgtccgagcagaagttatttttgcttgctcaaaagtagctttgcatttatgtatcatttaaaaaattccaatcagatatgctcagtgtcaagtgcaaataaacctcagtacatgattataagtatttttcagttgatacttttaatttaaaaaaatcgactgcatttttagagcaattttaggttcacagcaaaattgagcaggaagtacagagagttcccatgtaccccctgtccccacacacatacagcccccactatcacattcccaccagagtggtacatttgttacagttgatgaacctacactgacacatcatcactcaaagatcacagtttaggactttgagtttagggttcattcttgatgttgtgcatactatgagttttgagaaatatataattacatacgctaatcattagagtattatacagatagtttcactgtcctaaaaatcccctgtgtactacctcttcatccctccttccttcttatctcctgggaccactgatctttttattgtctctatagttttgcctttttcagaatgtcatatatgtagttggaatcatactgtgtacccttttcagattggcttatttcacttagtaatatgcatttaaggtctctccttggcttttcatggcttgagagtttgttttgtttttgttttgttttgttttgtttttgcattgaatagtattttactgtttgggagcatatttaattttaagaaaatgttcttgatagtctgtttcgagattggcatactaaattccacaagtgggaacttttaattatttaacagtgagttgaatacgtgataaattcccatttaatgggagtgaaattgcgtattactttaagaatgattgtcttcctgaatgaacaataattatatgagttgttgagaattcagggacaaatacaggatcttcataaactgtgtcataccaaatatcaaatattctttggactctggctcagtgtaactgtataaataatttttgctactatcacaacttaagtagtgggaatgtttgcagtttcagcacattgtccatatggtccatatgtaacggagtcaaatttgtctcatttttcaagattcaaaataagactcagtaaagttctgctgagcatcctcaattttttttaaattgagaaaccactggggcctagaggggggaaaatgttcccatttcatgccattgtggaagtgaagagtctcttgttcagttgcctgtgtatcactatcatatccttattttccaaaatcatatttgtttaatctttacagaaatactggaggggaccagaagggtaggaaaaggggcataaacattgtaatatttcatgaacttttatcacagtctaaaataggggttactatttctgttaatattttctctagaatcactggtccgtggcatattggctttgtttcttttcagtactctttactgcagagtgggagttggtttagctttgggctttaggctgagattccgcttgttttcctttttaaaagttgagaaaatttggttgggattatgcgttagctttttctccacagaaagcattccatgttaagtgaaataacccaggaatggtaatttaaacactgcatgttctcactcatatgcagaagcttaaaaaaaagttgatctcatagaagtaaaaagtaggccagtacagtggctcatgcctgtaatcccagtactttgggaggtcaaggcaggaagaccacttgaggccagtagtttgagactagcatactgtacaaaaaacgtagcaagaccctcatctctacaaaaaactaaaaaacttagctgggtggggtggcacacacctgtagtcctagctactctagaggctgaggtgggaggattgcttgaaccaaggagttcgaggttacagtgagctatgatcatgccactgcactccagcctgggtgacaagagcgagaccctgtctctaaaaaaagaaaaaaaaaagtaaaaagtagaacaggaaggtgagggaagaaaggaatagggagggatttgtttaaggacacaaaattaaagctagataggaggaataagttgtagtgttttatagctagaaaatactagaagtaggattactataacagtaatacatactttcatgttgctaaaatagaaaatactgagtgttcacgacacagatgataaatgtctgagatgatggatatgctaattaccccaatctgatcattacacattgtatatatattgaaacttcactatgtatcccataaatatatatacttattatgtgtcatataaatataatttttatgtgtcatataaaaaagtaaggggaaaaaagcatttccaaaggtaatctttggaaccatatggatactgtttttctcagaaggtaaggattctttgtgtgtgttttttgtttgtttgtttgttttcagggacggagtttcgctctgtcacccaggctggagtacaatggcgccgtctcggctcactgcaacctccatctcctgggttcaagcgattctcctgcctcagccacccgagtagctgggattacaggcccccaccaccacgcccagctaagtttttgtattttttagtagagacggggtttcaccatgttggccaggctgctcttgaactccacctcaggtgatccacctgccttggcctcccaaagcgctgggattacaggcgtgagccactgcgcccggccaggattctttgtaaaggctaatagcattacacactctactcaagcgaagtctaatgctgctttgagaccttctggtatggatactgtgccttatatctgagtcattgacatggagttttaagtcttctgaagcaaagtaataaaatatttacttgacattattaaaagtgttgtctagatatgggaagggaattagttcctaacttggggtattttatcctagtgaaagtgcattgcattcagtggtgaatcatttggaaagaagtataattatgtagaaagttccattctcagtttctttttcatcctccctgagtcagctcatctcctcccatggcttcaacgtccataagctgatgattcccaagtgcatatttccagcctccacctctctcctgcatatcagatccttatttttaactacatttggatatctccagatgtctgtaaagccagctcagcctgctttcccttattacagttatagtatcactgcccaccccacgtcaataagttcatttgattctatcttgtaaacatttctcatgtctgttaccttctcaccattcccacagccactcttaattagttcagactatttttcatttggattattgaaggagcttcttaactccttgttgacttccttatttctgacagccattgtactgccaccagtcagagcagtcataccccttgttctatggaaagaagcccaatatgctcttcatagcttacaggatacctgtcattctccctatattgtgaggtcttgaggatatttttctgaatagcatgagcacttaataggtgcttgacatataatagcactcaaaaaatgttgaattttttcacctttatctagaactcattcctactaattgtaatactgtgctcatggtgtttcctcttgcctagaacaagaccatctctccccgcaactgacaaggctagatttagatttcaatgcatgagctttctaggtatacgttagtccaacaaaattattttttatatatgttcctgttgtacatacctgtcatagaagtgctgttgtcagtggtattgtattttgattattctgtcttgtgtcttgcaaggttgaaatctgtttaggaacaaagtttatccctgtgcacagtccttggtaaacaggacctcaataaatggtaaattgaagcatcctgtcagtgtatacactggaaaactgaacaaatccaagataaaagtcattgttttgaaatcatagtgacacagtttttttagcaactgtttttgctactctacttcttttggccatggatcacagacccagctgttgggagaatctttatatgatttcagaaacatctgtgtggctcttatgcctttgttttccttccatttaaacaagctcaaaatttgcacaatatttgcacagtttcagattctccaagatattgtcagagtatggtccctggagcagcagcacgggcatcacctgagaacttgtaagtgcagtctcaggcctcagtctgtgttctaacaggccctccaaatgattctgctgcatggtaaaatttaagaattactgctttagaattttgtcatctaaggaaagctttgccttttgtatgtaatgacaaagttctcagtgtgatttctgctataagctatttatgctttggaaatattaatagttcatcagctgggaagactaggactacggttacctaacatcctgagatgtgattcaaaacttgaatttccctctggtcagagtttttgactctgtggtttctgagaatggctgtttaaaaaaaggtggggagaagtagcttactacctctttcagttaaaatgtcttctagattatacttagactatcagcttggactgcttgtgttcattgtcatattcatgcgatatatgatgatggaagaatgagatgaattttggtatcttaacatttaagtcctgattgttactgtgttgtcagagacagaaagtaagcttgttatcagaagttacgctgaatttatagacaggtgcatttcacagaaaaagtttggcaaagattagcttttgagcagtaattacctatggcttttgagaatggtttattcaacttgctaaagaaaaaaaaatgataacgtgttaaagcatggtaagaaaggctttatttagaacatggtgatagatgtagggaccagaccactgcagtgagattctgcactggggagagagatgggctcagctctgaatacagcataggcaggtgggggtcagtggatggaaaattactaagaggaaacattaggggtaaggaggatttggctaagccaacctaaacattctcactgaggataggccaggttgatcagacctcagctagggaatggtggaggctgaagaacctgatctgatactgaggatgatcaaagatgggggttcttgctaaactgacttagcaaggttctttgctaaaactgaattttacaaggaagttcacagatgggcctaggagaaggttcagaagcctacatattggtcaagcaaagaatctttgtcgaattgaagtattaaagctttctagtatattgttttcattttggctttaatgctaactggagagtcagttgaagtacactctttaaatgttttgtaactggtattatttttcttttaattaattaaaattgtttttggcctcaaagctccattttggatgtagttctagatctgcccatagctacttttgacaatctcttgggataagagagcttttatgagcatttgcttaaatatgtaagggtttcacttacatatttgaaccagacctttcattaataactctctttaagatatagcttatttgtgtgcatttttctgtttcccctgcatgagacattcctggtttttaatggctagcaaaaccagctttttctcttagggaccagcagcttaagtactatttgtgaagttgggaagtgaattacctaaaattcccctgaaaatactagcttgacaatagtttgtggctgctgcatttttctccttggacagacacatccttagttttaaaaaagtcatggtcattttgatgtcaaagtcaaaatgggccctgatttattgtatttggccacactttcttggatctgactgctcaagagtaaattaaatgcctttttcctccctggggtgaaggagaaacattgttagtctccagcagtgtctttgataatgaagctgtttacctgagtactgtaaaagcctgcaagtggctagcattttctttttattttttttgagaagtagtttgctttgtcacccaggttggagtgcagtggtgtgatcctggctcactgcaacctccacctcctgcattcaagcgattcttgtgcgtcagcctcccaagtaggtggtattacaggcgtgagccaccgcatgatggccatagtattttctgataagtaacatacaggcagagctttcaatctgttaagagtccatgtgaggatattcaggatcataggaaggaaccctggaagacagacgtacaaaaggaatgcaagaggggttcaattgtgagctgattcttctctttgcttttaacattttccaattctttttttttttttttgaggtgagtttcgctcttgttgcccaggctggagtgcagtggtgcgatctcagctcaccgcaacctcccctcctgggttcacctcattctcctgcctcagcctcccgagtagctgggattacaggcatgcgccaccatgcccacctagttttgtatttttagtagagacgagttttcttcatgtcgttcaggttggtctcaaactcctgacctcaggtgatctgcccgcctcggcctcccaaagtgctgggattacaggcatgagccaccgcacccgacctacattttccaattctttctgtttctcaggtctgatgtcaggttctatttttgtaagattttttttttttaaccagaatttattctaaatcatttttattaatttctggcagccttacctcatttaatgtcactttctatttgaaacatgttaattttctggatcagtggtttgcagtgcttttttcttttggaaaatggaaagatttggaaacagtcagtccagtagacatccccctccttcatggatgtgtgtgagccctgcccccagtttcttccacactgcttttgaggtatgttaatagaacactcaggactagtttagatcattcttttccccccccccccttgagacagggtctctactctgtcaccaggctggagtgcagtggaatgatcatagctcactgcagcctcaacctctcaggctcaattgatcctcttacctcagccttccaagtagctgggactagaggtgcataccaccatgctcagctatttttggtagagacaggatttcaccatgttgtccagactggtgcagtcctcccacctcagcctcccaaagtgttgggattacaggcatgagccactgcgcctggccttagatcattctttacctaatagagtagaatgcttgcataaaactgacatgttattacatttatagctttacaggttacaaagtaattttatgtacattgttcatgtgaatcttgccatgaccttatgaagaagataggaatcattgtccccatttttcagatgaggaaactgaggttgaagaaatggaaaaatccatcccaagttttttaaaccatggctcatttccctataaggtgagctctcatcttaatagacccttaactgttcactcatctaacagtagtacaatctagactcagggtctggaagacccctgaaatatgcaaaactttggttatatttttctgagttgagagattcccataatttttgttttctttctttgttgagacagggtctcctctgtcgttcaggctggagtgcaatgttgtgaccccagcatgctgcagcctcaacttcctggactcaggtgattctcctgcctcagcctcctgagtagctggaatcatagacttgcaccaccacacctggctaattttttgaagagacagttttttgccgtgttacccaggccggtctcgagctcttggactcgagcgatcagaccaccttggcctcccaaagtgctgagattatgagtgtgagcggcccatgtttttttttaaatcatacttttaaatttttttcttttttgtcattgacttttttttaaacctgtagatctaggtagatcatgcttgtttagcttgtcagtaggaattggcaacaggactgaatgaaagtttttgttgagggagatccgtcataccaaatgcttatttcttgtctgtcctaaagtaacttaacatttgcatagagtagtttacagaactcttacacataatgtaacatgattttcacaactaccctataaagaaagtggcatcattcccatttgaagaaactgcttaaagttaagagaatttgtgttgtggaggtgctgactcaaaacctgacaccttttcttaggctgaaattaagctaatgtgacatgatctcagattccataactacatcttatattttgtaaattaacagtttggcctgttcaatatccagtatcttcccaaatattgttaagcagcctgatttataattgataggattattttctactttaaaagaattttttttgaaaaggagaatttgtactgcctctctttattcttattattcttggactttccagattattcataatatcttagatttaatggtttataactctgaaaacacttgctaattccttgagtccacatacatgtgtctgctattatcactttgttcattccagtttgctctaaagataggaaggaatgaagaattcccttctttttcattcccttctgcagttaacatttccgttctggttctcattttatttggaaggttaaggttagttttttgttgtttcttgaagaacttggattttaagttaagctcattttggatgtgaagttctgcttcccagcctgttgtggagcagtgctgcaggctgctgcccgtggcctgtttagcacttatttctatggagacatataataatagctaacattattgagtgcttactatgtgtcaggtactgttttaagctatgttatctcatataatcctcacaataaccctgtgaggtagctgctattattagtcccgttttacagattagggagatgaagctcagagaggttaggtcacttgcttacagtcatacagttagtgacagagccttatgtgaatccagacaactgattttagagtttgctgcatttggtcactaaactatgtagtttctcttggcatgaactagattcccctatttttccaaagcagaaggctggctggtatagatgcctttggtcattttgaatggtataatttcagaataaagggtggaccctggtttagaagctagtgatagggatgatcttaatttccaaacttttgtcatatctgcctgatcaaggtacctgtggaaggagcaggtttgaatttggaaaatgttttgtaattgctgccatctctacctagagatgagactaatctgtggtacctcttcctgctgcagagaatgaggttaccccatttcctctgctcccaggacttcaagcctgccttacccttggtcagtacacacagaatgagtgcatatagacttctgacctgcctttggtgttaaggaatagtgatgaatgatctgtttcctgattaacaggaaggataggcaggctctacagtagtttgtgtaggctcaagtctgtgacagcctcacagcagttaagggtcctttagacatttgaaatactcatagttcctgtattcacgtttagatgtcagtgggtcttgctcagtctttattttgaggtagacgatttgaatttgtgtgtgtgtgagagagacagaggagagaaacgctcttatgatcttggctgtcattttctctttattgcgaggaacgaaggagagaacagcatgagccagccacagggaattagaggtagagggggtttgaagggaacagctgtttttaaaagaggtgacaaaagcaggcaagacttaaaggcctggccttggcagtagtcagttgagggagagagaaagttagtctgatttcttgttctgtgggttgccctggaggtaaatgtgaaaaatcatgatagtctctcctatatagggctaggctagctttttttacttccttagggcatatatgaaagcagttttcctgggattgggctcaacttgctcttctgtgtttcctttttcttctcaccctctgctacatatccacacatccagtttttcctgccagcaagctcctccttttctccggctgctagtcccagctgtcatctttgcctcccatcccccatccccagttatgcaattttacattacgcttctcttgggtttgctgcctccatttttaatgctctgcctgctaccccctccagcatcagcttctagtctcttcctccctcaaagccagtaaccactgttcagtttccctctttatcactgttgctctgaatgcactgatattaatactttcccaaaactcttgcagatctgggcccagtcacttaagatagtgggtggagacgatggtggggaagagggtggggtaggaggttgtcttacaaaatttagggtttttccaaaatattggatgacccttgacctagagagcaaacagatgcttctgttggcctcccaactttaggcagtgtgtgctttcttgttgaaggtacatatttgtttgaaagcccttagtaatgaaaggcagggcagtgagtcaggctctgaacctcctgctgctgctgctgagagccagttcttttcctgaattgaagctaattttggatggataataaggtggatggttgctaataactttcccttgctaattgtgatttcacagtactttgtaaagagggttcttttctcttttctctttttctttttcttttctttcttttccatgctgtttggagggggaatagatctcttttcatggtttttgatgagtgttcagctatcaaggaattccttagtttgtttagaggcagcacagtttattggaaagaaccctagactaagctaagacctgcattctagtcccagccccactcaggattaactgcctaagtgattttgggcaagtcataaacctgtctccgcacctgccctatgtatgaaccttgtggaactgtgcgaatgaaatgagatgtgatgtatgtggaagctctttgcaaactgcggagttttataaaactttcaggtgctgccctttattaatttggctcctgactacagcatcagagaaatttttccagtgtcttgtaaattccttccttctctgaagccagccttctccagagcagggcattggaatcatcagaactagaggcagtcttgcctcagaatcatcttatcttttcacactgttcaccctccccccagttgctttaagaactctttgacccagtgcttctctatctccattctctagtaagattataattttatggagttagtgatcatagtatgttgcacaattggtcaaaggttcctggctttttgtggccaggaattattattaattaatttattaattaaactaagtggtgacaaagcatatctttaacttaagtaactacaaaaaccttttcaggccagtgagacacattgaccacagttgtggtaagtgttaagagaccatgctttcactttggattccaggccagactctttgttattagcttgtgaccgtgggcaaaatatttaacttttttggacgttagtttccacatctttaagaaaaattataatggcacttatcataatgaataaatgaattttgaatatgataatgaataaagtgcttagcacattgcctaaacatataatgcatacttagaaaatgtcactgttactctatatgtctaataatggtaataacaataatggccttcaaagaccattgttggcattttaaagggttttttatcttgtgttttaaaagttcatttaaatatacatcctataatttactaatgcaaagaacatttttgtcttggtcccattttccttgatacaggtagaaaattgaactgactcagatcagcattccttactcttagcaggaagtcttgcccagggtggcatgatctggctgagtgactcgcccagttgtgtgcagtgggaatcatagtcagactgtttctcagctacctgtgacttgtgtgttattaggacttggggttacagtggaattggatggattcttggtgaaaggatactttcaggcatcttttttacattagcattgtcaacagattgataaacaggcttaagtctaaggctgctttgaagtacaatacagaagaagggaaaaagtacaaaagaaatccactaacagttctagggcataatcgagtacataattaccgcatttgagaggctgtaactccccaagttcacagataatgtgataagaccatttgtgattaccacttatggtcaagaatatgattaaaacagaataatacttttactgcatttcagggatttactgatatccagttttctctggtgattgagccagtagtaaaataaataaaaccaacttcctttacttcccctccctccctcccttccttttctttctttctttctttctttttttttttttgacggagtctcgctctgtcgcccagggcagagtacagtggcacgatcttggctcactgcaacctccgcctcctgggttcaagtgattcttctgtctcagcctcccgagtacctgggactacaggtgagcaccaccatgcccaactaatttttgtgtttatagtagagacggggtttcaccatactggccaggctggtcttgaactcctgacctcatgatcctcccgcctcagcctcccaaagtgctggaattacaggtgtgaaccatcacgcccggccctcctttacttctttgtttatattagctggcattgactttgacaggtgggcaggtggtagtttgtgagaccgagacatggctccttggataccactttattgggcagtgagctcagctcttcatgcaggggcttgggggctcctttctgtaattctaaagcttctcctgcatctgagaatgacatctgttgggcttcttggggcctctggtagatatttccttacaaggaatgcatgctggatctgaagaggtagtttaaaatggcatattaaaggcagaacgtttagtctaagcctgttaatcactgcattcctgtgctccccagagtctgaaaatgtcaggaattgaaagactagtatgaatttggaggtcttggcctctacttgagtaagtatagtacctccattaatgttcttagtccatggtgtggggttatcaccaaaggcaaatactgctatggatgtaaacaggaatttttccacttagtaacctccattttcagctagccctgttaacatccttggcttctggactgtaggaaaacagttccatttatttcatcctttcctctggaatgttcttaatttgatgttggcagatcctgacctcactccctgcttactgcacaggggctggcttggcttatgcagcaggcctcccaggggacgtttccaagccaatcagaatgccctcttttagtgtctctctttataccttcggatactgtctgaatcagtagaaatgctgaatgaaccctaggtggggtggaagggtaagagagagtatgcttgcactctgattttgtttcctatggacctaactccaagtttttaaactaagcctggattttttttttttttaactctttctgccatttccaccttgtcttatggaagtgtaacctcaagcaaattatgggcaattagaggtaggcatcaactttagttcctgggcagttcctaagagtgttggttgaggcctggctttcaccctagtgtttagtttaattcatcagggtacatttctcattcttctgagctggcttctagaagccaggcaattcaactgtatggagcctgtcaaataccatagcttttcagatttttctaggtaatggatctatggggttatggagggcacagtccctccattagctggcagtgagttgggttgctggtattgttggtcccacttctgagctgacccacaaagtattaatatctcactgtggtgtgaagtacagactgtcttgttctcctgagggtctgcattcaggaagaggctgcctaacgctaaacaactgggttgtttgtttgccataggcccagggaagaataggaggtggagaaagtctaatcgaacccaggatagaatcctgtgtgagagagaaatttgctactctttcagttgaaatttgaactctgaatcccaagagaaggcaccagtaggtcatttaatacttcttgttgaggcttgcaaaagacactgcatttctaacaaagcgtttgcccatccaaaagagagatcctgatttggcatataaaactactgcctcttctggttatctttcatcacttgcctgagtttaaaaaggtaataaatggtttgtgttctaaggaaagaggctcttcccaagacctgaggctttctcattcctaccagctgggcccattgctaaaatgctttccagtgggcttgcttctgcctggccagcacctgggctgccccagcttgtaattagcctgcctttgcttcataagcttcccagggtgtggttcttcttctaaaagcttgtatgaattgctgtactgtctctttatagtttaaaaatgaatccttttttgttctttgcaactcatttgcttttttcttttcttttctttaaattactattaacacctgttgattcttttttttttttctgattggcctgtcactgcattcctgctccccctccctctagctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagagtgagtccagcaccctacagtagtagtactgtagtcattagaggtggcccaatgacccttcccttctgcatcctttccctcttccccagtatgatcactcaccccaccccttgtcttcgtttttttttcaatcccatgacccttctggttgtagtgtatgaaaacatctgtggcaactttttttcttcttttctttgccgttctctctgcctcccttatcccccaacccttctctgtgtctttcttctcaggaacaaagaacttgaggaaatccgtgactgtccaaaatcatctgtgttgggaagagttggggagggagaactgggaagcttaaattaaaactcataaaaccaggcagtccaaggagggtagtgttgaaatggttttccctcccctttgattttgtagtaggtttcctgctatacttttgctgatttcttctctggtgcctttctatttttgtttctctccccagtctaactactttttatttcttctgttcttctgtttgaagctctctaagtagctgccttcacctctatggttttaagtttgtgtctgcccagcctcttcctttaactgtgacttggtgtcatcttgttgtgatgggaatgttgccatgggtgcagtgtggtggtgtgttttggttgttgggtggcatgtaagcttggatattttcatagttccagctctttttcttttctaaaaccgtggcatgtgcttctctgataacagccctctactgcagcagtgtactcctcactgggcctgctaattagtctcctctttaaaagcagcagcctgggacttccttcttatgttttgctgttaggagccaggtgacactaagctgcaaattattatttttttagcccatcacactgtttggaagtcagagttgcagttgattcctgttcacggtttgactctgatgagtagctgttggcacagtgtaccttatcccagagcatgggaactccagacatagtgtggggaccactcacactggccttttctttgtgtcttgaaaaaagaggaaactaacttccaacctggtttctcatagtgatggggtgagctgaccagctggctcagaatcctctccttgtagcaggtatgcgtgagacatatgacaccgggacttttgtggccacttctctctctttcttgaaagtgacttgctaccttatgttgagaagcagagagagggagaagccaccacagaaccaacgttcctggccaagaagagttctggccccacatcaaacctggttataattgaggggacattcacttttggaaagatcctctgggtttttcaccttctctttgaggacacaatgagagatctatagccagttccagcttaaagagctgattgatctagagaaagtaagaatagtaaaatcttactttgatgaggaatttggtaataacataaagtagtaagacatgggccttgagtctatatacttagatggaaaatagcaaattagtgtctgttctttgtagccacttgaagatcctatgggtaaaaaaagagtcctttgtagggcagtggtaggagaggctgctgcagttggcactgttgaatcaaagaacctgcttctggaaagaggaaaagaaaaccttgtctatgtgaaaatggggaacattaacccagtgattttttttttaacaatatttttaccctgcacgcctccttctcctgcccccttgctcctttccttataaaagcagaattacctacatggccacaaaggtctgtggaagtttataggtatggactgggctgggcatttgcacttatacttccaagagcctgactcatagctagaatggccatgccaaggggctagaaaaagatgaggcattggggtacctacctaccaatcccgagaatacatagcattccccagtttacttagaattgtctgcatgtggttgaatcaaatccaaatcctggctagactctcttcagacttccccatcagtcagttaacccaagttagctgttttggagagccaggaggttgttgctgctgctgctgcttttttttttttttttttaaaacaccctggatccaactctaattggactgttttatgatctcagcgtcccaaaagacattgctctatggggacatcaggtgttctatctaagaatgacctcctggtagtactttccccaaagctcattgagtatgtaaggcaagaagagaagtgtgcccagtttttaggtatctctctggccatagcatgttctttatatatgcatgatggctggggtaagggtctcctatccactgcttttaaatagacatcagtggcaggtaaacacatttgaacttctcctaaatgttcatctctcttggactttgggcagcgcttggccacaaaaataaaagccccaccttcatcctggtgcagaatgcagttgaggcaccatggccaaggaacttggtgtagcactgtttttcatatacagcaatcacaggaggcaggttaccctaccccacaaccctcctatggtgcagaatcatatttaaacctatttaaattatccacttgctcccagtgactctctcctggatctttaacacttaagggaaaaagtgctttcctttgccttcaaagaatacttggcagaaagtctaccaggttgctttcatcaacttcttaatctccctgagctgcagtggtcatttgcatcgccacaggtaagagtagcatttactttggcctccttgtatttaaacatctggaagctcttggcctcattctcagagtttaccctttctcagtgcagtctgagaggaatacccagaacgagagtcccaagtgggacagaaaatgaaattggataataaaaattaagtaaaaacctaaaagtgtgtttgggttttaatgttgcctttatatttttttaatttctcttctgtggagtactggttctatctttttctcttttgtttttgcttggttttgatttttcttggaattgtgatgctttctgctgatggtgtgtgtgcgccttccattgcagggtttgcagccgttctgctcgacttcttaaggcccagggatttggcttctgtccagtgtgtcttggaaaccatgggacaccactgcgctaacgtgtttacatgcatctgcttctgtcttagtggctgctatgcctccattatctgtacatagagaccctgtttgatgttactgataaggaccagtgctgaatggaagataaccgttatccttttgccagagttggaaaatagaactaatttgttaattgagcaaacttaaggttttgcattattacaagtttcttcaaagacattaactctacaagtcagaaatgttacatcggttaggaggtccttaagacattacatttcccaagtatcccacgacttccccatgctttccccctccctgaacagcaagcaacttagttcccatggagggagagagttctttcctcacgttaaggctcagcacaatactgtataaaatggtgaggggagctgctgcaaagctgtagataggaagtgactagacacagggaaatgggaagtcagtcaagggtttctgagagagaattggaaaacaaacaaacagcaaatacctcttattgtggttgggaaaagatggttagtgtagacttcacctggaaatgtttgatcaaaagtagagaaaactaagcctggggaaataataaagacaaagcacattaacaaaagacaacaaacatagaaatgtcttgactttaatacagtgatagatttcaaagtgctttaaagatgaagcttccaggaataatatagagtgattttaaacatttttgttcaatgtattataatatttgactcaagtaggttatttttgtagataagctagtgatcccaggttatctaagcgcagaatagaatcagaaggtgaagtatatataccttgcccaggacacaaggtggtgggggtggtcttggggatggggggcaaggatagagaattcagtcagatatgtcttctaggcccagctttgccattagtaatacttacggccttgcacaaatcatttcacttttccagctcttaaaaaaagagtgggattcaatgaactctaagggcctttctaaaattctgggagcccataataccaacacaatattgcactctagttatattttctcagaatggaatgtgttttaaagtgcaattctgaaaacaacaacttgttttgggaataggtatggctggagaggaggaactgatgatgctttctcaagaattttgcctccacaaaatttggaaaatgcaagtgacttccaataggaagtttgctttttagaatccacaatgtctttttctgcataaataatggcctatggtttgccataggtttaacatttaaatgtggggaaagctatacatgtattatgtaattattactgttccaaggcccagtggtacaatagggagtttattataataggtatataaatgatatggcctttgtcttcagaatggcaaggtggagcctggttgtctaattgaagccgaattgtttggtggttcttataaaaaggtggtattcaaaaacgtaagtggattattaccagtacaagcacccgtaatactcccattctttcacgtctaggccaactggtcttcaggctgttgtctgcgctagtggtcatttgcttataatcattgtttttcctttcttgacttcctccaaagtggtaaagtgaaattcctcatgtggtcctgtctgccctccctctttttctagtttccccctcctaccccgtccaactctcaggccagggctacagaggatggaaggctattgccccctatcattgtgcactcttattacagagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggtgagagtggtgggcagctcctgggaaggtgggagggagtgtggctgagcttacttgacattcataatccatagttgcgccatgcagaagggacatgagatatatttggttctccctttgagagtccaatccagtatctcaggtaaggcccagtagtctagaaaagattcccaaaggattctaatgagcagccagattggagaatcatagatgatcccctcactataatcatagagaaactgaggctgtgaagtagtgatttgttcagggtaacaatgttagtcaataggagagtcacacttagaatgtagtctcttgacctaatccagtcagattgaagttaggtttgaagaaacagattgaagtctgctttgtgactgtagagcaagacatctccctaagccatctttccactgggtagatttcctgtgaattcccttttaggagtgtgtaacatcactgtaacctgataaggaccagcagatgcagggctcttgaatgatctggattgaggatggtagcctggaaatatcctttgaaaaaagaaggatatttgctggctagagttacccagcacccaaatatttggtgctttttggaatatctagaacacatggcaccccaccttgcagaatagtttgttcctggttgaaggctgtctggaaaagaatcagctaatcctgcttagaaggttaatgcagtgcaaagaaagagagcactgaggtgagaccaggaaagcctgtgtatccagtgatagcaagggcattctgcaggatattgcagcattgagatcttttcacaccccttatttagttgatccaaatgaatttgtggatcctttttttcccaagcaaggaaactaggacttgaagagtgactcttggctgctttaaggccaaatactgtattttaataagttctagaaccaaggctaggttccaggtcttctgattttctagaattttttctagaattgtttttcttttccctgctatgccatccacttagtggcaaggtagttaacctatctccactgtagtttcttctgataaaaaaaaaaattagaaatttagcctcagcaattttcctcatagtttggaaaggattaatcaaataaagttgttaggtggaatgaaaagcatttttttcttgttctgtccattagttttacagacttgattttttgttgttattttattttattgagacagggtctcgttctgcctcccgggctggagtgcagtagtacagtctcagctcactgcagcctctgcctcccgggctcaagccatcctccccagtagctgggaccacaggtgcacaccaccacacccgggtaattttttttttttttttttgtattttttgtagagactgggtttcgccatgttgcccaggctggtcttgaactcctgagtgcaagcagtctccccaccttggcctctcgaagtgctggaattacaggcgtgagccactgtgtccagccttagacttgttttttatgatacctcctttaagatagcagacatccaatcatgtttctcttgggtcttgtactattgcctgcaaagtgctgagctttaacttcatgaagtttcagcctgactttataaaatgctgcttcttttttcccctcagcttatttgaagctctccaagggtgttgtgtatctctagagtttttcagggattctacatttcgtgaaataacaactgatgagttccttgggctaccaaataagttagcctgaagaggcgatttcagaaccctgcttctgcccagcctgtagggaacgttttccctttgctttaatttcttcctaatagctagtccaagggaatggtgtggggagattttcagcctataggcatggactcaagtgtgggagttatcttcccaagtatttctcaaagaacttagaagtctaagaacttcagtcttaagttcagggctgagtttgaggaaggaacagcaggtctttcttcagagcttggactcaaagaacttcagtttaagccctgaagaaagagctgctgctccttcctcaaactctggaacacttgttgataagagcagctgacttgtctgttttccaattgggagcataatgatttaagaagaggcatggtgtcacattgagaagacactgactgcttctcacagaatattgtgccgccatgtggatatcttgagacagctctggggataggctatgtctctcctcgtccatagtctcttaacctgtgtttcctttttggaatgagcaatataagatggataaatgcattaggccagagtggtcgagtttaggagtttttcttagacattaaatagtgcagtagagatttgaccatcacaagtatcatattttaacccctaagcaaaagagctagaactcagccctatataactatttatcctctcatctggaggctgatgtttttcttctttctgtaattactcactaacctttctgcatgtgtttggtgtatgtgcttgtaggccagagtgtactgagttgatgtgtagttgaccctcgggggcaagaaagcttgtttgggatcaccctgtgtgattgaaatgaagtgctgttctggccatatatactactttttctttttttctttttttttcgcaacagggtcttactctgtcacccaggctggagtgcagtggcatgatcatggctcactgcagccttgacctcccaggttcaagtgatcctcccacctcgtagcctcccgagtagctaggactatacgtgcaccaccatgcccagctaatttttttatttcttgtagagatagcgtttcgccatgtttcccaggctgatctcaaactcctgggctcaagcagtccacacacctcagcctcccaaagtgctgggattacaggtgtgagccaccacgcctgacccatacactcttcttacagtccttcctgtcactctgcttaacttgatctgaatctgtacatagatattcactctgtgtttgtgttcactcagtaattcattcatttattcattcccctgccgtattccaggcaccaggctaggtactcggtatgggatagtatgctgaataaacagtgcctatccacatagaacttggtctgttgggaagccggacattaatcaagtaatcacataaatatataatcacacacatgataagtattgtgaagaagcacagagtagtgtgagagagaatgttgtggaaggggatgacatttagattggggctggaataaactgacacgtaagccaagacctgatggaaaaggagttaggtagactaagagtgatgagaagagcattctctgtaaaggaacatcttgtgtggaggttttgaggtgcgaacaagcttggtgcattgaaaaactgaagagagaccagaagatctggacagtggcatgggatggagctagggatatagacaggggccagatcatgtagggccctgggatttatcaccagactttttgctgcatgtctgtggctgatgctctgatggcagatttttttctttttctttaaactgtgcctgggtcctgttagcaagtagacttgtggaaacgcatgctcctaaaagacaaggtaggaagaacagaactaccaaaacaaggtctttggagaagctcagaaagcttgtgctttttgtttgtttttgtttgtttgtttgtttctcttgtttatctaactggaaccaccaggtgaacaagaggtttttagtgatttttgtttttgtttttgctggagtgcgttggcatgatcttggctcactgcaacctctgctgcctgggttcaagtgattctcctgcctcagcctcccgagtagctgggattacaggcatgtgccaccacacccggctaatttttgtagttttagtagagacggggtttcagcatcttggccaggctggtcttgaactcctgacctcgtgatccacctgtctcagcctcctaaagtgctaggattacaggggtgagccactgtgcccagccgtgatggttttatattgtatatctgaatataaactatagtactttggacatccttctattttgattacttcttttgcattttgtttctcccagtagaccagagcattctaaggttagggaccatgttgccattccatctttgtattcttggcacctggaaaagagcaagacattaatgttttaggatgcacagagaggaatttttgcttttagttagaaggaggtgagttgcattaagggttcggagagcaggatccctgattgcccctttgattctccttctgttttatattttgaccgttcccagtttcctcacttggtttttcttctcatctctgcaggatcaataagccgagagctgaggattcaggcgaataccactgcgtatatcactttgtcagcgctcctaaagcaaacgccaccattgaagtgaaaggtacaacccagcagaggctgtggtgtgagcctctcactctccttccaagacagtaccttggtctggagtcccagtcttcaagctcctcttctttccatgtcgagacacaatataatgttgtggttaggccacaggctcaggatcgtggctgcctgggtttaaattcaaaccccatcatctactagctgtgtggccttggtggtttactaacttctctttgcttccttttcctcatttttaaaatgaggatatcagcagtacttacatcatgggttatttaggaggattaaataagttaatagattgaactgcataaaattgctgtttttatatgtcaaaaatgtttgaatgctggcagctcctatggcccaaggctttgtaaagctcttagatcagtgccttacaagtatgattacataggtcttctgtgggccagcaggattgaggggaaagtacagtgtgcagagtggacatcagctgtttgtggataattcattagaattttaatagaaacctttgaaagatgaggcagtagcagaaagttccaagatgggcaaacagaactataaaagttggagctacccaacatcataaatttcagctttcctaagttatttcaaagaagcatctgagacccagaaaagtgaaacctctagctgtctgtcacacagtgagtttgtggcagagctagtctagaacacaggtcttgacccccaatccaatgttttttctactctcacaaaattatcatgagaaggcagggctactgtttgaggtcagattttttattttcagtctttctcattttgcttagtaaggacacagacttgttctttaaatccatagagttatccctggaagctagaaggacaaatttaggagaaggaagggcccgtataataggtattcaggtcttcctaaaatatttggaaggttaaaaatgcagattcaagaaaggcttagacacattcaaagtttccattatatggtgttatcaaaagaaagtaatgtcttggtgacacagccctgaacttgtgagttgatgtagggatggccactgcctcctccagctgccagtttaattctgaatgcctaaaggagttacagttacaggtcacactgggccagagaacttagcatttgatttttttagtggcttttcttggagaaaccttggtttctacccattttagaagaatgccacatgtattcaacatgaaaatgaaggatgtgggaaaacattttctctaagccagtgagggctttccccagcctaggtgagccaaatttgtggtgagacctctctgtgagacttgaggccgtgcagcattcctggctgagccttcagcacaaagtccaagtgcagagaggcagggtgggtgagggaaggaaagagtggggtgtctagttcattgtgctccccaagcctaagagataattagtcctaactaactgtaatcgttagtgactttgagttaatgatttctaaaaagcactttcaagagtggaaatcaaaatggtttttccatttgtttggctgcttacgaaggtggggtttagtggccctagaggcatctttcttcatagtctcttcagcaggtaggaagcagcagttgccagggtcagagaataggacgctgtaggccaggagtattttcagagcaagttacaacttacgtgttatattcaaggtgcttactgtgcactgttggattctcactgtacaaatagccctgtgtggaaggtgaggcaggtggtagtatcttggttttacagaagtagaccttgagggaattctgttttataaatatcttaaaccatattctggaccaccttggatagatatactgtgtgtttatctctcaagaaaatttgtaaaagaattctagtctgtctttccttctccccccaacacctggatagaaaagagttcaatgtttaatgtcttgtcttcccagttatggatagttgagtatggtaaagactatgaacacttcgctttttctgtataagttttaaaaggtttgccataggcccaggatcatattctaagctaacctccaattgtggttggggtagaaaaactgccttgcatttagagtagtacatgtgtgtatgttcccaaaacattttaatagaaactctcattttattcccttagtgtctccggggtggggataagagacagttatctttttatagctgtagtgatctgaaaaatctgctgagtaatagagagttaagaggtggttgtacttgagaacagagaggttccgagaacatcagtggcctcttggctgaaaggagtctctgagaatcttcctgtgtggctttaactgaatcagcacaacagggcatgtaattcagaccatgcatatatatttcttcatcatctattctgctctcagccgtttctttcccatctgccttttcctgtctttcagaacatttctggggtgttgtttgggctcagcactgtgggaagtgaagcatttagcctagccagggactgggcattatctgtcagattaccaaatcttgagttatctgtggtctacaaaagaaaagaaggctgaaggaaccagacagagggacagtggcctgggaacagagccaagatgatcatgttttttaaccaaagcctgtagatcaccgtcaagaaaggaatttggaggataggagtatctacatgtagtgggggaggccttgtatctggagcaggtttttaaattctctcccttttttttttttttttttttaaaggacacaatgtggcatagtataaacaggaagatactgttgagggttacgtttctcaggtattcggcaggtgatctgcacagatggagagaaggaagatggagcagggccggtcaggagagggaagacagcagtgatgaggccttatggagcccaaagccccacctccctgggatccactcagctaatactgaggagggcatctctgtcctcagcttgtgactcttcagaggctgtggtaccagagtgcacaccttacagagaatacatgaatgaatagatgttgaaattttctacccctataatttttcaaccttttgccccttactccttccctcttctccttccttccttttctaaaatttttttttaaaaagtgctcacaaaaaagcaaattaaaaatcccggtatcatttacaaagtaaaaagaaaaaaattgctctcatgactcccaagcagtatccttatcccttaaccattttgattagtacaagaaagaaggagtttgaattttattgctgtttttggaagaggattttgttggtcatccaatcctttgcaacaaatatgtcactgcctcttgtgagaggcacttcccagcccagaagggggttgagcctgttgtcttactaggttcatctcaccctccttattggacatttcaaatgagtttcagtcttttggctgctgagagagccaggattgatcttgtttttctcctccctactccttagctttctctatatttgactattaagaataaaggttaggatttctataagtggccttgccctgccttcctatttcctattctgtcatggtgcattacaagtgacatattaatccagactggctaaggcagtgtggtggggatgaagatcactgtgaagaacagtgatacccagaccacattcacacggcactttcagcatgcacagcatctccaccgtcctttcttcactgacagtcaggaaaggcagctagtgtgataggtgaggatgcgtagaggttgtgacatcctttaggtgagaactgatgtcaaagcaacctgcttctgactcagaattgctgtgacttgagaagtctttgaaggcataataatatcatgaagctgctagggcattttgaacattaacttcagcccaaaaaccacacctgcactttcttttcctctcttcagggtgccaccctgaccttccttaataagaataagaatagctaacattattgcacacttactgtgggtcaggcactgtgctaggtgcattatttgttccttttctctcctttagtctccacaactctatgggataagtgcaattattatctctactttccagttgagaaaattgaggcttgagggaataactggcccagtgtcacagagttaactggtgaagctagggttctcactcaggcaccctagcactagatcctgtgctcctaagcaccaagccatggtgccctgttgagcatgtaacatttaaaaggccttgactaagagttaggagaaatgtgttctaatcgtggtcctgccattaaacacagtgactctgaccagtcacttcccttctctgggtctcagcttcctcaagtgcatgatgaagtagaatgagatagctcatctttaaggttcctttgctctgtgtggctcttgacggtctaggttcccttatgtggacagagatgagaggttgtgtattagtgtttcctagagggacagaacttacaggagatacatatatgggggtttgttaagtattaacttacatggtcacaaggtcccacaataggctgcctgcacgcttgaggagcaaggagagccagtccgagtctcaaaactgaagaacttggagtccgatgtttgagggcaggaagcatccagcacgggagaaggatgtaggctgggagaggttggttattgcaggaagtgatttccaagcccattttcctagtgttattggaaaatttcaatttgtcagtttctcagcttggaaaagtcacctgaatgactcccacacctctacccactcatctccctgtcttgtggggggtatctgacctctagtactggtgccaggaaaggtgatagaacagtggttctcaattttgatttaattcatatgaactgtggctcgggcatcagattaaggcacatcaggtgattatggtgtacagccagggttgagggtcactgtcttcaaggaaacttctacacctcttacacagtggtttcacctgcagaaggaggcacctgtcctagactgctctagtgttcacaaccaatgataaatctgctgtgggtggagaatgcttgttgagccaaaagcctgcatccttcttgcttctgtcttgactgatctcatattccttcttgggcatagctcttggcaagcagtaaatcttcactctcccactgccgtcagccaagtgttcattttgtccaccacaaagataggtgtttttgggatttgataggttgcatgaaggaagcaaatagaccgtaaatgcagaatctctgtgtttacttggaaacaggctagtcattgacaacacctttaaggatagattttctttgaagataagttgctgggttatgaacatgctttaaaaagtgagcaccaaggccaggcgcagtgtcttgagcctgtaatcccagcactttgggaggccaagacgggcagatcacaaggtcgggagttcaagaccagaccagcctgaccaaggtggtgaaaccccgtctctactaaaaaatacaaaaattagccgagtgtggcggtgcacgcctgtggtcccagctactcaggaggccgaggcagaagaatcgcttgaacccgggaggcggaggttgcagtgagctgagatcgcgctgctgcactccagcctgggcgacagagcgaaactctgtctaaaaagaaaaaaaaaaagagcaccatataagcagtgtctgtaaagaggccttatatcttgatcactttcttaagtctgttctgttaactttatttaatatcatctgaaacgtgcctccatggcctgagttgacagtttctacagcatccagcctggcctagaagctgaccctttgctctaagtgcatcaggttgggtagcagagggtactaaggaacatgcattcgtcctcagccagagtcccagactgcccagataatgaaattggttcaggtgctgttgggtaacagagactcttttgggacccctgtgttgctatttattaggatactggagggatagccattaaccagtgtgactagaatatgtgactaacaaggccagagaatgaatgaattcctgagtggatcagaactctcttctaagggtctttttgttactttgttgctcctaccccttgctcttgccacttagtctgtgcccccctaagagggtaaagagaagcacagagtattgtctctgtctccttcaggatatgaaggcttagttagacgctcagacctgcttttagaccaacaaaatctggttaagcagtcccttattaaaaggcaagaccatagaaggtgaggcactaaaataggccattaatcagataatttatcagtatctgacatgattaaaccttatttttagagctacaaacaaaagtcctgtttgtatcagcaaatggggagagcacatagtaatcagtatctttgatttcttagaactaatgacagagtcgaagccttagcctttcctttccctgactgatgtttaaatgcttggccctgagttccaaccatgttctagattagtatggagatgtaatttaatcctcacaagacctctgaaacatgtgagtattactcttattttacaatactaaaactcagagtatttgacgtgatctgccctgggttactcagttggtgagtaatagagtcgagatcaagtccagatttccatgttttcaggtctgaagctctgctctttacgctacactaatacagagtaaagtctgacaggtaaataggttctgctttgggtctaaggtaaattggttctgctttgggtctaaggtgttttagcacatctacaaggaaagataacttttgggctctttgctctgcagttaccagtaatacatggtaacaaatatatacatatataacatgtatatacatatatacatatataacatgtatatacatatatacatatataacatgtatatacatatataacatgtatatacatatatacatatataacaaatatatacatatataactatattatatataatatatatatttatgtatatatatatttatgtatatataaatatattttgtatatatacatatatattatatatattatatatatattatatatatattatatatataatatatatattttaaagttttactttaagttctgagatatatgtacagaacgtgcaggtttgttacataggtatacttgtgccatggtgatttgctgcacctatcaacccatcatctaggttttaagccccacatgcattaggtgtttgtcctaatggtctccctcctcgcatgttgtatatttttatttttgtggactctattctagtttattttcccctcagtatgttaaagtacaaaaagcatagtctctggattcacacaaccctgaacttggattctggctttaccatttaaacattaaattacttttccaaacttgagttttccaattttaaaaagtggggtaatgtctgcttcatcaattggtatatttgtatctatacatacaaaaatgcataataaattaccccaaaacttagtggcataaaatgctaagcacttaccacctcacagttttcctgagtcagtaattagggagcagcttagtggggtgttctggcttggggtctttcctgagattttggtcaagctgttggctggagctgcagtcatctgaaagcttgaccagagctggaggatccactccatgtgtacagctcactcacatggctcttggcagtggccctcagttcctcagtgtgcccctctccattggttggttgagtgtcccccagtatggcggccaccctttcccagagtgtcaaataaagaggggaagtggtgttctcctcctcccacacaccaaggcaggagtgaagactgttcctagcccccttcccaatcttgacctttaagtctgggtcctttcagaatagtgacttttcagaggcagtgcagctgccgactcaacttttagcattctagatggttctaatgtacagtcttggaaatgagtccccaaagcaaaagctgatagtactgaattcatagtactattgccaataactggcccaaagtgggtgtcttctttgggtcaaaggagaatgaaaatgggaaaatgtaccacatataagctgatacctgaaatttatatccctaacatagaacatttccctgaactccagacttgctcttttactgcctacttgatatttttacttggatttttttttttttttttgagacggagtcccctctgtcgcccaggctggagtgcagtggcgcgatctcagcttactgcaagctccacctcttgggttcgtgccattctcctgcctcagcctcccgagtagctgggacaacaggctcccgccaccgtgcctggctaatttttgtatttttagtagagacggggtttcaccgtgttagccaggatggtcttgatctcctgacctcgtgatccgcctgcctcagccttcccaatacttggatgttaaataagtatcttttttttttttttttttttgagacagaatcttactctgtcgcccaggctggagtgcaatggcatgatcttggcttactgcagcctccacctcccaggttcaagcgattctctcgcctcagcctcccaagtagctgggattacaggcacctgccattatgcctggctaatttttgtatttttgtagagacaaggtttcaccaggttggccaggctggtctcaaactcctgaccttaggtgatccgcccacctcggcctcccaaagtgctgggattacaggtgtgagccactgcacctagccagccaccacacctagccatatgttaaataagtatcttaaacttaccatgttctagaccttgaccttctggtttttaccaccactgtttctcagtcttttaacaaaacaaactaagattaagcaaacaaaaaacactcttattcttttgcaattttcctcatcttagtaactgtcaactccattctcacagttacacaggccaaaaccttggtgtcatccttgactccttttcttctcacagtccacattcaatctattagcaaatatgttaactcaacctccaaaatatacctggaatctcaccatttctccttatttccactgttactgcccccatggaaaccagcctctcccttgcctgggttactgtaatagcctcctgcttggtcttgcttccactgctgtctctgcagttcttgttcacatagtagccacggggagcctgttaaaacacacccatcattttatacctgcacatagtattcaccagtggcttcccggctgactcactgtaactgccaaagtcattatggtggcctacaaagtcctgtctaatctgggtccccagtctctctgatttcttttatttcctgctctcttctccttgcttactatgttccaatcaaatcctctttgctgttccttgtacataacaagcacaatcctacctcaagacctttgcatttccctcgacctagagtgttcttcctacagatatgtgtgacctactcccttcttttcttttttgctgggagaccagagttttattactattcaaatcagtctcccctagcattcagggagcagagtttctaaggataacttggtggttgggggaagccagtgagccaggagtgctgattggttagagctgaaatcacagggagtcagagctgacttcttgtgctcagtcagttcctgggtgggggtcacaggatcagatgagccagtttattgatctgggtggggccagctgatccatcaagtgcaaggtctgcaaaatatctcaagcactgatcttaggagcagtttagggagggtcagaatcttgtagcttccagctgcatgactcctaaaccataatttctaatcttgtgtctaatgttagttctacaaaggcaatctagtccccaggcaagaagggagtctgttttgggaaagggttgttaccatctttgtttaaactataagtttctcccaaagttagttcagcctgcgcccaggagtgaacaaggacagcttggaggttagaagtaagatgaagcagttaagttcgatctctttccctgtctcagtcataattttgcaaagacggtttcagtctctccctttgggttttataacaccttaatcttaaggtgtaggctctgaagatggcaaaaggccgtagatcactctggcttcttcctgctgataggggacattgtgggaatgggagtgaaccccaaggtgagaagagtggaaccaccttgtaactgtctgagtgtactcatgcaggcctggctaggattccaaggcttgtgtgggaaaaacattactactctcatctatagttttactacagtgtttaagtgaacagcctactgtaaggtaaataacgagtcctaggatgaggagtacaattcccaattttaaaagcaaagatttgaaagcattagtttggggacttccaacccacaaagaatttagaatttcatctaaactgcagaaaaaaacctcaagaacagctaacaacagtatactatagtttttcttttgaagcgtaatttttctctctccagtccccatttttattaaaaacaaatcatgatagaactgatttatttataaaataaacttattcttactgtacttggcctgattatttgcataaagtgcagcaagagtagttatttttcacttaggctttttaaattggctttgacagaactctgttccatgaagaatctcagataagactgttaaaaagtcgagcccagccatgggtttgtaccctcaaatacttacgagttgggcaaattcctctcctcttgaggtcccaagataacttggggttcctggcctgttagaaagtgacattcttagccaggcgcagtggctcacacctgtaaacccagcactttgggaggctgaggcgggtggatcacttcaggtcagtagtttgagaccagcctggccaacatggtgaaaccccatctctactaaaaatacaaaaattagccaggtatggtggcagatgcctataatcctagctacttgggaggccaaggcagaagaatcacttgaacccggaaggtggaggttgcagtgaaccaagatcacaccactgcattccagcctggccaacagagagagactgcatctcaaaaaagaaaaaatacattctttacttaccacaggtcaggaaccttgtatatactcccttattttcttcacgaccatgctaaagttcatctcatcacaaaagccttacccaaccagtctgacatatctggtgtgtagtgggtgctcagcaggtgtttgccagatgaatgaagcatggctggctggagcagcacatggtaacccttcgggcatgctgggtcctgtgtggctatggagcctgctccttggagtgcttggaatttatggactgaagtaagctctgagaaagggtgaccaggttgaacagtcagcctaagaagtgactgagtagctgtgggaaaagttcggctttgtgggaatgagatagagccaggttgaccacttccttctgtagtaagaaactttgcctggaaaaaaaaagatatttcctttgaaacgtactatctagaaaacacttcacactgagtgttactcagcaggcctcagtttggcagggactggttacagagacagcttggggccttgcccagtgcatgcccatccaggtgcctctggagggtgagtctaaaaccagtttgtgcctgggaagcacattctgtgactagtaggactttgcattgtttttaagccaagaaaaaccaagccagtcaaaggtggaacatgagattagccccaatgcaatagtacaggcttctacagtctcaagatgaatgttttgacatcctgttcatctacccaagaacactgggaggtagacaaggacacgaggtgtctccatttgataatggctgtagcagcaaagcccagaataacgaaagaaccaacaaaactggaattgggaccaaggcatatcgattctctttcctatcttggataacagagtgacatccagcctgctttgacttttattgctctcagattactgtaacccggctgggcgtggtggctcacgcctgtaatcccaacactttgggaggctgaggcgggcagatcatctgaggttagcagttcgagaccggcctgaccaacatggtgaaaccccatctctcctaaaaatacaaaattagccgggcgtgatggctcacgcctgtaatcccaacactttgggaggccaacgcgggcagaacacctgaggtcaggagttcaagaccagcctgaccaacatgatgaaaccccatctctcctaaaaatacaaaattagctgggcatggtggcacatgcctgtaatcccagctactcaggaggctgaggcaggagaatcgcttgaaaccaggagttggaggttgcagtgagccaagatcacaccattgcactccagcctaggcgacaagagcgaaactctgtctccaaaaaaattactgtaactggtgaagcattggcgggtaatatagttatgataaaataaagctaaatccaaagaattcgcttttatctcaggcttctttgatccttgaaacttacttaatttttagactacagttgttgtttatttcttcctaagtgatccctataaatagagaagaccaacggcctctagcatgtcttgaaattccttctatattgggttcagtctaggaaactgttgcaaatcaggtgtccaaggcagattcttaagttgttaataaaaggtcttagggccaggtgcagatgcaaacacctgtaatcccagcactttgggaggccaaggtgagaggatcacttgaggtcaggagttcaggaccagcctgggcaatatagtaagaccccgtctatacaagaaatttaaaaattaaccaggtgtagtggcatgtgcctgtagttctagttactcgggagctgaggatcacttaagcccaggagcttgaggctacagtgagcagcgatcatgccactatgctccagcctggacgatagaataagaccccatctcaatcagtcattcaattaaaaaaaaaatctcttgggacactggttgaatttcctgttcattcctttcttcctccttgtgaagaccagtttctggattccctctttcctgggagagccttggtcattgttacttattgagtagcttctccaagcattcattgtttttacataccttgtaataggacttgattgtagttgttttatctcagaatctcatttccttaagggaatgtgtgatatttgacaggatgcataactgttgttcatgcaggtgttttaagaaaaaacttgggccgatagaagagataatagtgtttgtttgcattttctttaaaggtaggcttaattgagggcagttggacctgcatccttttccagtaggttggagaatcacctacattagtagagcctcatatattagtaaccctggtatctgcctgggcatctttagcgggtggggggtagaggatgggtttggtccctttaccctattctgacctgaaatgctcttcatcaaagctgagtatgacagtaagcataaagactgactacattacaagcagggctctgagccagaaggtggggcctttgtatcctgtttggagtagacttccgtggtaactgcgtctaacgctttctcacagccgctcctgacatcactggccataaacggagtgagaacaagaatgaagggcaggatgccactatgtattgcaagtcagttggctacccccacccagactggatatggcgcaagaaggagaacgggatgcccatggtgagtaggaggcaggcccgggtctctggttgctggagttttccctgcagaggtccagacacgtgggtcagttactgtagtagctgtatcctcggatgtgtgcatggcgagggtcaccctttctagagtcacggtttacagcatgaatcaagaggtcattgacagtctcttccagcacaaaaatccctgtacgtgatttgttaaagctgtccctctggtaagagattagattgctcactgtattagtccattctcactttgctctaaagaacttccagagactgggtaatttataaagaaaaaaggtttaattggctcatgattccacaggctttacaggaagcattgccggggaggcctcaggaaacacaggaaagatgatctttcctatcttagacaacagagtgacatctggcctgctttgagttttattgctttcagattactgtaactgaaggtgaggcattgacaggtaatatagttaagataaagctaaatccaaagaattagcctccccctcaggcttctttgatccttgaaacttacctattttttagactgcagttgctgtttatttcttcttaagtgatccctgtaagtagagaaacttagaatcatggtggaaggtgaaggggaagcaggcaggtcctaggtggctggagaggaggaagagagtgaaggagggagatgctacacacttttaaacaaccgggtctcatgagaattcactgtcaggagaacagcaaaggggatatccgcccccatgatcctgtcacctcccacaaggcccctcctccaacactggggattataattcaccatgaaattggggtgaagacaaaatccaaaccatatcacttgccttcaggataggacactgaaagaaccgagcctaattctcgtccatttatcctgaagaaaatactgtttttgaagtggtcttagagaacctgccttgtttttttagtaggaaacaaggtactgagggcaattattagtacattcctgcaacacagaacatactgataaggaattggggcaacctgaggaggcccaaggtactgagggcaattactagtacattcctgcaacacagaacatactgataaggaatcggggcaacctgaggaggcccaagggcagccttggcagccttagacattgggaacctgacggtatttgccccagaaaatgtcaaagagaacatcttttccgatcagtgggatgattcatgatgttgtttggagagtcagagctttagaacctcactttctctctcattatgattgttgacccattaccttttctgtcagagagcgtgtcaagcgttcctctgatcccatggatcctctttgattatcagtcttcagaatccaaaaggaccttaaagatcattaatccatcttctttggaagggttccatagtagccaagataaattagtggcaaaaccaagagttgtatctagtttttttaaatttcaagtccattattcttcctacttcatgacatcttgataataaaatgttgagttgtgataatgactccaacatcagcgatgatttcagagacccgttaacgaggagcaggatgaggattgccgaggtgaagatgctgagtcttttttacaagacactgaactttctaaggcactggagaggaaatgtccacttctctctgctggtcactgggaaggagtgcccttgagcttttgccaaagcaggttggaattaacgcagtatgtgttttaatctgaaagatgaagcttgaggcatcacagactagctgttttaaaagcttacgagttccccatttcagatgtacctgcactcaaatgctgacaagattgtatgccatatctagaatcatttccaggataatattcccctttttctctcctatttctgattgtgctttagttgttgcagggtaaagacacatgagtctgttttttccctgccgggatctcatgagctgagtgcagtgagccatcccgctgagtcccgacctctgcctgtgcactcttgcacctctgccttcacacccatgcgaatccctgcctgcactgctcctccctgtttgatcagctgtcctcctccacagtctagtgcaaatgttagctcatgtgtgaagctttccctgactctttccagcagtggccactcactgtgccctacagcactctatacacacgctctgttggggcttcttaacacattcctgaaatcagtcatccctttttggatgtctggttcccttttgaggccaagctccttattcatttctaggtctgtcttctccctatctcaccttctcactcccacctgcccttagtaggatataaagcatgcagcatattttagtaaatatttgttctcttttatttgtttgttttgttttgtgttaagacagggtcttgatctgtctaccaggctggagtgcagcaacctcctgggctcatgtgatcctcctgcctcagccttctgtgtagctgggaccacaggtgtacaccactatgctcagctaattttatttttgattttttgtagagatggggtctcagtttgttgccaaggccagtcttgaactcctgggctcaagcgatcctcccaccttagcttcctaaagtgctgagattacaggcatgagcctctgtgcccagccacaaatatttgttgattgattgaataacctttcctctaacctctagtccttaaatgaaaggaaagttatgaatttcccccagtctgactaggagtgagttcttagcattgtttgtggaggaagtttaaggagacttcctcagaactcaccaagtgtgaagtcagtgtgctgactctgaggtcatcagagaggcctgaggtccccgaggcatgcctgactgtaggggttgtacccctccttctgccgtcctctttctgctgtggtttcttacctggtgttggaggcagcatttactaggttgttggacttttctgagtctccaggcagtaggacctgcactcacttcgtggaagtcggggaagtctggaggaccgatggtaagggaggcttgcctggctctgtcagaagttgatttgttgttgttgatactgaagggaaatcattaatgaaatgttcctagacactgcttcctcattctggctggtgcctaaaaagaacggagagcagtgtcaccctctcttgaacattagctcagttactcactctcacctttgtgtattctcacttttttgcaggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacggtaagagcatccctacaaaatagctgtactgctggggttggttccttcgggtggtttccaagtacccaaagaggactatagggatgttgggattcaatccctaaaggaaagaaggaaaattcttataccagttcctaaccccctacccgtaagagttttttatttttattttttatttttattttatttttattttttttgcattagccatctagagctgtccttagctctctccctctgtttgggtgttttccaaaccctagtcccatctgcctttcaggccccatgtggtgaatgggcagctgtcagtctctttgttcagctctgtcctccttcaatacagatcatcaggcagattgagcttgaggagaatccaagtcaagcctagaagccaccccaagatggcaggccacctggcctttcaggcagatttaaggtatctaactggttgtcacatggttgcctggtgtagcccctgtaggtaactgccccagcccagtcagactgttctcagaaaagccattggaacaagccagcttttggttccttggttggtccctttgataggtttccagcgctctctgctgggtggctttccatctgtgtctcacagacaaaggagagtctgatgtatccacccatctagtgtaagacagagatagcaaaggcggaacaaatggagtccatgccccgaggctgtgccctcaagctggcctagggtcagagaagggaggagatggtagcagcagaaccacagcacaccactgagcactggaaagagcaagagctgaaatcttaggttattggatatgcctagagtcagaaaagccttgggaaatttttggtgatcgatttttcctgtgaagggggaagctgctgatggagacttgtatctgcagtacttcaggttcccagctggctccccatccccaccctataacatgaccggcgtacagaaattaattggccgactgttaccaccactagtctgtccctggctagactagacagatgggtgtgcccctgggctcagtggtagcctacccggggtgatggtggggttgccagctgtagtccagctgttctggggcctgtgtttgtgcacctgtggtgctgtatcctgccccacagagctggctgtccagtggagaatacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaagtagagtgagtggctggtgaggaggtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgttcccagcagaggtctagtctttgccctaagaagtcaccgcgcttatgaggttgctatcacagtgcatgtggtaggttagatttgagaaatggttaggattgttctgttggataagtgcagacacctgcccagggaagcagctctttttttgtaagagttttcttggttactgaaatcaaatgggggaccagtttgttataggagacatctgtggccagcaaatctgaacagcttcctagagggaaagtacctcttttaaactaagttattatagacagtgaatgaatcctacccttaaaagagatgacggcagggtaagtgcaaagtaaaacctccttgctctagtctcttgggagagtattgtaatgaaagcagcgtttacttcgttgttgttgcattggggtgaaaaatctgagatgctggaatgatggcaatgtttgccttctctccttcccttcctgacagccagtgtgggccaggctccactctccatcttcacaccctgcccttgctccagtatttccattctgtttttctcctctgtctctttctgtctttctctcaaactccatcctgcttccacccctgcccgcttttcttctcctttcctggaagtaatcattaaacaaaagaaaaagttgaatgttctttggtgagtttccttcttctctgccttttccttctttagccagttcccctcaacccctgtgcactccataggaaggacaaacttacctgtctgcttccttcccatgtgcttctccccaaattttcatatagatatatacgtacactccttttggaataaacgaagaggtacattatatttgacacaaacttgggagtgttaagaggtcataagtgtttacctatcagataaccatctgtggctctgtgttggattttttttataccattaggaaaatgggaatttttttataggcctgccatacttctactttgccaaatagcactttattatcaagatacacccatggctcatttcagactcactgaactttttttatatgaatgcacagtcgtcatattttgggcagtctgtgagttcttggtaactcatccccttactacaaaagcactaagtgaacaatacaaaagtataaaagcacaaatttgaacttacatagtttagtttaagtatgtttcactagaaaatcaaatatttagatttctcacattgaaaatgcttaggattgaggtttagctgcttcctttaaaaaaaaaaaaaaaaaaaaagccccatgtcttttttctttacctactggagtattctcagaccatttcctacatgaaaacacccacctgcattcctttagtcccctgtatggtctctttgaggatcagtgcccactaggttgtcttgtaggtggactaatctacagatcacctttaccttcagtattttcaggaacaagtgaatcatggagtcaaataagagctttgttttgttcacttgactcaccacttgactgtattccctgaaaatgttaaatgatagttctctaaaaagaccaggtcaagctagcagcctctaggcttccatccatgtcacagctgggcacctgcttgggtgcaccttctgtgttggtgtcctgcggactgcactccaggagcagtcagcctgtgctcctgagtctcccctccccaggccctggaggaatggggagtgaacccacttagttgctgaggcctgcagttcttctggatattttagtgacctcacagacagcaaattaaaacaggagctgatttaagaaaagaagtgctggtaccaaaaaagaactttctgtttttaccttgggataattttttataagcaagtcaaagggactctctttaagttactgatggagaagatatttgaggttttttggggggccatttttagtggctctgatatatccaagctcttttagacactttagaatgaagagctgttctaatgttccaaaatctattcgttggtcaaaacatttggtagcatatgaagctttatacagactagggatattggaaaagaaatgtgacttttaaaatgacacctaaaacatgcattcggtgtctggtctgttaactaggggccatctgggtcaataacaagttacctcatggagaaaatgcaataggaccaaacaaggaaggaaataggaagtaactcagtctctcttgggtttaatgctaacctgctaaggtcaggcaaaatttaagtggatttagaaaccataaaaccttctagtgagatgaatgcagtgacaaaggacctttgaccagagagtcaactcttcattattcggactttaaagccatctttttggaggtgatattgtattaggcaatccgttatttactagacattgcagagcaccccttctagatgatgaggcggatatagggggagtgagggctgtggtccattcggttgggaagatggaacacgcagataaatcagtgtgtgctacagttccaccggtaacttcactctcataaggtggattccagaagcatcttgtttccattatccccccagtcctcttcctctcatctagccagtggctgtaatactgaggtggagagaacagtcattgtttaagctggctatcttttggcctgagggtttggggtatgttgatatttgtcggttactatgacttcttttttttcccccctcaattgcatcaaacccttaaaacatggtggtaagtgagcgatatgcatgcttttggagtttgtttaatctccgcttcagtctatacgatgcacagttcataatgttaacacttttcttcaagtttacttcattcactttcacaactaatttggatttcagtttgctgtttaatcctcatttactttggtttctgtatcttttttctgtaattctgttctttccctctcccctgacttccctgttaggggtcaagtcgtttttttgtctgacctgtaggggagagtggtgctgcagatagtgattcagtccaggagagtggggagacatgaggctcttttgtttgtcagtgtgaaagtggatttggggagacagatgaagagggctcctgggattttgcccccttgtgaatctcaactgctcccacttgcaggcatggcagctatgccggaggcactgtcgctaaaacacctccatgcaaccctttgcatgttaccagcttgttgggctggaaagtgacattactaatcagacaccagggaatacccacactccaaaaggaaaaacagcccgtggtgtgaggtgcttgggttggtgcctacagtgtcatgctttgaaaagattagcctggctattgcgattctccctcccctgctttttattttaaatttgggagtagattggtgtattcttgattcggctctcttgcattagaattttgtattttcgagtgcacagccagagcactaaaagtattccaagtttgctcctatgtcttttcatttaaatccccaaagtgcttagttcctagcatgtagctgagctggcttggccgggatgctgagcattaggatgttgtgaggggagaatttaggctgggcttttgtgtcttagtacctggtatgtctttgtatctctccactgcatacacagcacacagatgtcttgggtgtccttaagtcttagtttgttctctgtacccgtttgatagtgtatactgttgttagtagtggactcctgtggacactagtgtgtcgctagcctattgttttggctgatgagtcattggtttgtggttagttcttttttttgaaatccttttttgctccagtcactgtgtgtgctggcggtggctttgcctctccgttgcctcgaaggaacaggtggagcaatgtctccctctgacagacattactcccgacatgtgctcctgcagatgcctacactgagactgtaatctccataactgcttcatgtgcaccaagcccccttgtggaatcctgctgagaatttttctagaagccttcagtgaaatcaaactgttctgaatcatttagtttacctgacttttgtataataaaaacaaactaagagcacttacttgttcccttccccttgtgggtctttttaaaacattctctctctgtgaatgtgtatctctgcttaaaggggatcaagttgcacttagttgaaacacgaaagacttataaatcagaatcataaagtatcaatttaagaaggcttaaactcatataatgtcagctttttgattttaaaaaagttatctcatggctcccctgggtttggcttctggttttggccagggcacaggagtgagcctgtctttctgaagtcttttctagagggatgtcaccactgttcagctttcctcggtgtgtcacagaacatcctctggtatacatacacttgttgctggcatagcccagcatggctgacccaatttaggttgaactattgtgattgcctcttctcaatctcattctccagactaaagactcttctaaagattacaaaacagcaagaaaaacagagtgccctttggggaagtgaggatgtgtggctaaatgtacagatggtacacatccattcacattgcaggattgagccaaaactgcatgcattcaccacaagaaaacaaacagcaggattttacaactgaaatgttggtttgtcttctcatctatttaagagtgaaccactggaacttggggacaagatgagtataacaatgttgcagcctatctgtccgctacagttgcagtttttcatgacaagcattcaaagtgttaactaaaaccattgaaacaacatacctgccatttaaacttgaatctagaaataataactccatgagtgttttgcacctccagatggaatggcctttaataaatgctgtgagtagccatgattgccacttgcagtttgctattctgttaatccttatgcagaatctaacagttttctcctttcttctcttatctctcatggatttttaaaaaactgaacaccatgtagatgatgaaccagctggaccaatgtaagtactttattggacattgattcaacagtatctgattgaatgatgttgtgtttgcagtttaatcaaatggagtagctaagattggaggggaagacagtgagtggaaatgaaggttgcagtgtagatttcttagcttgacacagatctgactaaaaaccacttgattctcaggataggttatgcagtcttgttttccagtggccatacaaagtggaataccatgcaaaaaacttttttttttttcaaattttgtgtatttgatatacttaaaatgtgggggaaatggccagtatatctgaggctcccggttttgtcaatgttaaaacgtttctgatcccaagcatttcagatgaggaatactcaacctgtagctacttaaggaatgtttttttatgcactcatattgtgccacaaaatttctcactacaccagggatggtagtaaaagggtccctgtatttccatgtgttatactttcaaaagttgttactgaccgagtttaactcatgtaatgcaatttgaggctgaactatagcctggataaactgtctagccccattaacaattgctcgtatccaagagagagggtactgcaggtatggaatcaatctaagatcggcagaatctcctagagttggactaaagagtgagaagcagacaaacagcacccaaatttgttaagtaccagagggcccagcactgccagcttatgattaccttttatcaagaagggacagtggtgttgtgttcagtggagaaaagttttacatattctcacctgtatcgtaattatagttccggattcgaagggaaagtactcgtctgccttgggggtcaaaaggaggataaaatgaggtatatacaggttgagtctacctactaccaaaatccataatctgaaatgctccaaaatctgaagttttttttgtgtgctcacatgaggctcaaaggaaatgctcattggagcattttgaattttggattttcagattagggatgctgaactggtaagtataatgcagatattccaaaatctaaaaaaattcaaaatctgaaacatttctgatcccaagcatttcagatgagggatacttaacctgtagctacttaaggaatgtttttttatgcactcatattgtgccacaaaatttctcactacaccagggatggcagtaagtgaaagagtccctgtatttccatgtgttatactttgaaaagttattgactgagtttaactcatgtaatgcaatttttcctccaaaggaaaaccaactctaccaacaatcacaaagataaaaacttgcgccagagaaacacaaattaagtactgcttacaatgtaagtatggccttctgtagcagtcttaaaaattatattcaaatgaatgtgcctctattgaccttgttacaaattcttcagtaattggtgttataagatattttagttcatttcagagcagctgatactgatgaagccagttctgtctgcccagtttagggactggaaaggaacatttttcagctgcgttgttttttgttgttgtttggattttttaagatggagtctcactctattgcccaagctggagtgcagtggtgtgatctcggctcactgcaacctccgcctcccgggttcaagcaattctcctgccccagcctcctaagtagctgggattacagctgcccaccaccatgcccagctaaattttgtatttttagtagagacggggtttcatcatgttggccagggtggtcttgaactcctgacctcaagtgatccgcctgcctcagcctcccagaagtgctgggattacaggcatgagccagtgtgccccgccatcaggtgcattgtgtcacatgtttatataaatgccatttcagaagacatattttaaaatcaacacttttcactactattatatctttacaaagaggtgaaaattgtcaccttcttaggtggcttattcccagaggcctactagtcttacctcacgtctgggggcaagacaagaatggccaggtagcagcagggccagaatgtcatcttgttaggcatatggagatcagaatttcacaccacatccctgagcgtgctgtttgaaccaaagttttgtgtggcacacggtgtagttgtgagtgacagtgcataatccctttataatttccaaatacatatttctttacagatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaagg

SEQ ID NO: 36119 - DNA, 8080 bp, Homo sapiens
aaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtaggcgctcccgggccaggacccggctggggtcgggggcgcgggacggggtggtaggcaaaggtgcttggggtccggccaacgcttgggctgggcacagggcggatcagtagattgggtcagataagacgccatttgaccaggttcacgtttttgtggatcgaggggtttcccatggagtgatataatgggggcgcctagaggaagtgcagtgttcagtggctttctctatctgttcctttcctcagcgcccagtgtagcgcgtggcgttccatataagttgtggaattgaaatggattccagggccatgccattccccttctctcattctcctcgctctccaccccccctcccccgccaatgtcctggaaggacgccctttagtgggtgcctcctaggagcttggagcagctggcagctctcttgccgggcttgcacggcacccgggctcagttgtaggtggtaagggggctggaagactgtgtccggctcctgccttggggattccgaattgaatccgcgctgagactagaacacgccctcccaagggagcagtcccagagtcatccacccgaggcggaggaatctgctcggagtagaaatgttgaaaagcccacaccggccaggaaccctcgcttcgattcactttattttccagccagcgattttcctttgaacatagggatcccatccaggaggaggagacacagctcctagaaacaggatccgccgggtcctcctcctgcgcgggtagacgcagaacgttcccacagtctactttatgcgagcgtggcacccctgcttgaggcaccccagagcaccctcgggccgctccttttcacccgaaagataggatcaccccccagttaagtcgcttctgggttttccgcaactcacctgacactcccaacaccccgaccccgtcccggggctcgctgctgccacctactgcccaacccgaatgaaatttcagacgcatgatcaagcccagtttaatagggaggaaaaaaaaaccttttcttctccatgactggggctaagagctgttctgggacaagcatgtatgtgtgtgtggtgggatgggatgggatggggtgggaggagggggcagcaggggatttttctagctggtgccagagcagccaggcctcttagaggtggggtgagtctggccattgtgcaaccccttccagttcctctgagcagataatagctgaatccagatggtgacagcccgtgtgtcaccgtttccagttgagtctaggatatgagtaactggactgaacaaaaggcctttaaagagaccagccagcttcctagaagagaggagatgctactcatttctaggggtggggtcgggtgtggggggataaacaaacaagtggaaaacccattcgcaggattccatacccttcctgtgagaattgtaactcaaggctgcttacacttgagtcggactgtaggcaggttgcttaaggctgcattgtcccagcctccccctccaagtcatctgttccttctgattaatgacagctctgcatgttctctggcccctgcttccccttggaggctgcagagtcaccacattctgtgccctttctgtgttgagcactttgggtctgcaggaggcacatgcacgtccagggactgcttttcagctcctggacaggccaggggcttccttctatcagccactcaactagtgtggcctgcaaacaggaaagggccacagagggtggggggtttgcttagctctcaggagctgacagaagatgggaacatgtacaggagacagttctttcaaatcatctgtgtgaaagcgggtaaccctttgggtatttgcaagtctagagctttaggtgttactggttttaaaggtgtcaggggcagctggggctgcgtaaggtaaggtggcagaggaaaggagtaggtgaatggaacttactcacatcctaagcccacaggttgagaacttctgttcagctccctcaggggtttgggaggctgcctttgcttttctagccccctaaacgggccccccttctctctacaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagaggtgagcggccgccacagcttctcctgtggccttttggaaccaaagcggaggtgcaggtcatgtagttaggtgctgtgtgttggtgcaaaacaaagtcaagggctcatatgtcccagatttagtatttagagcttctgttcctgaggagtcacagccaaggttggtttattctgcattctcttggacggggcctggggacaccgtggcgcttctatgggatggcaagtgttgacagggtgctcttcctctcctaccccaggatcaggttcattccccattgttgtcagaaaggtcagttgtctggggtacaaatattaaactgccctttacgatattgccttctgaaggaagtgttcaaatctttgcttatgccaagtgctgttttgtacctggaaggtttcacagagctagtgagactgtcatatatgcagaattccaccctcttgtttcacacagcattcctctcccatcccagtccaggttctctgtaacatcacattctctggtgactttttagacagcttgtttggatccgtcttcagaaaatagccacattgaatagtaaatggaagttggttaggatggattgctaaatatagatcatagcttacctcataaagaacaagatgagcttgataagagagtaatgaggcattaagattcaaagctgaggtttcagctagagaattcaggaagccgcatgagatagaccacacttgattttaagagccagccacatcccttgtggaaagattacaagcagtaaggctgtaacattgtagaggtgagagtgagttagtttgttgtaagaagtgggcttatctcacctgtgcatttttacctttgactccagagcatatgaaacagtacagggttgagctgtcataaagcatgactttgtatctgacctcgcaataattattggaacacactgattagcaaagaaaagcaaactgttggcaatgaagaagtttctaattcctggaacatgctcctttgatatggtgatgcattttctgaaacatgccttacacacctccttactagcttttgaaatctgcattgcacaggcgaatatcatgggcatggggtttggcaacccgggggttaagcaatgtcaggctgacgctattcgtgtaaccagcacaggtgcagggttttagtgctgtagcagccaatcaggggcagacagtgtgggttgagtcatattttccgtttacagaaccaatgggtattttacataacgacagggaggtcacgctgaggacatactgaagttagcacatgtatactacactccagggaacaggaaggcagaaaaaaaaaaaaacagacctttgagaggaaaaggaattgacccatcagccagtaccaaatgtttgcatttaacttcacaagtgacttactgaaacgggtatttcagagaagcaggcagagacagggtgtcactggatatcagagcttccccaccacatggctttgagctttgggggatccaggagacttgggtggctggttctgaataaggaggcacctgcagcttcataagagagcctttgactgaaggtgttttagactttcgttgttacctgaacagagaccccccctgtagaatacatatgctcacatgttgatgtgccatcccagggggagtgtgtgtccctgtgtaagaatttcagggtccctgcgtccctgaaatccatcagccacttttgtttgctcgcataacctctctgtccaggcaaagtgttctttgcagttaaacaccccaataaatgtaattaacattccttgcaactttcccatcctaattgttgcagcctgggcccaggaggacaaagtttgctctgtgtgcatgtatcagtgtgggcaccagcgctgatgacctgtgtgtaatagcagtgactttgggctccgtgttctgtaatgcagtgtgggtccaggtagccctggcagtcataagagggaagatgggttcgtaggatgctcaggccctctctgaagaagtaggatatgctgctcttccctgctagcttttgtagagaatgcagcattctgagacaggctcccagttctgcaatgggaacttagtaaattgcgtaactcctattaggatatctcttgtaagctccagcattatgaatactatttggggctttgcctcataccctccaccccaggcgctctgccgatactttgcaaacatttattgcagttcgtgttagtttgtgaaatcaggagccctcggtagttgcagggcactgcttactggacgaaggggtaaatagcattcctggagcctttgctgttagtgcctgtgggcgctgttattgggaaggctttgtttttcatagcagctggtgtggaaataatggcttggttcctctctcttgcagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgt

SEQ ID NO: 36120 - DNA, 127441 bp, Homo sapiens
gcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattacaagc

SEQ ID NO: 36121 - DNA, 4160 bp, Homo sapiens
gccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggtgagaaggtggtggagggttgggcgtggggagtaaagggaaaagacagcctataggtggggtgtgatgatctgtagagaagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttggctagtttgttaatatttttatagagatggggtctcagtatattgcccaggctggtcttgaactcttgcactcaagcaatcctcccacccctacctcccaaagtagcataagctactgcatctggccccattcttttacttgcgtactactaacttgcccatagcagaaagctctgaaatgttctggaattaggaacttcatatccctttattctctttattttttatttatttatttatttatttatttatttatttatttatttattgagataaggtttcactctgtcacccaggctggagtgcagtggcccaattacagctcactgtagcctctacctcctgggctaaagcaatcctcccatctcagcctcttgagtagctgagactacaggtgcacgccaccatgactggctttttttttttttagatggagtcttgctctgtcgccaggctggagtgcagtagtgcgatctctgctcactgcaacctccacctcccagattcaagcaattctcttgactcagcctcccaagtagctgggaccacaggtgcacgccaccatgctcagctaatttttgtacttttagtaatgacagggtttcaccatgttggccaggatggtctcgatctcttgacctcatgatccacccacatcagactcccaaagtgctaggattacaggcgtgagccgctgcacctggcatttctttttttttaaaaaaagagacaaggtcttgcttgcccaggctgatctagaactcctgggctcaagcagtcctctcacctcagcatcccaaagtgctggaattgttggcctttattccctatacttcctattttgagccactaagcagtaaccattcaactaagatatctttgaaaatgactgctaccttatatcccttctcaccttaggcctctcttctgtggaaactctgaagccgaccagttgggcaaaatctttgagtaagtgaccaacatgggagaaaaagattttctattctgagtcctctttctgctgaacccaggatggcaactggctctgcccatggggatgggaactggaggaccctcctgaccagagttctcctgtcccccacagcctgattgggctgcctccagaggatgactggcctcgagatgtatccctgccccgtggagcctttccccccagagggccccgcccagtgcagtcggtggtacctgagatggaggagtcgggagcacagctgctgctggtactggagatggctgtgggcacagggaaagaaatagagactggggaaagaaatagagcagtatgcagggccctggccactgtggttaatgaaacttggttggtagatgggctgtagtttttattacagctgcaaatagccacccacagagaaggatatagaagagaacccatcctggctgggcacggtggctcacgcctgtaatcccagcactttgggaggccaaggtgggcgtatcacctgaggtcaggagttcgagaccagcctggccaacatggtgaaacctcgtctctactaaaagtacaaaaataagccgggggtggtggcacacgcctgtaatctcagctacttgggaggctgagataggagaatcacttcaactcaggaggcggaggttgcagtgagctgagatcataccattgcactccagcctgggtgatagagcgagactccgtctcaaaaaaaaaaaaaaagaaaaaagaagaaagctcatcccaggtattgttgtgggtgggcagaagtctgttttcttcatggttttctgacctttgcctctcccctcaggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttt

SEQ ID NO: 36122 - DNA, 50694 bp, Homo sapiens
cccggacatggccgccaacatgtacagggtcggaggtaaggccgcaccgcctttatgcccggccccgacccgcccgcagcccccacccgccgccgctgccgcctcccccgcccctctgccccgcaggccccgcgccccccgcccgccctcgcggcccccggctccttcccgaaccgccccccgccgtgctcaccccaacccaaaatggccccgcgggtcggccccatcgggggcgggcggggctcggcggcccgggggtggggggcggcccacctgttggggccgagggggcggccgcgggggtggcgggggggcgcggggcctgcgggacatccgggggtccggggccgggagcccccagcgggagcacgtggccttgggaggcgccggctgccggtctgggagcaggagttttggggctgtggggtctcccccggcccgcggccctgtgctgggactccggtgcatcccctctggggatggggagccccggtgaggggccacgttcctccctagagccctcctgcagcctggccccggggcttcccccagcagggatccctcagggggtcttcagcagggagcgagcatcccgagcacgcctctaagtccccccaaacttttccctgcctctcgctcacctcagcccattcgggaggcgctttgcaagggttggggagaggccggagggcctcctgggcaggggcttcctccgtgggcccagcctcctgttgctcgggccccccgggcctgcagctttgagccttgccctccttcgtgtgcctgggactccgtggggtctttcacaggaaggtggggggtcgtgtgcattccatcattccatcagcgcctccctccccaggactctgagacccctccctgcctgtgaccctctcgggcaggtgctcattacctttcccacctgcagcctgcgctgctggagggagctggggtcactcccgctctggcttgatccccatgcccctgaccccgagtgcccagaacactctgtgtctctcgagcgtggcttctgctgccttggacgccgtgtggtctggccggccagtcctgtgaccttggggacggtgggagccccctacatcccgtctgtgagatgggcggtcagtccgcatcagcagctctgggcctcccctgtcctctcagaggggcggtgggcctgtaccccatccagcggcagcccctcccacagcctcatacagctttgccaggtccctgtgtggacccaggtgcgctgagcccaccccacgctcagggagcagcctgggtgcggggtccctcgagggaggggcctgttccttcctgttctttctccccacctggagaccccccttccagcctgacatgagggcccagtttctcaccctggcagagaggatgcctgctgcctgggctccagccgggcccactgcgcatggttttgggattggtcccaagaagagctctccctgcccccacccatgttgggggtggggagtggtggcagctttgggctctagggctggggacaccccgaccccaactcatgccttcctagtggctgcattgctcggccttcaggcctgcctgcctgtgatcttggcgccagcctggctgccccccctccaaccttcccatgcctcggtttccccatggtgtgggtgaggacctcgtctctcagccgtccttttgtgccctgtggcagctgtgctgtggctgatgaaagccaggaccctgccttgtcccatcccggaggtgcagctcccctgggccccacacaggcttgggaggagcccttcgtggggctgcgccgccctccccgaaccctctgtccccctgtgcccgcaggcccgtcccagggcctcactgacccacgcactccagtgctgtgagggtgggtggcctggactcctaggctgtggcggaggggccccaccatgcctggcagagatgctgctggtctcttttcctgtgatgaggagcatgggaggttgggtgctgtctgctggcagcacagccacgcgtgggatccagactgcttctgcgtgtgcagtccgtggtcactgtggccgggtgtgctcggagctgtcaggccccccacgtgcccgccccgaggacttcctctccctgcaggtgagactgtaggcctccccctctctactctgactgtccctataggagaagcggcatttatccctggcttctggaccggaaccctgggttccggcaggaccccggcagagccctgtggtcgcagtgggctgggcattgcaggttggcttcctgtcttggtgctcgctcggggaggtgggcgtctggattcttgagcccccagacaagaaagaggaaggtgtgcagtgtctcctgagcagcctttgtccgtctgtcgccggctgcctggcacgggctccatctgggtggccagtcctggcctgtgggagatgccggcagggacccagcctgggaaggggcttgctcctgtgcccccccaccccagggaccttgtgtgtagaggcaccaaatttagttaagaaaagtacaggacgcccaggcaaatttgagtttcagataaacagaaatttattagtgtaagtatgtcccaaatatggcatgggacatacttgtcccagaagattcttatctgacattcacagttatctgggcaacccgtattttagctggcaggctactccgaggccctgccaggttgggctaggcagggtgaaggtgtggtggcagtatttttgtgccagctgagctgggtgaagtggtgagcagggagggaacagggcctgtttcttccccatggagtgccctggccacggacagaggccttctgtctgtgcctgtgagggcagcggatggcctgggcaagggtggcggggtcagggttccctgacctctgcttctcaagggttgtccatcccgagggctggggaaggcttgaaacctgctgtgggatgagagggccccagggcaacggcgggatgtttcttctctgggttgaacatgaagatgttagatagcatccaaaacaggacagcaggaatcggtgcctgccagccgcctgcagcttgctcatgtggggcttctgcttttcagtggacaggccattaccattttgccttgggtgtttctgtttttcattgcaagaggttaacaccccatcttttggattttttttgtttaattttttttttttttttttttttgagatggagtcttgctctgtggcccaagctggagtgcagaggcgcgatttcggctcactgcaacctccgcctccccggcccaagcgatttcctgcctcagcctcccaagtagctgggactagccaggcgccaccaggcctggttaagttttacatttttagtagagacggcgtttctccatgttggtcaggctggtctggaactcctgacctcaagtgatccacccgcttcggcctccgaaagtgctgggattacaggcgtgagctcatgcccggcctttttgttttaattttaataaaagttgaggctgggtgacagagtgagactccgtatcaaaaaaaaaaaattttaatgtagtttgaaaggatgccagaaagcccctgcccctgcagggccgcgggctctgccccggtctctggcgcagcctgggcggaagcaccctgtccgtgctgctggtcttcactgggcttggcatgtgccatcatctgcgctctggcgcgctgttagaaatgttgcttttgtatttttattctagtgtttttttgaagtttaaactttattgctctatatacttgccagtggggaaaaaagtaaacttaaaaaaaatgtcagatttgtagagggctgcagccagcgccgccctaccctggagtgctgagtgcaccgtgtccctaggcacttgctgctccatgggccgacttttggggtcccacccatcttttccaagaaggcagggaagagccctggagacacggccgtcctgtgagcaccaggagcgggagtggtagaagtggcaggggcccaggtgtgatgtcctggaggggatggcatggggctgtcccacttggcctgtgaggatcggcctcagcactgcgccattggcagccctggctcactctccaggcaggatgggccactgagcttctcctgcctcagccactgagcactcctggcttgctccacctttgtttttttgagacggagtctcgctctgtcccccaggctggagtgcagtagcgcaatctgggctcactgcaagtccgcctcccgggttcacaccattctcctgcctcagcctcccaagtagctgggactacaggcgcccgccaccatgcctggctaatgttttgtaatttttttttttttgtagagacggggtttcactgtgttagccagtatggtctcgatctcctgaccttgtgacccacccgcctcagcctctcaaagtattgggattacaggcgtgagccactgcgtctggcttttttttttgtttttgagacagtctcactctgtcacccaggctggagtgcagtggcacaatcgcggctcactgcaacctccgcctcctgggttctagtgatttgcctgcctcagccccctgagtagctgggattacaggtgtgcaccaccacacctggctagtttttgtgtttttagtagagacagggtttcaccatctaggccaggctggtctcgaactcctgacctcaagtgatccacccgcctcggcctcccaaagtgctgggattacaggcgtgagccacggtgcctggccccatattgttctgagtggagaatttgatcgttaagctctcagaataataaaaaagtagctgtcagtgagagatgttggaatatatggtccaatgaagcacatccctcgcgcccgacccgccctggcagtgccgttcccgcccgtgtgtgtgggttctgggtgtcaaaactgctgcagtggccctgcaggcatcctacctagaggtgggtccccagctgcgcatctggacgctggtcagcaggtgaggctgggatgccagaggaggtgccgtgtgcctggccaggtacccgggaggcggcttgggggagcactggctgcagggcctccttcctcctcctgctgaacttggagtgctcttgccagattatgggctgagtcctgctagggagggtggccccccttccccaggaggagcccaccctgagacctggttggggggcagcttagaccctaccttagactccagcaggctgtcttgggagcatgtaattatgttttttttgagacagggtctcctgttgcccaggctggagtgcagtggcaccatcacagctactgcagcctccaccccacaggctcaggcgatcctcccatctcagcttcctgagtagctgagaccacaggtgcacaccaccatacccagctaattttaagattttttatagaggcggagtctcactatgttgcccaggctggtctcgaactcccgtcctcaagcgatcctcttgccttgggctcccaaagtgccgctgggtttgcaaggctgtgaactaccatgcccggcagagcatttaatattctccaaatgtctttcctcgtgtgctacctgggctcactgctttctggggctctcgtgttgctggtgtctccacccccacccccaccccagctggcctgctccattcctgtcccggtgggctcatgtctgagtgtgcggactgggggatcttggtggcgatggagccaagcccagggaggctggggccaccctcatagtgcaaggccacccagcacctcgcccctataccccacccgccccaccaatgtgcccccggcacccccgagcccaggccccaaggcttgcttctatgggctttgcaccaccctctaggctgctcccgcctgggccatgcagcgcacctgaggggtctgaggtgaccgctcctcagagccgcccggcagcctccctggggcgggcctcagcactgcagccccgtgatccggcctggcgtgggctttgctgctttctctgcccggtggcctgaggagctcgagtgcccgcctgcccccagagccctttcacggtcagggcctgagctctgtgggtgccattaggaggagggtctgcagatctgtgcggttgggggacccctggggcatggaggggaccacgcgtcccttcccgtccgtgccctgccaggctgtcctcacagcagcgtcgtcacaggggaggaaaccagggcagcggcagcggctcctggtaccaagcataccttaaaaatgagcccatggatgttgcagtgagccgagatcacgccactgcactccagcctgggtgacagagcgagacttcgtctcacaaaaaaaaaaaaaaaaaaaaagagcctcaaggcctgtgcagttggtcagcggtggagtcaggtatggggcacacctgattctgccctggctcatcccctgccttcagaggacagcaagggcgcagcgcacgtgggggctggccctgaggtgtggcgttctctgggctgggctagggcagttctgagggaggggcgtgttctgtcccattcctccaggagacacagtgcctgggccatctggccacttgcatgagggaacgtctgtctgcatcccctgggggccgctgtccccatcccttgactgccggatgcacctcggatgctggggctctggtctccgatccttcttggactttgtggggacagcaacggaggaggatgaccccaaggatgggccgggcgcgaggcttgcagcagtgcccaggttttgcagataaaaatacaggacacccctgcagcatttgggacgttgtcacatggagacccggctcctggagcaggggtgctgggggctttcctgaccactgttgctgtttctcttgactctgttcccaaaagggaaaagacaaagttcctctctgtgctccctggtctcctgtctctgaccatggcagacctggctgtgggtgagctcaggagagtgggctgtgccctggagggtcccggacaggcagggaccacgggcaccgccctgccgcacagctcttgttgctcaatgatcttgggggttgtgtctgttctcccccaattcttctgtggccccatcccctatttgttaaaacttacgtgtaaccccaaaattcacacttatgtcactttcccagtcatttgcgggcacgcacaggctgctaaaagcccaagttgcgtggtgcttgggtgcctgctggggtgagcgaggcaccctgccctctgccactgctcccatgttggaagcaaattgtcctttctccatctactgagggccatgcttcttgcatttgggggctcttggtgattttgctttttagatgcccctgggggaggtgccgcagtgctgttgagtgtccctggacacaggcaggctgggatgggtcccatggagagaacgtgtgttggacaggctctgccccacgtgagttcagtgtcggagaacaataataattataaagttctttgacagaaacgtaaaataaggctgttgcgtattgattggttgctgaaaatgttgtgaccagaggctcgtaggaacctgaccctgtatttcctgtaggaacagaggtacggtgttcagtattagtggtgactttatggaacgtaattactgcaaacaatgagaattgactctgggtgcgtgtatatttttttaacttaaagtaaggtttaggccgggcatggtggctcacacctgtaatcccaacactttgggaggctgaggtgggcagatcacttgagctcaggagtttgagaccaacctgaccacacagcaaaaccccatctctactaaaaatacaaaaaaagccaggcgtggtggtgcgtgcctgtaatcctagctacttgggaggccgaggcatgagaatcacttgcgtgcaggacgcagaggttgcagtgagtggagatcgcaccactgtaccccagcctgggcaacagagtgagactctctcaaaaaaaaaaaaaaaaaaagttaggtttattgagatacacgtttcacatggcaaacccacttatgtgtaggggcctgtggttttccactcatgcacagctgtgtggtcgctgcagctcttccacacctgacatgcttctcttgtgaccttctgtagtcagccccctcttctcccccagctcccagcaacactgacctattttctgttcctgccgttttgccttgtccagaatgtggtagaagtggaattgcacagcatgtgggcttttgagtctggcgtctttctttttttttgagataaggtctcagtctgtcacccaggttggagtgcagtggtacagccatgactcactgcagcctccacctcccaggctcaagtgatccttccacctcagcctcctgaacagccgggaccacaggtgtgcaccaccacacccagctaagtttttcgttatgttgtctaggctggtctcgaactcctgggctcaagcgatcctcccacttcggactcccatagtgctgaggtaacaggagtgagccaccatgcccagccttatagtaattcttgaaatcaagtagtaggaatccttgaactttgttcctcattttcaaaattgtttagcctgttctggttacttggctttcccttacagagtttagaattggcttgttaatttctacagaaaccaaaaagaagtgtttcttttttttttttctttttttgagacaacatcttgctctgttgcccaggctggagtgcagtggtatgatcttggctcactgtatgtagcctcagtctcttgggctcaagtgatcctccccacttcagcctcccgagtagctaggactacaggcatacgccaccatgcctggctagttttatttatttttgtagagatggggtctcactatgttgcccacactagtctcaaacccctggcctcaagtgatcctcctgccttgactcccaaaatgctgggattacaggcatgagccattgtgcccagcctcaccttgcacttttatgtggtagaaatggcttctttccttgaacttcatgggccaacttctgctagcttcagatttttcttctgcagcctcctcacctccctcagccttcgtagaactgaagggagttagggcctcgctcaggctggggctctggcttcggggaatgtgtccgctttgatttcccatcccggcacttcagctttctctctatcagtactaaggccgttcagctgtcttatcaggcttgtgttcactggagcagcactttttgttttttggagatgaagtcttgctctgtcgcccaggctggagtgcggtggcacgatctcggctcgctgcaacctccgcctcccgggttcaagcgattctcctgcctcagcctcccaagtggctgggactacaggcacccaccaccacacccggctaatttttttttttttttttgagacagagtctccctctgtcacccaggctggagtgcagtggcacgatctcggctcactgcaagctccgcctcccaggttcacgccattctcttgcctcagcctcccgagtagctgggactacaggtgcccgccactatgcccggctaattttttgtatttttttagtagagacggggtttcaccatgttagccaggatggcctcaatctcctgaccttgtgatccacctgcctcagcctcccgaagtgctgggattacagacgtgagccactgcgcccggcctttttttttttttttttttttggtgaccaagtctcgctctgtcattcaggctggagtgcagtggtgcgatcttggctcactgccacctccagctctcgggttcaagtgattctcccacctcagcctcccgagtagctgggattacaggcacacaccaccatgcctggctaatttttttatttttagtagagatggggtttcaccatgttggccaggctggtctcaaactcctgacctcaagtgatccacctgctttggcctcccaaagtgctgggaatacaggtgtgagccactgcgcccgacccacttttagtttctttcaggaacttttcctctgcattcacaactgggctacctgcttggcgctgaagaccaggctttccgttagggtatcttggctttcgacaggccttcctaactaagcttagtcatttatttccagcttttgttttaaagtgagagatgtgtgaccctcaactcttcccttcactggactacttagaggccatggcagggttgctagttggcccaatttcagtattgttgtgtctcagggaatagagaggccccaggagagggagagaaatggaggaatggccagttcctggggcagtcggaacacacacatttatcaattaagttcttagttggggtatggctcatgatgcccaaaacaattacaatagtagcatcgaggagcaatgaccacagatcgccatcacagatagaatcatggttaaaaagttggaaatgttgagagaattaccaaaacgtgacagcaacacgtagtgagcacctgctgttggaaaaatggcaccgatggacttgacttgatgcacgttgccacaaaccttcaatttgtaagaaacacaatacctgcaaagcatcatcaagctaagcatgatgcccgtgtagatgtttgggaaataattggcatctaaaccaatcttgggtcctctcgtacagggattggcaaactggcccgctgcctgtttttgatgactcacgagctaagaatgggttttacattttttaattgttgagaaaaaaatcaaaggcagaaaacttcatgacacatgaagattatatgaaattcacatttcagtgctcagaaataaagtgttatgggaacacggccgcactaatgggagggattccagttattatgtggctgctttgagctaccgtggtggggttgaatatttgtgatagggacaggaaaaacttaactttttcccagtctcacacgttcaacacagaacacttcacctctggtccctggaatgtgtgtggggtttctccctaccagcagccagtcggttatccagtgatttaacccaattttgacactgcttacctggagagaatattaggttctgcagctgaagggctgagtcccacaagactgtcctcacttctcctgcctcagcctcccgagtagctgggattacaggcgcccaccaccacgcacagttaatttttgtatttttagtagagaccaggtttcaccatattggccaggctggtctcaaactcctgacctcaggtgatccacccaccttggcctcccaaactgctgggatttacaggcatgagccactgtgcccagcctacaagctggttattaacaagaccaataaactgaaatctatagccagactgacaaagaaatagaagccacaagtaaccaacatcaggaacaacagatgggacatcactacagatcctactgacacgagaaatgtgtggcacagaaaagggcttggttggacaaatttacaagggttgttaaacatacaaagtgccaaaagcctatagttattcattctattacttgttggcaggtaaatattttgtggaaagtatttgtttatttttatttttactttttgaggtggagtctcgccctgttgcccaggcagcagtgcagtggcgcagtctcggctcactacaacctctgcctcccgggcccgagtgattctcctgcttcagcctcccaagtagctgggactaaaggcatgcaccaccacacctggctattttttgtatctttagtagagatggggtttcaccatgttgggcaggctggtctcaaactcctgacctcaggtgatccgcccacctcagcctcccaaagtgctgggattacaggcgtgaggcactacacccggcctgtggaaagtatttgagtctgtcatgccttattgaaccagtagtgtcaacagtgaacttcatttgaccttgtggacttgatgtcatcagttctgtgaattaaaaaaaaaccttttttaaagagatagagtcttgctttattgcccaggctagagagcagtggcacagtcctggcccactgcagcctcaatttcctgggctcaggtgtgagcccctgtgcctggcctaaagctgaacatcttgacttgctgtcctgtgcagcagcttgatgagttggcagtggtgaagttctattgcttttttatttttattttttatttatttatttatttttgagacggagtcttgctctgtcacccaggctggagtgcagtggcgtgatctcggctcaccgcaacctctgcctcctgggttcaagcaattatcctgcctcagcctcccaagtagctgggattacaggcacatgccaccatgcccggctaatttttgtatttttagtggagatgaggtttcaccatgttggccaggctggtctcaaactcctgacctcatgatccacctgcctcggcctcccaaagtgctgggattacaggcgtgagccaccgtgtctggcctgctttttgaaaaagcgccgaaattggaaaatttcagaatgagaagaaccactgttgactgccatcatcaatacaccagatgacttgggaaactagtttttgctgcatgatgttctctacgttctttatgaattcatcttaaagttacgaggcacaaccacatttatttgcaaaatttatactgtgatgaagtcactttggcaacagctcatgtttaaatcacaaactgctttgtacagttttcttattgtcaagaggtaaaatgagaggcaaagtctgcattgccacacagatttgcagtgagctgcttttctgggctcacactgtggttacagcagagtgtctgcgacttccatgcgagtgcaagggaaacgtcgacatttcaaaatccactcagctgtgtgttagggagctcccgcctgagcttcagtcgaaagcgattggactgtagcgtaaccccgtgctgtaatataggggccccaagaccaccctcgggttcagtaattcactaggactcatggaatacagcagagcatttctgccaggggtacggttgattacagcaaaaggacgcagactcaaatcagcaaagggaagcggcacaggggccgggctcaggagagaccaggggtgggcttccggcgtctctcccagcagagacgtgggcggtgtgtaggtctagcagtggtctgtgatgacaggcctggcgtatttccaagcagggacgctcccgtgagccttggtggtccaggtgtttttagaggttggtcaggtgggcctggctgagcaccggtgtggctgccctcggtccctccgtctcagcccctccagaggtcaggctgatgccacaaggcaccgcggtacgtcactgtcagggtagcctctctgaggtggcctgaggccctgggtgagcagacgctgttggcaggcaggatgctccaagagctccgaggtgacctcctaggagcaggtcaagggtcagacctctctggaaggaagaatgcgggcaatccaagcctgctgagctggccctttccaggaaagggagtagcgaggctgctcacttagagccacgcacctggggctgacagtgtgcctggcagtacctgtgtggaaagacagttacagaggaaacacatgaactcactataagccagcactaatggatgcacctttgttgttgattttggtgataaagaacattaaatttgaacccagtgaagcaatatgtcatctcccaaaacaagtcctctcatgagtgcatctgtattatagaaagctgcactcagctttttaaaaaaatttttttagatggggtcttgctctgtcaccaggctggagtgcagtggcacaatctcggctcactgcaagctccgcctcccaggttcaagcgattcccctgcctcagcctcccacgtagctgggactacaggtgcgtgccaccacacctggctaattttttgtatttcagtagagacaggctttcaccatgttggccaggatggtctcgatctcctgaagtgatctgcccgcctcctgaagtgctggcattacaggtgtgagccactgcgcctggcccagttattttgatttcatcagtatgaaatgtgtagaaattgttacattagtccctatgtaatatccttggtgtggcctcttggcctgcacagcctggagtattgactatctggacctttataggaagctcaccaacatgtattttaacccttgacaccttatctgttaccatttatttagatctttgctgatttttctcaccagtgttttgtacttttcagcatgtagatctttgcacagatcttttgatctttaaacatctatagatcttttgtaaaatttatattgtaagtatttaatttttcttggtgctcttgtgaatagtacttttacaattttgatttccatttgttagtagtacgtagaaagaggactttttttttttttttttttttgagacagagtttcactcttgttacccaggctggagtgcagtgaatggcgtgatctcagctcaccgcaacctccgcctcccgggttcaagcgattgtcctgcctcagcctcctgagtagctgggattacgggcatacaccaccacacccagctattttttttgtatttttagtggagatggggtagctccatattggtcaggctggtcttgaactcccaacctcaggtgatccgcccgcctcagcctcccaaagtgctgggattacaggcgtgagccaccatgcccagcccaaaagaggacttatttttatatattgacctgtgaccttgcaaaactcttactcagcagtttcaatagctttttttgtagactctggggatttctatatagaaagtcacatcatctgcgtatagaaagttttatttcttcatatccagtctgtgtgcctttcattgatttttcttcccattgtactggctgggacttcctcgatggtcagcagtagtggtgagagtagctatacccttggcacatccctgatctcagcagaagcagcccttttctcaccactgaggatgatgctagctgtaggttttttgtaaatgtattaccaggctgaggaagtaccctttagttccttgtttgctcagagtttaatagcgtatgtgttggattttttcagattatattcttgcatctacggagatggtcatagggcttttcttacttattctgtgaatatgatgagctacactggtttttgaatgtttttaaaaatttaagttatatttagagatggcatctcactctgtcacccaggcttgagtgcagtggtaccatcatggctcactgcagccccaaactcctgggcttaagcgatccttctgccttagcccccaagcagctgggactacaggcacatgctaccacacctgcataattaaaaataatttttttttagagatggggtcctgtgatgttgcctaagctggtctcaaactcctggactgaagcaatcctcctgatttcttgtgtgtctttggttttggtatcagggcaatggcgttctcactgtcagctggggagtgttccctccttttctgttttctggaagagttgtgtagaattggtgttaatttttccttaaatgtttgatagacttcaccaatgaagccatctgggcgcagagttcttgttgttgtatttccgtagtatggatagggttacctgtttcttcttgaatgagctttggtgtttatatctttcaagcaattggttcatttcatttaagttgtcaagttctgtggcataaagtcctccataatactccttacaccccttctcgtgtcagtaggatccgtagtgatgtcccatctgtcgttcctgatgttggttacttgtggcttctctctttgtttctttgtcagtctggctatagatttcagtttattgatcttgttaataaccagcttgtaggctgggcatggtggctcatgcctgtaatctcagcactttgggagactgaggcaggtggatcacctgaggtcaggagtttgagaccagcctggccaacatggtgaaaccccgtctctactaaaaatacaaaaattaactgggcgtggtggtaggctcctgtaatcccagctactcgggaggttgaggcagaagaatcacttgaacccgggaggcggaggttgcagtgagctgagatcgctccattgcactccatccagcctgggcaacaagagcgaaacttcatctcaaacaagcaaacactcagcttttggttcctctgatattttcccctctactatttttgtttcatgttatttttactctatcatttcctgccttcttgctttatttgtccgtttattaaggcataatttacattcagtacaattccttttacgtgtacagttccgtgaattttggaagtccatagtcatgttgttgtaccacagtcatgatacagaatagttcccaaattcccaaattctcacgtcttccacatcttggttttcctgcgccagcagcttgtaggtggccccactgcacgcagccgtcgtgcctgccacctcccccgagagggccttccggtgctgcagaccccgagctgccagggggcttcactcctggcccctgccgaggagtcttccatcaagtggatggaccccagcttgtttgtctttcctcacttaagggacatttttcccccattttttggcaagtttgatgcattgttttgaatttaatttatttggtttcttggagtaaaaagttagaccgttgatttgagaccttttttaaaaaaaagtttgagatatctacatgtgatgaaacccaccaattttgagtgtgtgattcagtgaattctagcgttttcacagcgttgcacaagcgtggacacatcctgcattcagaacactcctgtagccgtgacacagacccacaggccccctgtcacttctgcaggcttttctgcagggaacgctcactgctgtgcgtgtcccccgggcaccgtggctgtgtcccctctgggctctccatgctcctagcccgttgtcctgtggagctctatgtgggcgtagcctcatctgatcagctggtttgctcaggcagcacggggggctcaggagctgcatgcacaggtgtgactttgcacatgggtgcccaaacaggtgcgtcctcccaggtgtgcacccacagatgtgtcctcacgggcgtgtgcctgcaggtgtgtcctcacgggtgtgtcctcatgggcatgtgcctgcaggtgcgtcctcatgggcgtgtgcctgcaggtgcgtcctcatgggagtgtcctcatgggtgtgtggctgcaggtgcgtcctcaggggtgtgtcctcatgggagtgtcctcatgggcgtgtgactgcaggtgcatcctcaggggtgtgtcctcacgggcatgagcctgcaggtgcgtcctcatgggtgtgtcctcacgggcacgagcctgcaggtgcgtcctcactggcgtgtcctcaggggcatgagcctgcaggtgtgtgccagcagcaggagggagatgctctccaggcccctccacagggtcctcgcggcacgggtttggcctccgtgtggacagatgggctgggcttctttggtgctggtcttgctgtattttgctgaatcccaggcctgtgcgggcctctgggctgattccagctgagacaggcctcctgctcagtcccccctgcggagctgatgcagggtgggctggcgagggtgctcgtggtgctggttcgtgaggacatggcctcagtgcctcccaagctgagcccctgcggtggccccaggaggcctggagcatcggggtgtcagcaccaccagcctggacttccctgggccttccagggtaagcctctgggctccggaaggttccgtggctctctgtctgtggagctggtgagaaggctggagggccagatggtttcatcgctgagggaagcgctgtactcacctgatggccgatcttggggcactcccagtgcctgctgcctgttgctgtccctgagctctggtgagctctggtattcctgtcattcctggagcaactctgtcctgtttttgagcctgcctgggcccaggaagccccaactgtgttctctgtgtagtcactgctgttggttttggagggaaagatgggggccgctgtgggcagggctggtggctggtggtggccacgtggctctgggggtgtagcatccaggctggctgctgccagtgggaaggtgtcctggggctcccggcagggtctgggcagtgctggagctgggctttgcctgggaagctgccgcctggcccccacagcttccccaagaagggcctgagcccttgggggcagctggcgtctgtgaggatccgggatgggggctgtctgctcctgctgggaacggcccctccagatgcatctccctgtccctgacccagcctgtcagtccattttggttgcagccacccctccctgatggtgtgggggcttcgcttcctctgtttattcctcgcctgagggagcagaggtgaggggatgacactgccccgcctgagccccgagtccctgggccacgggaggtgggactgggtctggcctttggtgccacaggtggcactctctctgttgctgtttgcagactacgtctactttgagaactcctccagcaacccatacctgatccggagaatcgaggagctcaacaaggtactggggggccctggtgttgctgcaggggggtagtgggtgggggctacgccagctcctgccctgtgggtggccagtgtgggtggccccctttcggggctgatcttggactggccactgcacaggcccttcagtgactccgtccactgtcacctgcaccgtggctcctccttggagatactgagtgaggggcctggtggcctcatgcaggacccagcgcagctgccctgagctgcctgcccactctacacttggtctgtgggtgctgggtcccctgaagatgccagtgtcccctggggagcccgagcggaatggtgtgattctgaaaccaaccaaaggctgcagaaagccatactcggtgcccctgccctgcccgaaccctggcagccagccctgcagggctgtgagctctgcccccacccctgaggtgtctgcatggctggaagcaccctccctggtcactcaggcagccctgcagggctgtgagctctgcccccaaccctgaggtgtctgcgtggctggaagcgccctccctggtcactcaggcagcccttgctcccacctggtttgtgtctgccatgagtccttggcagttgcttgctgtttggtcgggggacgtggttgtgcccatgcattgagcctggcagcaccagatccttcctggggggtggtgacacatgggcccctcagccccagccactcctggcctccactgcctcggcacagcctccgtcccatcagctcgggagacagagccgtagatggccatggaggtgtagggcgcccgcacaccctgggagccttctcgctgtcctcaggggtggtgggtgggtcccccagcgtcccttctcctcctcctggttggagactttctaagggtgttgagggagggcaggttgtccccaccagtggacacatggttccagcagagagtggggtggggtgctgggtgcttcacagacctctctgtgcctgcctgcagggctcctgagcccccgatcccctggagccagtggcccgatggctgccttctcctaggagccctgcccactcggcaggcctggggcactcgggcccttggtgttccatctggatgctgcaggctcacctgggagaagctgccttcctggacctcaggcttggtggcagcggtgacgtggggttcttgggatcagagggggcagcggggggaaggttagcgcgccacctctgacgtagccatgctgggctccgggcttccctggctgcgcttgtcgagggccattccctgcggtatctgccaccacctggggccgaggagcatggggtgcgacatctgctcccccgcagcttcctgggaggtctgagggccaggcctgtttgttggaggcacaggcaatgacctgggtgtcttctgagtctgcctcactgcccctgctgggcagggcctgcccgcctgcagagcaaggccacttgggtactgccggaatggggcgccactcctgtggctgagcctcctgagtgcggggcagcactttacgcatcccagcatgtggactgtagggaaacaggtgcagagggaggttcctcagctgacgctgaaccatggctgggggaggtcctgtgtccctcctggtctgtgtagtggaggggcggccggcagatggcactgctggccccacacagccagctggcaggcaacccggggcgggaggctgcagtgcctccgtgggcgcctggccgagtgccactgctgggaggtgccactgtcaggaaggttccctcgtgctgcttccggcttccatgtgcagacagtagattgcaggcgtgtgcaggcagggggctggcttccagcccttgggcgatgttcagttacacatgtagcattgcacacgctcagaggcgtccccttcgtcctaggactccctcctcctcagggccagggccacatggcgtgggcacttgcctgtctctgggcgggacaccagcctgtgaggggcacgactactctcttggactgttcaggcagggcagccgagccagacgctcaccatgtggaaaagaacccgcaggcctgcgacagagtgcggccagtgccctccacgccaaggagctccaggcggggcttccaggtgggcgcagctggttgagtacagacctcccctctgttccctggactgaacgccccctcaaataacaagaaagtggtgctggggctctgcacccacagggcaaggaaggtgggagaggcggtgccactgggaggtatgggcacagcttggaaggcagccaggcagactgggcaacctgagaggccctggccctggcctgggtcaggatggggagaacaggaaccatggtgacatgtggctggcagcgcggaaggcctgtctggggggtcaggtggtcccacagagcccttccctgggctggagcagtggactcagaggacccagatttggggcaccagacccaggccagcacagttcgtgcgggggctggaagtggggatcgcctggctcatggcctgtcccctggtgggcccccccgcccctcttgcctccttggctcccaggaccctagcggccagacttctaaagcccacagacccagctgctggcatcggggacccagcagaatgcccgctaccccagcacccatgggtgcagcccatgcagcgagctgcccagcaccggggaggctcccagggatgaaaagccgcaaggcgtatggggcggggcgggggggcttttaacaggaaggtcagccagcacatgtaaaaattgaactcagaggctggacgcaggggctcacgcctggaatcccagcactttgagaggccgaggcgggcggatcacaagatcaggagatcgagaccatcctggctaatacggtgaaactccgtctctactaaaaatacaaaaaattagccgggcgtggtggcgggcgcctgtgatcccagctactcgggaggctgaggcaggagaatggcgtgaacccgggaggtggagcttgcagtgagccgagatcccgccactacactccagcctgggcgacagagcgagactctgtctcaaaaaaataaaaaagtaaaaaaggaactcagaggaagggccagtgcagggaacagaaggaaactaaagcaaaacaaagcccgtgaatgttctctgagaaatggatgggatccatcctgggatgtggtcagatgagaggaaagctcttgacacttgggttaggagaagtagcaaatgaaatgaaaggatcaggtgataaagttgaggataccgcacagaagatggggcaaaaacacaaagaaactaggagagaaaaaaatcagacatcagtccattggtccaacgtccagttaatagcagagaaggagcgagcaaagcaataaagaggggccccttcaaggtgtatttaaaattttagaacacgggagaagaaatgtgtttagagaaaaagtgggtcacacacgaagcaccggagtcaaaacccactttgcctttcggcagccgcgttcaggtgtggaggctccacgcccagccaagctccatctcccggaaggcagatgagtgaggtttcctgactgaggccttggagtgcactcctccgcgcctttccaacacgagggaggcgcaggttcctcccgcccaggaagatgcggcccctggtgcaggcagcaagcagggtggaccccagctctgggaggggcctcgcaggcgccctgatatgagccctttctctttgggagctctgctgccgagcactttagggaagaatctgtgatgattccatgaaaaactaggcaagtggagaaaaaagacgattgttaatctcaggaagcaaaggtgttcgaaggaagagaagaaagaatggcctagtgtggcctcaccgcctttacctgtgtgtgcaggagcgtctcagaacagaccccgagtgtgactgagtccgctgtgtgcaggaacacaacacaacagaacagaccccgagtgtgactgagtccgctgtgtgcaggaacacagcagaacacaacagaccccgagtgtgactgagtccgctgtgtgcaggaacacaacacaacagaacagaccccgagtgtgactgagtccactgtgtgcaggaacacagcagaacagaccttgagcgtcatggaatgcacacagtgatcctggagggtggggtgcatgtgtggcaatgggaggcctggcctgaggcgctgagctggtgggaacctgaatgcggaagagcctggccccacggtcccagctgcccgggtggggtggctgcggtcatgtgttcttgcagggttcatggctcgctgagacattggatggtctgtgtgtgtcactgtgatcagatgtggatgtaaccccactgcggtggagcctgtcagggacacaggagccaacaaagcgagaacccggcggccagggtagggacagctcgacctgcaggagggtcaggccacattggatcatgacttgaagcagagcatggtggtccctgggttcacaccaccatagtgagcagatacagatgcgaaggggagaggagatgcacgtcccaaacagaggaattccaccctcgagaacgcccggctcccggcaggctgtgcagagcaactgagcacttttctctttattctttcttttttgttgttgcttttttgaaacaaggtcttgctcttttgctcagaccagagtgcagtggcacgatctcaactcattgcagccttgacctcccaggcccaagtgatcctctcacctcagcctcccaagtagctgggactacaggcgcacaccactgcatctggttaatttttaaaacacattttatagagatgaggtttcaccatgttgcccaggctggtcttgaactcctgggagtgagccactgcccccaacccatttataacattaaaccaaattatctttaagaaaagtggccaggtgccttggcttactcctgtaatcctagcactctgggaggccaaggcgggcagattgctggagtccaggagttcaagattagcctgagcaatgtggtgaaaccccgtctctacaaaaaatttaaaaattagccaggttggctgggtgcggtggctcatgcctgtaatcccagcactttgggaggctgaggcgggtgggtcacgaggtcaggagatagagaccatcctggccaacatggtaaaaccccgtctctactaaaaatacaaaaatgagccggtgtggtggtgggtgcctatagttccagctactcaggaggctgaggcaggagaatcgcttgaacccgggaggtggaggttgcagtgagctgagatcgcaccactgccctccagcctgggcgacagagtgagactccatctaaaaaggccgggtgcggtggctcacgcctgtaaccccagcactttgagagaccaagacgggcggatcacgaggtcaggagatcgaggccatcctggctaacacggtgaaacccagtctctactaaaaaatacaaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtaattggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggggctgaggcaggcagattgcttgaggtcaggggttccagaccagcctggccaacatggcaaaaccctgtctctactgaaaatacaaaaattagctggtcgtggtggctcacgcttgtaatctcagctacctgggaggctgaggcaggagaatcacttgaacccaggaggcagaggttgcagtgagccaagatcacaacactgcactccagcctgggcgacagagtgagaccccatcttaaaaaaaaaaaaaaaaagagttataaatagtattccattaggcacttgcactgtgattagaattacagcacaattcttgcagtagcaaagatgttataaaaactcgttcagaaaacatacgtgcttctctggtggcgttttacagccgtcttgacttggagacgtttgtcagccaggccaggtgggagggctggtcccatgcggggggtccaggctgcgtccgccgctagggccgtggctgctgtgcaggtcaccccagaggggctgggatagctgggcgtggcctcccaggagctgactgaggtcctacccagtgtggcgggggccttttcctccttgggaccctgctgttctcaggtggtacactggggtctggaagggagggagaatggagacacaggttgaggttgggtgcacacgcccgccttctcccctgggatagacgccacgggcgtccagagctgcaggatttgctccatttgtgaagtgccctcctggagtcccgaggggtggtgtggttacacctgcagtccctggacggcagggtccggccttggagcccctcctgggagctgtgcagcccgggtttggtcgcgtttctcagacgcccctgccttgctgttacagacggccaatgggaacgtggaggccaaagtggtgtgcttctaccggaggcgggacatctccagcaccctcatcgccctggccgacaagcacgcaagtgagtccggccttccctggggtgcccgcctggcgggagggtcggctggggagggctggcggggtccttcttccctagggcccatcggcatcctggcctcgtggggccaccctctgcccaactcactctggcgtctctttttctcccttccacagtgggcgggggtgtcctggctccgtttcctcgggggctgggtgaatgaagtcctcgcacgccccccggagtggtctgtctctcactggcatcctctgcaagcttgtcatggtgtggctgggtgtgggcatcattgatcgaggcttctttttcccttctatgatgacttctggagactttccaggctggtgggaccctgctgcctgcacttgccaatgtctctctctttttaattttgcggagaggcttctgttgggattctgagtagtgttttcaggaaagcagtcctctccttattctttacgattcaaacccaagtttagtaacctggctgggaggggctgctgtggccagcacagcgtgtgggaggaagccactggctgcatgggaatgccctcagccttggggacccagcttctcccccgggaacaggtgctcgcaggtggtggagtctcctgtgccgggggatgttgacttcagagccaggagccagaggcacccccacgccctccacatgctactgacacagggcctgccgagctgggccccacctgcaccagacacagtgtggtaccccactgaggcccttcatgtgtcggtgggggcaggcatgaggggcatttttggcttccactctgacacatcacctggggtgggatctgagcccaggctgaggctgtggtctgtagggtgacatttcccagtaggtgaggcatgtgactgcccgggtacccgtgtcgctggggtgggccaaggtcccacctgtaacctcccacgacccctaatggggtgaggtccagggactgtgggtttgcggtgggtcgggtgggaggaccctcgcatcttctgccccgtcccagcgctgtgggtgaggggcaggaagtcagcccaggcaacctccccctgctctgggaggggcttagggacaggacagaccatcctgccaccgatgccttgttcctgagcctttgctgggagtcggccagggcaggcgcttgtggaaggaaggtgtcccttaaccccactgccttgcccaccggacagctgggacctttcctcagcaaccagtggatgcggacgtgagctgccctgggtcagtgcagctgggccgggcccccgagcctgggtccactctggacactgggctgtggggcctgtggctggcccaaagggagctgccagttgaccatgggctttctctggctttgtgaggaactggacctcctagctctctgctcagaggaggggagcgttcaaggtggggcatggtgatccttgacctctgaccccaaagcctgtgtactccactgctgcactcggcgggctccaggcaccaaggaggagagctggggatgttgaaggtccacaggctacacattctggaggggtgtttggtgtggcccttggccctgcaggtgctgggtgccagtcagcagcacggctggcggttcttagtgttggaggctggcctatgtcgactctgcagggctggcccgctggagaagcagtggtggggagcggcctggctcgctggagaagcagtggtggggagcgggctggcccgctggagaagcagtgcccaggctgagcggccgcagtgtggccctgccagtctgtgtggcctggggagtcaggcgccaccgttgagttgggcatgtttatggctggcccagggtggatcctgtctctgtcctctggcacctgggggcacagtgtccctgctccagagagcctgtatcagtggtttagtggtttttgagggtactgtggcccccttggctgaggttctgctctcagacgccccagaggatggccttttgctggaagagccccagaaggggactccagacataacgtgattagaggtatcagagggcaggttttccagaagggcctcgttggggctgataggactgggtggagagcagtgtcccagctcgagcactggcccccccaggtacacagcacagcccctttggacggtgctccctggaaagctgcgtggcggcccctctgcagggcgttcctatgaactgagagcccagctgcagggagcaggcgtcatgggtgatgggtctgccgctggtccagggactcagagcgcggccccactcttgcctggcggctgggccttgcggtgattctgcagggcccacaccccccggggttgtgtcaatctccgtttctcctgcttctctgtgagctcatggcagccagggtgaggcccccagctgatcccagggacaggtgtgaggacactctgggaggcctctggctctcccacgtcactgcctccacccagcccctgctggggcgtccagcccacagtgcaggcctcagggtggagggtagacacccgccaggctgcactgtggcccctgtggcagagaagccctccccccggcagggctgtgagcatgaagcctttctcaggacagaatgacagggagaggggaacgtccctcctcagaggagggcgtgggggccctggagaccacagccaagagtgggagtgagggcacagcctgggcctcacgcttaggggtgtatccagggtctgagggagggttcagagtgtgaggggtgcagggtacactagccagccccacctcctgcctgggtgtttctgcctgttgagggtcttctgaggagctgtaggcccacctcgcccgcatctccgacaggctgcaccacagagccctgttctgctgaccgggacgctggtgaaatgggagtttcggagccgctgtgggctcctgtccaggctgggtcagtgctcggatggggcctggcatagggcgggcgtgaacaaaagccagcctctggtctggggctggtgtgtgggcctctgggccctggtgatgtctgagttcagggtgcagtttgctcgtgggtccccagaagtgggagcgagtgagatgtgttggcctgggatgagaggactggggctgtcctggtcggccctgccctgttctatggaccgggaggaggtgaggctcagccgccagacaccccaggcttttgaggcccagatagggccggcccagaacaggcccagcatggctgctcccagcctcagtcttagctgttggcgcctgggagggcccagaggagccaggacttcctgcaggcaccacaagggggccgcagagagcgagcagcccggctggctgtggtcccatctggggaccttgggctcagagagccggcagggcgctgagcgggatgagtggcccactggcggccggtgctgagcgtgcgaggggcggtggggagcaccactgcacgcccccattttgggtgttataagaaccctacttgggttcctagcacagggcaggaatccccatgctgctggccggtgcccggccccggtctcatctggacagcctgttctgggaagccccagtggagtgggggcaggggtggcctctggacaggggccctccacagccaggcttgtctgggctcttcccaaagaggcttggcactgggtggatgggcagccagagtggggggacgtcgaggcccagatgatcttcaaccgggtggtcttcacgccccaccgggaggcctgcggcccccgttctgccctgccccctggcggcacagccctcggtccgggccctgggcagggagcaggccgccaccctgtgctgaccgtgctgccgggtgctgtctgtctgttatatagccctgtcagtctgctataaggccggaccgggggcggacaacggcgaggaaggtaagagccggcctccgcaaggagggcgtcctcctgtctgtgtccctgggctgggggcggcagcgccgctgagggacagagtttgggcgggccgcctgcatgcctgtgccctgcgcccggccggcccggctgaggaggggccctcccttgtgtccggcccacggcccaggcttggtgcggccccggcctgagggtgacctgctggtgtgggaggtctgtggtgggctgtatggggctgtctggccacgagatggggacggacagagggcggctgcccctcgccctcctggcctgggctcttggcagccgccgactcccccgctcctcttgctcttgcctgctgcttctggggctggcccggaccttgttctccctcctccttccatcttcatgccctggggagtctgggcctttagggtgcctggacttaaagggcacgtgggcaccagagtgtctgcaggggtacctgccaaggagccgccgggccgccatagggtggggcagtgggacagtgtccggcagcaggaggaggcacgcctcccaggactgggcctcctgcgtgctggcgccaggtggggctggtggggtgggccttggtctggcagtgtgcgtctgccgcggtgctgacaggggctccttgtccttcaggggaaatagaagaggaaatggagaacccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcggggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggccacctgagtcttcgcaggagtcttggctggtctctcctgggcggtgggcagagtcctggtaggcccaccttgggggtcactgtgattatacggtgttaccaggtgattcttatctgggggtcacctgtgattatacggtgttaacctgccgtatagcatcccccaaggcgtgacaaccaaaaaatgtgtcccgacaatgccatacatccctggggagcagtgtcgcctgacggagagcggtggcactgaggctgctgtgagatccagcgaacgggagggttgggttttctgaggccacgtgggggcaaaagcgtctggagtgtgttggttccctggagtgcctgtcacagttgcggggcacacctgccaaggggcaggcgcatctccaggcctagggcttggcctcccacgggctctgctgccacctggctggagtcttgtgacctgaacacccccagcgtgtccagtcagctcagatgcaggttgctggatgcggcccccaccctgcccatcccaggggggctcatctctgtcgtggccatcggcgctctggcatgggctctgaaggatccaggatggccacggtgtgtcccaagctcagccctgcactacctctgtggccccggtccccattcccaccacacagcctggaaacaggcgtgaagggcgacagtggctcagctagggctgtggtcgtgccttagctcagagtcatgagcaggcagagaagagcaggcagggcttggcctggggtcgtaacacatgcgtggagcatgggcagggctcgaaccctctcaggctgccagaccagcttcccagaaggctgagccacaacatgctgggcgggagcagaggctgtgggggtcgctgtgaaggcttccactcaggaatgaggagtgcccttattgacagagccacacagagagggtgagactgcagaaatgtatctgtgggcacagaaaatgtttgttagcaaaaaaggcccgtgaggaagcagcaggtgcagtgacaagcctgtctgcactgtgtccgcccagaaacggccgggtccatgcttgccggggacaaaacaggctgctcaggcaccctgaaaccctcctgctgcacgatgcagcccttcccccctttttctttttctttttttgttttttttttttttttttttttttgagacagagtttcgctcttgttgcccaggctggagtacagtggcgcgatctcagctcactgcaacctccgcctcccgggttcaagcgattctcctgtctcagcctcccgagtagctgggattacagacgtgtgtcaccatgtccggctaattttttgtatttttagtagaaatggggtttcaccatgttagccgggctggtctcaaactcctgacctcaggtgatcatcccgcctctgcctcccgaactgttgggattacaggcatgagccactgcgcccagccacttccctcttctttcttacctggggtttctgaacagccccaatatgggaatttaatgtaacaggctcagggtgagtacacttagcacctggcagaagcttgtgccactggcccctgggcgatcgtgcccctgcctcgcctcaaataaccctcactgatgaagtcctgataaacacaggctcatgtcacagataagcaagagtgcagaaacagcacacagcagtcacagacacacccaggccctgaccagtggcgcagtccggcaccaaatagaaaccacttgtgtttattaatttaaagaaacaggccgggtacagtggctcatgcctgtaatcccagcactttgggaggccaaggccgggggaatcacttgagctcaggagttcaagagcagcctgggcatcatagtgagacctcacctctacaaaagtaaaaaacattagccaggcgtggtggtgcacacttactgttgtcccagctactcaggaggctgaggtgggaggattgcttgagtcaagaggcggaggcttcactgaagcaagatcgcaccactgtactctatcttgggtgatagagcaagaccctatctccaaaaaaaataaaagatccaggcagagtaggagctgaggctgaggctggcagctggcctctggatagtcgtgtcagttcaagaggacgaaggccctgaagcatggctcgtggtcacacatggagcaggtgtcatgctggactttaaaggtagctcttgaaagaaaacacgcagagtagctttcagaataggagagacagggaaagcgggtaagggctggaaaagacgacccacaggaatcaggaggatgacctggaaacgggagggtgattggacgccaggcacacatgcagaagaaagtgcagccctggctgaggccaggtgctcaggctgggactccagggtcaggcccggacaggcctgcttcaaaaatcatcagaaccagcccagtgcaggacacacaatgccggacagcaaaaggttggcaaaggccatgtcctggaaatgccatcccagaggcagcctgggggccctggtgtgaggttgcctgagatggaatgctggcgggaagggccgcgcctgctgcgcgggtggcggccggcggtgctgagcctggaatgctccgtagcgctccagcggtggccgctcctccaaggttgtgcccagaactcctgatttctgttgctcttaaacaccttggataagttacatcttcacattgctgctgctgatagggatggctttgtagccgggcatagcacacgcctgtagtctcaactacttggaggctgaggtgggaggatcacttgaacccaggaggcggaggccacagtgagctgtgattgcactgctgcactccagcctgggcgacggagcgagaccatgtttcgaaaaaggaaaataagtctgctgggcgcagtggctgacgccagtaattccagcactttgggaggccgaggcgggtggatcacctgagctcaggagtttgagaacagcctggccaacatggtgaaactctgtctctactgaaaatacaaaatattagctaggtgtggtggtgggcacctgtaatcccagctacttggaaggctgaggcaggagaattgcttgaacccgggaaacggaggttgcagtgagccgagatcacgccattgcactccaacctgggcgacaagagcgaaactctgcctcaaaaaaataaaaaggcaaataagtcatggtttttgggctgtagccgtatccaccctgccttggtaaaggcttgtggagcctggccccacccctgcagctgctcattggccctgcctctgctgaccctcggcatgtctcctccgtgcagtgtcatggggcaggtgcatcccccagtgaccctcgaggccccgctgtaggctcctcccaggcatggccgggagctgtgggggctcctgcgccctccctccctcctgcgcccatgtcgccccacaagagctctgggcaagaccctcccagcagcccggccgtgctgacgcctctctgaccctcccagcagcctgactgtgctgacgcctctctgtctcctgtggtgttttccaggatttcttcttctattctctagtctacgacccacagcagaagaccctgctggcagataaaggagagattcgagtaggaaaccggtaccaggcagacatcaccgacttgttaaaagaaggtagggtgggccgccctgggcatggagccctctgtcctgtcctgtcctgccgggtgacacactgggtgagaggaggctgggacatggccgtgtcagtgattcatgtgtgactgggggcggcaggtgtaggcctgggctctgtccacatgggtgatgcgtgtaggctggtgtcccggagccttcccccacccactcctggtggtgttggggttctggggaagcctcagaccctcaggcaggacgtggtgatcagctgtccttgcacagtgacacctggtttccttctggcagttgtttttctttttcttttttttcagacggagtctcgctctgttgcccaggctggagtgcagtggggtgatctcggctcactgcaacctccgcctcccaggttcaagcgattctcctgcctcagcctcccgagtagctgggattacaggcgcccgccatcacgcccggctaatttttttatttttagtagagacggggtttcaccgtgttggccacgttggtcttgaactcttgacctcaggcctcccaaggtgctgggattacaggcgtgagccaccgagtctggccttggcagttatttttcattactttttcttttttttggacaaggtctggctctgtcgcccaggctggaatgcagtggtgcaatcacagctcactgcagcctcgacctcccaggctcagatgatcctcccacctcagcctcctcagtagctggaactacaggggcaccaccacacccccctagtttttttgtatttttattagagacagggtttcgccatgttgcccaggttggtctcaaacccctgaactcaagtgatctacctgcttcgacctcccaaactgctgggattacatgtgtgagccactgcacctggcctcattttttaaagttctttttgcctccagaaattttcttctgtgtgaatctgcccacgtttcttgtcttgcctgtgggtgccccacccttgaggcctgctggggccgtggagctccgacgcagtgctcaccccggatgctggcagcctcctccctccaccgggtgcttcggtagccctggtgggaggtcctggggctcactgtccccttctcagccctgtccctcatctccccgctgggcaaggccgcgaggctgccctcgagacgcagggctctgcccccgagggtgggcggggactcgcctccctgcttgcagttgtgatcaaggcgtttcgtgcttgtcctgttttggtttgttttgagagcgggtcttgctgtgtcgcccaggctggacttgaagtcctaggccccagcgatcctcaagcctcagcctcccgagtagctggtgctgtttcgtgttcttcttgattgtccgtaaggtgctggtgcgtctcacaggtggctgggtgtgccacctcctccaggcagctgtgggctccagcattgggctcgtgggcctgctacattgcaagcatctgtgctctgggaggtgcttggcagtgggggaagacccccacatctctccaggcagacagggcacattgagggctgggcctggggaggaggcctctgtgctgaggcctgtgggtcggagcctggggaggccgctgtgctggagcccggcctgtgggtctaagtgtggggaagtcactgtgctgaggcctgtgggtctgagtgtggagaggccgctgtgctgaggcctgtgggtctgagtgtggagaggccactgtgctggggcccggcctgtgggtctgagcatggggaggccgctgtgctgggtctgggcctgtggcctccagggtgccctgctatcatgccagggtctcccagcctggggctgtcttgcctttctggcctggccaaaggtgaaggcctggcagccgcacccaggtggaaaggcagagtccgtggctgggagacaggtgagaacacagatcacatgagggccagagagtgaggagctgtctcaggtcagaggccctcagctggcgcatctgtaccttcagcctggggccagtgggcctgtcaggagaatgggccttgaggtgcccccatcttaccatgcacacctggagagacctggcggagctctgcagggtctggggcgatgggactaagggtccacaaggccgagccagccgcaggagccggcctcctctccccacgctgccttccccgctgccctgccgttccttggcttttgggccgctggtgcaaggaccagggatcccaccagctggtgtggggccgggacgtggcgtccagagctttccccacctccgagaggctgtgtccctcttgagtgatggaaaattgcacactagttgtgcacctgcctttagtgagtttgaaatgtcaaagggagtgcgaccatcatgaccagcagtgcgcatacacggaggcaccatggcttgtgtgggtcacaccaaggctcagcttcttggccgtcagggagctaggccccagcttccccagggtacccctgagccaggtgaggagtccacaccaggctgaagaccccccagcccgccttgctggttcacacagccccagtccctggctgaccccgtcctctgagtctggccaggcattgtttcctagaggccgcatggcctgaccctccctggacacatggcccaggatgtccggcccttggggcagggtctgggagccagtgccccttagcgagggatagcattttcttggggactttctagtctcaagagctctctccatgctggacctgcagccgggcgccccagtggagggcagccccgcactccgtggtccttggtctggaacctcggtgctgcccagggctggaggggagctgcttgcagagtctgagcctggcaccctgcactgagctatggaggcggctgagaggtggacagaggacaattgtggagctctttctccaagtcctcccccaggagtcaggctcagccatgctcagacacacattctcctgagggtgtctcccaacaccacggtcttgttttttggcgagtaaaaggctgtttcgtcagaaaccctcctggccctggccgactgcaggcgtcaggtggcctcttcaccagccttgagttctccatcgtcccagctcccagaagacaggaaacaactggtgactccagaggcacgcccactccctggcccccggctctggctgtgccaggcttagccgcagctgccccagaaccccctggggtggaagaggggccaggagggagcctgtgcccccagaaggtccctggaggtggtctgcctgctgctgtgacgtggcagggccctcttgcaacagcatgtgaacccaagtatctcaaaataaaaagcttgggccgggcacggtggctcacgcctatgatcccaacactttgggaggctaaggcggatggatcacctgaggtcaagagttcgagaccagcctgggcaacatggtgaaaccccgtgtctactgaaaatacaaaaattagctgggcatggtgtcggtgcctgtggtcccagctactcaggaggctgaggcaggagaatcgcttgaacctgggaggcggaggttgtagtgagccaagatcgtaccactgtattccagcctgggcgacagagtgagactccgtctcaaaaaataataataataataataataatataaataaataaataaaaaggcttgatttaaatttacaaaccaaccttcccatctcttgtggccacagttcttggagccctgcattctgggtgggctgggaggccccttgcgtgtgcaccccagccccgggttgagaggccactgtgtgcctgtgtgtgcaacagcctccgtccagccttgcaccctggcctcacctatggggccctgcagcccttccccctccccgtcccagcagctccccgcacccggggaggagaggcgcggcccggcgcgccgtgggaccccgtctcagaaaggccacacttcctccctgtaggcgaggaggatggccgagaccagtccaggttggagacccaggtgtgggaggcgcacaacccactcacagacaagcagatcgaccagttcctggtggtggcccggtgagtcctgctcctgggcaaggccagcaggggtggtgcctggagcttctgttctcccttccctgtggtgggtgttggggacgtgacagtcttggatcccatatcccaacaagaagcccatgcgctgcagccctgagacccccggtagcagttcccagagaggctcgggagtgctgggtccaggcccttcattaaatagaagggcggcccttctggggggcaggcctgtgtgcctgcccatgtgtccctaatggggctttcccaggatgggccagaggtgctttcccactcctgggccactgggagcaagtgggctgggcctggtcatggagcagagcagctgcagcccgggcagacccctggggcagggcgaaggccgaggcccaggagaggaccatgcaccttccctgccagcagcctgggaggtggagaaaaccccaaaagaagccccaaggcggctgccaatctatcgggatgccctcagttagacgcacacgggttctggggtgggtgccgggccctactccgcagcctggggcccaggacacgaggagtcctcgccacctgcgggctgctccctgcgatgctcatgcagtctgtccctggtccctggcgcctggggagctgtgtgcctggggggagtccgcgctgcccgtggcccctggtccctggtccctggggagctgtgtgcctggggggagtccgtgctgcccatggcccctggtccctggcacctggggagctgtgtgcctggggggagtccgcgctgcccgtggcccctggtccctggtccctagggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccatggcccctggtccctggtccctggggagctgtgtgcctggggggagtccgtgctgcccgtggcccctggtccctggcgcctggggagctgtgtgcctgggggcagtccgtgctgcccatggcccctggtccctggcacctggggagctgtgtgcctggggggagtccgcgctgcccgtggcccctggtccctggtccctggggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccgtggcccctggtccctggcgcctggggagctgtgtgcctgggggaagtccgtgctgcccatggcccctggtccctggcacctggggagctgtgtgcctgggggaagtccgtgctgcccatggcccctggtccctggcacctggggagcggtgtgcgtgggggaagtccgtgctgcccatggcccctggtccctggcacctggggagctgtgtgcctgggggaagtccgtgctgcccatggcccctggtccctggcacctggggagtggtgtgcctgggggaagtccgtgctgcccatggcccctggtccctggcacctggggagtggtgtgccttgggggagtccgtgctgcccgtggccgctggtccctggcgcctggggagcggtgtgcctgtggggagtccctgcttggccgacactgtggtcagcgcatctcctttccccagctctgtgggcaccttcgcacgggccctggactgcagcagctccgtccgacagcccagcctgcacatgagcgccgcagctgcctcccgagacatcaccctggtaagtgggcccagggcgggacaggtgagacctggggtggcccatggcccagagtggctgcgcccttcttcctaccagggcccagcacctgccccaggtattcaggacccctgcagaggtgctgtcccacctggactggcctttcctatccaccccaaactcggccagactgtgctgagggtgcagggagggttgtgctgctgggcctgcagtaggggatccttgaggtactgagggagggggtaccgtgccacaggtgcaggaaaagccaccttggcccgggtgaccctgctgtctcctgccgcagttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcgatgggggagtggctggccatgcccatctccaggtaggctgcgggggtgtgggctccacatcccactctgccctgagggagcctgtcctgcaccctgattccctgtgcggagctgcatgagttctgtctcagctgcgctcggccgccatagtccttcctgtcacactggttcagcagacaggcatgggggcgctggtggggcctgggcatagagagccatgctcctgccaccattgcgtgatgaggataagggttggcccaggtgacggaggccagggtatcctcacggagactttcccttccttgctgccccctccagccccaggcttggttttgctttgtttttgactaagctgaacctcttgactcctcatgtccttgttttctgtctcacgtgagtttagcccagcagcaggcctagagagtcttcatggcgtggggtctcccttccctgtacctccacctcaggacccccaccctccaaccgtcagccctcctaaaatacttctaaattaatctgttagaagagcatccctatgtgggggtggtggggcccccaaccatcagccctggggaggtggagactgtggcagggcagggaggagccccaaaggggccgggacacagcggggtggctagtatctgatgaaagcaccatccgggcagcagcgcacaggccagcgcagcagaggctggagacgcatctggaattcggaagaaacaaacatggggttgggtagggtgcctagacctgaagaggaggagggacagcagccagctgtgaggctcctgaggacgcatctgctgggggcaggagtgcagctttgtgtgggggcctctggccaaggggagagcttggccgggcgggaggagtccctgactgtccctggggccagcggcctctccaaggcggatacggatctctccaggcttaaaaacaaaccaagatgagcagaacatgttcagacaagaggacgagggctagaaacaaaattcaccaactaggctcagaccagggcggaatttgagggagaccctgctgcacatggttccagcggaggagaccccagtgctgagcccacgtgatgcctagcgaggcagcgctcaggggactgcggctgcggggccatgcccaggcacggtctcggggggctgcggctgcggggccctgtccaggtgcggggatgggaggctgcagcttcggggctgtgtcgagggagcaggccccgctctccttcctgccagatgcagtggaccagactgaggaactatctgaacccttatttaataagacaggtttcttaaatccatgccacagcccgggcgcagtggctcatgcctgtaatcctagcactttgggaggccgaggcaggaggatcatgaggtcaggagatcaagaccatcctggccaacatggtgaaacgccatgtctactaaaaatacaaaaattagtcgggcatggtggcaggctcctgtagtcccagctactcgggagacagaggcaggagaatcacttgaacccccgggggtggaagttgctgtgagccgagatcgcaccactgcactccagcctgggcgacagtgcgagactctgtctcaaaaacaaaaatggctgagatggccgggcatggtggcttatgcctataatcccatttgggaggccgaagtgggtggaccacttgaggtcaggagttcgagaccggcctggccaacatggtgaaaccacgtctgtactaaaaatacaaaaattagccgggtgtgttgagaggtgcctgtagtcccagctactcaggagacagaggcaggagaattgcttgaacccgggaggcagaggttgcagcgagccgagattgtactactgcactccagcctgggtgacagagcgagactccgtctcaaaaacaaacaaaaaaaaggctgagatggaggctgggttgtcagtgccacctcggcaagatctcgaccttgaccttgtgccagctcctcttcccctggcgtcactgtgttttggcatctggcggggggacctgcttcatcagctgccctctgcacctgcctgccagcaggggcctggcctccgtgcaccaagcacacctcgccctctggcctcccgccccctctgtggccttctggccgcagccctgcccctgcctgcatggtgtgcctgcctcctgccccttcctgcttgtgtgacacgcctcctcccacccagctcccgtggaagtcgctgaccagcatcattgagtactactacatgtggaagaccaccgacagatacgtgcagcaggtgagcccgcccgccactcagtgcccggggtgtgccgcctccccgtcctgcgccccatcctctcccagcaggtgggcgtgcactgctgcagcaggaggggaaggaagactcctgagtccctggcccggctgtcctctccgtggtgctctcctctccgtagcctccagcctgtctgcactgcagccccaacctgggcctagcctgctgacctctgaccttctcttttgttttaagaaacgcttgaaagcagctgaagctgagagcaagttaaagcaagtttatattcccaactagtaagtgtgccctcacagccgtcgtcctcgtggccccgggggccagggagggtgggcacagggtgctggggccaggcgggtcccaaggaaactcaagctcagaggctgggaaagttggggcagcccccgggagggcggcccagggctggggggttctggctgcagacgcagtggccatgtctctgtcgtcctggcctcctggtcagtaagggggcattgggattccagcccacaccgccagggttcagtccctgagctgggctccatgctagggggagcacgggggcctggagaacggctcagacctcagcagtggctcccaggaactgaaaggggagaaaggaagatccctgccgaggccgaggggtgcgaggacgtggttctggacaaggggtggtcagccgcggtgcctgctgggcacatgggccctcgaggtttgtgctcctgcaactcctctcgtctctcctttccctctttaagtaacaagccaaatccgaaccaaatcagcgtcaacaacgtcaaggccggtgtggtgaacggcacgggggcgccgggccagagccctggggctggccgggcctgcgagagctgttacagtaagtgccctggatggccgggggcacaccgcacgcccgcctgtgggccgtggtgcctgcgttggccctgagggctccagcatggcccagcctgcaaggggcccactgacgatgggggctgcgtcccaggggtgtggttgggagagcctcggggaacgtgtgggggtgcctggcgggtgggggcggccggcgtgggggtggcggggaatactctgacatcgctggttctgcttaagaatccgtctatttccaactttgttgtccgtagccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatggtaaggggggggacacccgccctgcctgccatgagcctgtcggccacgcgggtcctcggcccccggtcatggcgctgtgttggggcggttgcgcccccttccgcagagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgtgagtcaccccaacgccccgcttactctgttcctgcgggtggtggggagagagcagcaaccttggggcccagcctgtagccccactgggagttctgatctcagggagccccacgtcctcctcggtgctgacatggccgagcccagtgagggctcccaggtcaaggcgcaggcagggtcccgtgctcccctgggggtgccccacccctcacaccgtgtggtaccccgcaggcacggcgcggctgcccgaagcctcccagagcccgctggtgctgaagcaggcggtacgcaagccgctggaagccgtgcttcggtatcttggtgagcagccaggcgtgctggggggctcccaatgctgcctgcaggcagcttctcacccaagctcatgcactggtgctcccagccttctctagctgggagctcctggacagccccccagggcctggaactgtccttttggggtactctgcaccgtgccaggctcaggcagacccactgggacccaggctgctccctgctcctggggtcgtgatggggcccagtgcggagtagcggccgccctgtcttctgcggggccagcctcctcaaggcacacccgggggcttccctgccagtctcgctaccctgttccctgtgttctgatcgtccctggggcctgagggtctggggtttaggtggtgcacacccctgcctgtaataccattaaggcagcgtcgtacctgctgcctgcagggagtatacttcctgagccacgcccactccacaggggcagcactcaggcctctgcacgccctcggcagggggaggagcagcctcaggcggcagggggttcctttgcctttgagcatctgaggacacccgagaacctcagccggctaccctggcccagctggaagcagcttggtggctgggccagacatttgtggtggcggtggggggcctcctccatttgctgggctcgagtgggcttgtgcatctgccctcccgacacagggtgactgtcctgagaaggacattccagagtcatgagccaagtgtgctctgagattcaagtggctttggcattgctccctgtttggggttgtggcccctgtcctgtgggaagaggtggctggtgtcagggctggtcctcagcagctgtgtccctggccaggctggctggatggttggttcgctgtctgacgagcagccagccctccaccagcagctccgggggcctggacgtgggggctgtttaataggcgtgctgtgctcacgggcctgtgtatggatcctgttgtcccggggctgaggggcctggcccccgccaggtggtctccctgctctctggaagccctggggtgcgggactggcccgggcacacgccttgccgagggcttctgggcttctggttctgtggtgacctccccacttccagcccagtcaggatggggcctcgggtgggggccgcatggggcttagttcctgggggtatcccggaaccatgagggctggagcctgggcctgcctgcccctcccctgctgggcagaggcaactcgttctgcctgtgtcattcccggcagagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtgagtggcccccccgcccggtgagtgtggccctccccgcccggtgagtccggcccgtccccgcccgggcacccgccgtgcgtgctgacgctgtcttctctccctctctcccaccccggcgctgccaggcaacatgaagaagcgcctcttgatgcccagtaggggtaaggcctggagccgcgggcgggcgctgcgccggccccgcccgtgatgcctgtgctgtgctgctctgtgtccccgcggcgggcggcccagggcccatgcttggggcagtccacgtgagccaggccacagcccagttccccacattcctcccgacatcactggtcccttggtgaagaccccccgagcccaggcatctggccctcggccccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgcccagcccagccaaccctgtccccttggggcattctctcgaggctgctgggtgtcctggcaggcacgtcctgtggggtcagcacgccggctgcagcgcagggtgggcctgagatcgggtgccgggccccccatctccacctgtctggacacgcacccctggcctgtccttgcagcttcctcccgacatcccttggcggtgtctgtgtctcggccccagccccagccctcctttcctggggcaccctcccagccatctggtattggggctgcccccattgcctagtcctgggcccagggccagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaaccagcaagttacataaaagcttatttgttcccactgaattttccacacctcacacgtgagtcccagccatgcagtgcttgtgagggagcatcaccccttgccgcctggctgggcggggccctgggctcagaggggtcagccacagaggaagcgcctgtcctgacgtgtagcggccaggacctgggcgctggagaggggccagctgggtgaagacggctcccgggggcactggcgcacacgaggtggggtctctgtccagcctgggtaggcatgagctgagctcgagtgagggccctgcctgcccacagcacggggccccagcgctctaacccggccatttgcccgtgcagcctgttgcgctgtccccacctgcggggcctgcagatggctgcgtgtggctcactaacctaaagcatgtgtttcttccctctgctgtccaccgctctggtaggcacttacctgggtaagtagtttttgtgctactggccagccctgggcgctgggccttggcttgtggcaggtgccctgaggtatggctgttcctgcttgggagcgccgcagatcaggcacctgggcccccacctgaccctgcccggcagagctaagcaaactggcagggaaaggctgacccagggctccagggccccagttggcccccaggggagtgccccaagttaggaggcaactgcaggtggggaggggctggacaggctgcttctgttccttaagggatgggcctcagctaagcagcgtttctggagctggcaggttgctccgatgcccctgggccctggcacctgactgagttgagtatgacatcctgtcctctctgagctggtcctgctgggagccgagccatcctgggaccagctcccacatgcacacgcccacacctacacacagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccagggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccaaggtggctgaggccgtggtgggcggtgggagtgcaggacgcgctctctcggggcctcatttctctcctccatttctcatcaggtctggcaaaccacggacaggccaggcacatggtaagaggaacaacccatgatggggtacggtgcgctcacccatgagctctctggggtgttgggaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtaactcactggggtggtggggggttggccaggcacagcacctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaa

SEQ ID NO: 36123 - DNA, 83016 bp, Homo sapiens; identical to SEQ ID NO: 35589

SEQ ID NO: 36124 - DNA, 210077 bp, Homo sapiens
ggtgtggacgttgtctaaatttcggtagccatggcacaagaatatagtaagtactatgccatacttcctatgacctacctgctttacaaagtgttgattttctgtgtttaaatttctgattagagaaatgaaaacatagaaacaaaattttaaaaaatctacttttctcaaagagatgaagtcgtttgtcatctgctttttgaatctatagctttatatacaaatacagtgtaatagtgatttatttcgtattctgatacagtattgctcaggctattgcctgtaaatagtactgactgaacattagggttggatccatatcatgcgttgcatctattcctcatgttatggggttgaagaactgactgcagctcgccctgattaggagcagtctcatttctgccttgtccatgattgactcatgaactctggctacatcagtgagtgctgagtgttacctggccagggggatggtttcagagatggtcctgtaatccttttctacccagcgtggctccaatgtgggtttgcctggagcttctggcagaaggcttctcatggttaggacagagctgcctcttacttctggatgttgttgtgcgctggtgtgaggtctggtgtagctgcagcattgtggcttccggactgagtgagaagccacacagggtggaggacggagtccagaatcacaaggaaaccagccctgaagcttgccctttctctgacgtccaagcatttgagccaatacatttcctttttatttaagccagtttgagttaggagccaaaacagcctaagtgattcacttagtctccattttatttttagtaatccattagtttctccctggggaaatgtaggagtaattgcaaagcaaggcaaaataataccattaaattaaactggcagagtgtgttggtgttgactggcatactcttcactcttaacagttagcaggtagtgatttagtattcaaagacatgagaataaaatatatcactttcagattctaccccacccccacacccccagaaggttttgcgtcctgatcgaccaacttgtgctgtgaatgctaaaaagggtcttggatactggcagactcatccctttgcataggtaggtgcatatttggcagtgcagacttgttctttgtgttttcttagaacagtctatacccttctaattccttgtttttgttcttgaaaaattagtaggaatatttcaaatataaaaagcatataaggcataacacaaatatccttaccccagctcctttttgattagcagaaaaacaaaatccatgttacctctcctcaacactctatagagaaatcgaatgtttaccaattccattgaacattaaaaaacccaggatatttctctctaacagcagttccctttcttaatccccaagaagccactatcctggttttggtctttattattcccatgcatttgtttgtgttcttcccacatagtgtattgtatgatttttggatgctttttaactttgagtaaatgtagatgctatgtgcatttattactcaaaatcgtaagggagtttagaataaattgaggatcgctgaaagaggctataaatctgttcttaggtacttgtgaaaagatctattattgggtatcctagtgatctgtgatagaatgttttaggttttgaatggtcaatgagtttgaaccaacatgctgatagctttctgtcttatctactaatacgaagcacttttctctggtaattggcctaccattgagttcactctctgtatctacttctacactcctgtgcaggtgtggaatgtgcaggatacttatagatcaattgtgtcattaatgaggttttcagagtgtgttggttgctgtttcatttaaatagctctattcattctgtagtccaaatgatgcttctggcatcatttttctgcattgtgagaattcgccattatgcctacaaaatttacttcttttttttttttttctaaatttgtcagtttgtcactatgttactttgtactggtagcagtagtacagaagaggggtctactcctaagaactggctgtcaggttgcacctcgaaatagtactgtgtatcagtcatctgggagcctccttggaaatctttgttgtgcctttatgtcccttgtgacccaatattgggtcttagggatcattttctatcttgttcttgtgtgaaatgtatcttttttttgtttgcttttgcttttgtttttgttgttttgttttttaagacagggtctcactctgttgcccaggcgggagtacagtggtgcaatctcagctcattgcagcctcgacctcccaggctcaagtgatcctcccacctcagcctcccaattagctgggaatacaggcatgatgaaccaccaggtttgggtaattttttgtattttttgtccgcctcagccttcaagagtgctagaattacaaatgtgagccaccatgcctggcctgaaatgaatcttaagtcatttaaattttgcattcaaaaaactaattcccttactattgggggagtcctgttaccctttgctcttgcttggaatgttgcctccatgaaactgaatagtcagttccattcaaaaatcattaatcctttcaacttgagaacctaattactgataaagtatcagagaaaaatttacaacaatataatttctgttttgtttttttttctgggtgccatttttacttaaatgtttaacatttgaaaaaaagtgaactcaaaagattttttcccctttaatttatacatattatatccatgttacaggaaggaaaacattaacatcttttgttgaaattgtttgaagatcttacactttgtgaatgtattggttgttgtgtaatatgttttgtgtgcattttcttttttaaaaaatctgcatgttatagttgggttttaaggggaaaagcctattgaaaattttctttgaaaaatcaattcggtgaactgatattactcttttttgtttgtttcttgtggaatggagtcttcttctttcttatatatgaaaggacttgtatatatattaatggcatacaaaaggacttgtgtaaatatggaaagtggtacaaaaacttggcttgtttttgtaccgccagatgaaatgctgcctttgtggggaacggccccctgggctgagggagcttctagacactgactcagatctgtaattaggtcttgctctccgcacccttgttgacttgaaagcactggccatagaccatttagtctggaaaagcaatactacatgaatcatctaaattggcacaaattatccagaatgctactaaatgttttgtactcctctgtaattgagagaattagaaaaggagacttgttctttaaaagtattatagagggtacgtatacactgatgaaagtaaattttttttccctggatagaatgaaaagcagtggaatatttgacatttgtaagcagttctgatctcatgggtcagttttaggagattcctccatggttcccatactattttcctttgtgagaaggtaggaagtgtggcctgtcttccagctcccgtttatttctccactcagaccttttagacctgtcttgccatctgtagcctctgcttaacctctacagggtggtggaggcaggggaaatcctggaaacatattgtatctgttttgcttcctcctaactagtctcacaaatcagtatctcagtatttagaatggaaatatgatactcctctcttccctttcgaaaatgttgggtcgtagacttattgagacctgttaggtacctggcaatgaagtgggtgaaagtcatttttttggtgtgtttgctaagtagtaagttgacagtgtttccatttatttttaaaaaatcaaatcaaaagttttcttactttgtctcaatttactttataacaagactttaattatattctaaagttgaaggcatttataagtcacttaggaatagacataaaatgaagacttttcctagagtaccctttttcatttttttctgataatttattaggagtctttaccagcacttctttcccagcgctgtgtctgctctaaaaaggacaagcagatttattcattcagcagcaaaaaggccaaattttcaacttgtaatgtgagttggctttttaatatgtgaataaacccttattttcatgttggaatatatgtgagcaggcatctcagaggaatgcgtctttggcagtaagtagaagaaagccacagatcactatgtaattttgtgttgtgaaggcataactgccattttgtgtctgcggttgtacatgcacatgcttgtgattcaggttgtctttgttagtatagggcattgctatttgtcagaccttgccactttcattttggagttgttgaaaatcacatattcaaattataaaattgttagaacatatgctgagttaaattgaaagactttagagtgagtttctaaaaaactgattggtaaaatatttcatcagtcagtacccttgataaaattcctcattaggtgggtaggtgaatattttttccctaatataaattacaaaaaccttcatttaggctgtgtttacaaagagtgccagtttggctgagtgctgtgactcatgcgtgtaatcccagtactttgggaggccaaggtgggaggattgcttggaggccaggagtttgagaccagcctgggcaatatagtgagaccccatctctacaaaaaataaaaataaaaataaaaataaaaataaaaataagaaaagagtgctagttctctaagaattgtgatcctgtttgtcacagaacttgcttagtacccagttaacctttcacttaatctattttggcaattgtaagccaagagaccatgccttagtaccaaaaacaaatcacccaacctcattacccttggtttgcatttgtataaataattgggtcattagccaatatgtaaatggaggggcatgaaaggttgaccttagtgggaatttaacaatactttatggcttctagattaactcgtgtaaattatttattcgtggcagcaaatatcttttgtttgtgggtgcagtgctgtaagacctcaatcaagacttctagagttcttaatgggtaggaaaatatctaaaggagttttatgcgtgattatatcttattccatctagtaacagatgctttcccaattttgtgaatgaatggtaatccctgatgaaagagcttcccaacctcatttttaaaaaaaatttccttcacaaaccaattgaataaaattagtctggcctatggagttaggtgccccctttgtaaaatggaaagctttactaaacagtgtgtgcagagagaccatctgtctctatttctatctgaatatttggctccctccctaaatttgatggtatccccattgtattactatgcagtggcctcaatttaaagatggagaagccaatgtacattcatctgttctgcatgtgtatagagtctgttgatcgtaaagatttaggccaagatcctgcattcattgttactataatttgatcctttagttgtattttgatgatcacttggaataacattcagttgtattcgttcagagcatcaaggaaaatctcatttaatacactattctcaacaaatgttaaaagtaacttacaaaaataatacatactggtaaaaaagtagaaaatgcaggtaaacataaagacaaaaatgaaaaccatctataattttaccgtccagaagtggccattactaacataggctaataataggttctcacagaacacagagcacaccattgagaaggggcagggggaccctatgccaacaattaataagggactggctggagatgatgacagctagaaactcttaaatacctatgtatggtgtgtgttagacttagtgtcttctaaactggaagtatttattagctgtgttcattttatttaagataaaagaaagcacctgttgaaggagtaactgccctattctggttgacttttgtttccattgattttttaggaagtgtttttcttatgcagggcatgtttctctatgtaagcatgaattttcctcttgattcttaagtgaagggataatataaaatgagctgctatatagaaagagtagaataataacatacttttaaaaggaatgccttctgctcctctgatggaaagataggaaagtcaagtcaccagaagctgcatgtggttattatcaagggataactgaatgtcagaatccctcctaggttttttttttttcctttttcttttcttttgagacagagtctcagtctgtcacctaggctggtgtgcagtggcacagtctcagctcactgcaacctctgcctcccaggttcaagcagttctcctgcctcagcctcccgagtagctgggatgacaggcatgcaccaccacacccagctaatttttttttttagtagacaaggggtttcaccatgttgaccaggctgttttcaaactcctggcctcaagtgacctgcccatctgggcctcgcaaaatgcacggattacaggcatgggccactgcacctggtcccttctagatttttaaaaatggtttttaacatagtgtatctgtcccctgctacatcttatctgatgtccctcttcttctgtctgttgccttgccatcctacggcagcttcacgtaacttaacaatgctacattgtaaaatctaaggaattctgtgctaagatctctgattattccactaacattctctcatccttcaatttacaatagctttcaaaaaaaaaaaaaaaagagtctggctttcaaatcattacactacaaaggtttatgtaagcaacagtcatctccctggatatgaaagtagttgtcctttgtgctgttttgatggcttccgagtgcttgtttgttggtttccttctctgatgctcaggataacttagtatgccacaaccctcttaacttccaatgggcttcttttaagtgtctatgcttaacagaagctttctctatgagcaataatgtacttcaaccagttggtcagtgatgatccccacagtttgttgtcttgaagccattgtggtataaacagagcaaatgatgagagctttgtcctctgccctctcttccaagtaaagagtgtaaaagttgttttaaaggaagtctgcattttgtggtatcattcagttttggaacagtgtctatttagattttagcctggaattcttttggaaactccacccctggaagaaaatgattttaaaaagaatgtgtttcagcagctgttaatgtcagcagcaagaacatagcactgtcttggaagatcttttggttatacaacagtagcttgctggatttcacttctgcagttgcagtcccttccattgagagactgatttaaattaggcgaatattgccaagttttaaattataatgttgtattgttggaaaatgctcaaatgttgattctctggcgttataatgtgtttttaattttaagcatcacattgagattttagcatttaaatacctgaaggaagcgatacgcaaattttaacttgttaaaaaatattaataagtagcagttgtttctttcttgcctgtttttcttttatggaatatttagattttgtatggtcatatgcaatagttctgaactcttgtcttcttatgcacaatgttagggttgtgcatgggttggttttcttgcacagctctcattagatttatttcagttacctattcacagccctaatggtagtgacatccctgtttatttacttcttggattcttaccaagttacaacatgatctctttatccttgggctgctgattctattaagtttactatttcttttatttatttacttatttttttgagacagagtctagctctgttgcccggagtgcagtggcgcgatcttggctcactgcaacctccacttcttgggttcaaatggttctcccacctccacctctcaagtagctgggattacaggcgtgtgccaccaggcccggctaatttttggtattttttttagtagggacagggtttcaccatattggccaggctggtctcggactcctgacctcaggtgatccaaccgcctcagcctcccaaagtgctgggatcacaggcatgagccaccaatcctggctaagtttactacttctacacgaagacagactgataggtttttattttagataagcaattccagtgtaatctcttttcagaggatttagataaagtattttcagttggcctcccattcctccttctcattccttcagtgtgggcgagtgggctatcttttttcccctgcatcttcatttccttttctctctctctctttttttttttctcccttgacagagaagttttactttcttctaagtggaggatggtagtaaaaatcaagttcaggtaaagaatgaagttgtgggccagatttgggaagaaaatgagagagaaaaagagttcaggtgaggaatttgtagtcttaaaaagtaaaatctgccactgttcctttagctgtttctgtgtgaccctgaattggaccaggtaactgccattttctcatcagggtctgaggatggcatttgagcaatagctagcttgtcagtgtttgtttttataatgcatagtcagttaagagtttgactgacttgctgatttgttaactgcagggggaaaaaaaagattcactctctcctttctaatttcttaccagatgaattcctccttcatcagttctgtgaagaggctatgaaataatttgaacagtttttatttttaataattgaatcttcttccctactgttatacactaagatctccctttttctcaaaaggagtgagaagttattttcccttcaggttttaaggtaagaattggtcccagcgaggtgatttctaactattcttacttttttttttcttcagtcttccataaattagccgaaataaaattttgttctgaaattttaccaaattctttgagattcttggagtcctctagaggtggtatggagccacagcttggaataattgctttaggaataatccttccacctggtacacagggacatcatcctttgcaaggaaggcggttaaatgtgtgtagtctggcagattgggatctggactcctgagtgtgtctcttctgccttctttagtttgctgtttcagatctctctgtccttattgccaagtcaggtctctaagcttcattgtcaagttcactgtcttcctaaggttgtaatagcggcagggtcatggtgctttttggagtttgtgtctgttttctggtgtttgctggatacaagacggcaaagtagtcccatttctgttgcagtgcttgataaatgcagggtcatggtgctttttggagtttgtgtctgttttctggtgtttgctggatacaagacggcaaagtagtcccatttctgttgcagtgcttgataaatgactgaagaaaggaaaaaggagagaaagaaacaaagaaaatctgatttcttaagtagttacagtctgttcttcagactgttttttgtttgtttgttttgatggtgtttattaaatgtgcacatcattaactgcagtcatacagggttgctttcaaatctgggagaacacagtggtctacaaagtagcttcttagtatttctcaactgtttttcagcacaagggaagatgcactcattttgatttccttcgttttttcctccaagagcagagagccgcattgtttttcctgtgacctttataaagccatgtggtctgtttggaggacagtcagtgcacactccattcaaggatgctctctacagtccttcctgctccttggcccgttttccaaaatgagataatgaatataaaaacactctctcataagctgtagaagtgtcagaaatggaggagaatattgtctttactatattactctttgcttgtgtggcctagtgtaaatattctctattcactacatgatctccattggtgaaatggctgcttttgacaatactgtttccagagaatagctacttctcgattaggccagcttggaacttttccaatggaaaactatttgcacattgaacaaatatgacatatattgcattaaaatgagttgctggtatttcataatatttagaagttgaagaatcactgccctttatgtatggcagtaaatttcttttggcagtgaccatgaagttcttggccacatgagaaataactgaccagagagtctgaatctaacttcttattcagagaggactgtttctctgacagatggattttgtagcctttgtcgagcttttatatagaataatgctttttgttttgtgatttaactcattgccctcaggcttttcaatttgtatatgttgatttgaagagctcttcccatggagagatgtgtgacctggactacaggaaatataatgtgcaggaagagttggggaggggggcatttccttcctcgatctcccaaaatagccaagtaattaaatctattactgtagctagaaagcagaactattgtctatattgtcagcaacaccctaagggtgaagagaagctgcctgcctctgtgcaagacattatctgagcaggcgcctcatccagtgggacgatgccatccacatttggaagcaggctgagaaatgcttcggcactggcagcaactcctcatcagaaatgctctctcgcattttatagtaaacctgtgttgactctggtggggagctctaaaaataccttatcatggagatttgacatttcttatagcagccgatagtttacattgacaagccccttggaattgtttcagaacactaatcacttgctgtcagcagctagttcctctgaggggaagagcggggctgatcctgcctctgttgtgagactgcatgattagagggacatttctgaattcatgtccattccttcatttccagtgcatactgaaatcaaaataccatcaaaggctgatagaactgattcacagaatttgtttttaggaattttggattttttaaagtacagctaagcctggtggtggctcatgtctgtaatcccagcaccttgggaggctgaggtgggagaattgtttgaagccaggagctcaagagcagcctgggcaatatagcaagaccgcatctctacgaaaaataaaatttaaaaaattttaaaactaaataaaaagtgctgtgttatagctaggacaaacaaaaaaaaggttgtgtcatttgtcttggaagtgatgtctttgctgaatgagaaaaagaatacagtgacaagggaagcagtttcactgctgaaaacattctgactcttgttagaacagaattttcctcctccaagagagatggttatttagacatgacattgtttgaaattagggcaaaatcatgtagtgttttaaaaaagtactcaaatatacagtgaaaagaaagccaagctgtaacgcattaatcagaacttattcatgctggctgggcagggtggctcaggcctgtaatcccagcactttgggaggtccaagtaggcggattgcctgaggtcaggagtttgagaccagcctggccaacatggtgaaaccccaactctactaaaaagaaaaaaaattagccagacgtggtggcacacacctgtagtctcagctactcaggaggctgaagcaggagaattgcttgaactcgggaggtggaggttgcagtgagccaagattctccagcctgggtgacagagcgaaactccatctttaaaaaaaaaaagaagaagaacttatttatgctatatggaagataattttttctctctccttctggtgagaataatttgctgctccatgtgaggttaagttagttcctttattggatcatttattaaatgttaagttctgcctatggatgagtacattaaccaagagggcatgtttcatttttagaataattgactaatgtaaggattctaatgtttattatatctataacaattcctctttaaggataagtaaataaagacccaaatgcatagttacttgttaaaagtagcaaaacaagtcattcaaagagcaggaaacagatgggccagtgcatgtttctttctataaaagttaatctcagccagaagcggcagctcatgcctataatcccccagcactttgggaggccaaggtgagaggattgcttgagcccaggagtttgagaccaccctgggtaacatagtgagaccctatcgctacataaataagaattaaaaaataaaaattagccgggcatgttggcacacacctgtagtcctagctgcttgggaggctgaagcaggaggattacttgagtctagaaggtcaaggctgcagtgagctataattatgctactgcattccagcctgggtgacagagtgaaactctgtctctgacaacagcaacagaaacattaaggtatgttgacacaatgcatacatcattcaaaacagagattctagtgccagttattgtgtcattatttttagataagtattgtagccattgcacagtaatagctcaaggctccccattccatatatttcccattggatggcacaaaggaattctaaaacacgtaaggatcagtaataacttactgactttggggttaagggacaggaggaaatcaatggcacgaccatggatccaacctgctagagaatgaacttacttcccagtcccccaactccttatttctatatttttatttttttagaaatagggtcttactctatcacccagcctggagtacagtgcacagtcgtagttcactggcaggcttgaactcctgggctccagctcaagccgtcctccccactcagcctcccaagtagttaggtgtgcaccaccatgcctggctcctcctcctcctcctcttcttcttcttcttcctcttcctctcctcttcctcttctcctcttcctcctcctcctcttcctcctcttcctcttcctcctcctccttctttcctctttcttcttcttcctgctgctgctgctgctgcttcttcctgctgctgctgctgcttctgcttcttcttcctgctgctgctgctgcttctgcttcttcttcctgctgctgctgctgcttctgcttctgcttcttctgcttcttctcctcgtcgtccttcctcttcctcctcctcctcttcctcctcctctcttcctcctcctcctcttcctccttctcttcctcctccttcttcttcctcctcctcctcttcctccccctccccctcctcctccccttcttcttccacttctttcttcccctcctcctcctccctcctcctcctcctccttccttctcccttctcctcctccctcctcctcctcctcctcctcctcctccttcttctctctctctctttttttttttttttacgagatacagtcttgctatgttgcccaggctggtgtggaattcctaggatcaagcaatcctccttcctgccttggcccaaagtgctgggattacaggcatgatcctctgtgccctgccccttcatttcttctgtgttctattcttaactttgtatgtttctcaacttttatgaagtcctactcttttctgtagctaacgtctttgttctgtctttaccagtccctctcttctctgggatgtgaattctctaattgtgtcattgcacttactcctccttcctcatctcttcatgctttttctgtgtctgtaaatcttctctggctctttcctgtcctctccagcacccactgccccatccactctcagatcttttccattctctctcttcttgcttccagtatgtcacaaaaagtgaaggagtgggagaattaccccatcactcttttttatctttattcttaattcttaaaagttctttttaaatttgggtattatatatccaacaaaatgcaaaggtcttagttgtcctttaagatttgggtttctgattattggctgttaggaataagattgctatcaacattcttgtacaagtcattttgttgacatggaatttcatttctcttgggtgatacctaggaagagaataattgggtcataggatagatgtatattttactatgtaagaaactgcccaactgtttttctgaaatggctgtgccatgttatagttgcaccagcaattcatgagggttccagttgctccacatttcttaccagtatttggtattatcagtttttaaatgaacttttagctcttctgctgggtgtttaatagtatctcattatgattttaatttgctatttcctgatgactgattttgagcatctttttatgtgctgattggccattcatgcggtcagtaacttttttcttttttttttttttgcagtgtcttttgcaagtcttgactgtttttctaaattatcttcgttgtcttttaattgctgatttgtaagattatatatgtatataatgtatgtatatgtatgtgtatatatacatatatcatatgtatgtgtatatatacatatatcatacgtatgtgtatatatacatatatcatacgtatatgtgtgtatatatacatatatcatacgtatatgtgtgtatatatacatatacgcacatgtatgtatatatacacacacgcacatgtatatatacacacacgcacatgtatatatacacatacgcacatgtatgtatatacacacgcacgcacatgtatgtatatacacacgcacgcacatgtatgtatatacacacgcacatgtatgtatatacacatatatgcacgtgtatgtatatacatatatgcacgtgtgtgtatatgtacatatatgcacgtgtgtgtatatatacatatgcatgtatgcacatgcatgtgtatatacatatatcatgtatgtatacacatatgtatatacacatgatatgtgtatatacatatgtgtatatacatatatatcatgtgtgtatatacatatatgtatatacatatatcatgtgtgtgtatatacatgtatcatatgtgtatatatgatttctttgtcagatatgtatattatgaatacttttccttgtctgtagcttgcctgttcattttcttaacgatgtctcttgatgaacaaaaagtttaataagtcaaatttcttgagtttttttcatggttaacgctgtactatgtgttacctaagaaatctgcttagccaatattgggaagatattttcctatgtttactccgagaagctttagggttttgtcttttacttttaggttgataaaccatctctaattttttttgagtgtgaaatgaaacaactgttaaggtttacttgcactgttttcctgtttctatctagtaccatttgttgataatactgttcttttcccattgagctgagttagttcttggttgaaaatcagtcgactatatacgtgtgagtctcttctgttccactggtctctttgttcttaagtcaattatacactgtcttgaatactgtagctttataaaggcttcaaatcaggtaattaagttctctaactttatatttttttaaatttttattttttagagatgtgcagtggcatgatcatagctcactgcagccttgaatccctgggattgagtgatctatctgcctcagccttccaagtgtctaggactacaaatatacaccaccatgcccagttaatttttatttttgtagaggtgctatctcactatgttgctcaggctggtctcaaacttctggactcaagcagtcctcctgccttggctccccaaaatgctaggattataggcatgagacactgcacccagcctcattcttgccttttaattgctttgtatattatagatcctttgaatatccctgtaaattttagaatcatttgtcattaaaaaaataaataaaagccaattagattttgactgggatttcattgatactgtttttcagtctgtggagaatagacattttaataatactgagtattccatttacgaacctcttcacttaacttctcagcagtgttgtgtagttttcaatatagatgttttgtacatctttcattagatatagattttcattagatatactggattttctgtgatcctctaagtagtgtatttcaaattccattttgttgttcacttgctagtactcagacataacaattgctgtttgtgtattgacctgatatcctgcaaacctcctaaattcagttgctagttctaatttgtgtgtgtgtgtgtgtgtgtgtgtagttgtcatatgtgatcatgattgcttctgttaataatgacagttttatttgttccttttccatctttatacatttttaaactcctttttctggcccatcgaactagctagaacttgctgtggagtgctaagtaggagtagtgaaaatggacatcttgcattattcctgatcttaagaaaaaagtattcattgtttcactgttaagtctcatatttggctgggtatggtggtgcatgcctataatcctagcactttgggaggctgaggtgggagaattgcctgagtccagaaatttaagaccagcctgggcaacacagtgagaacccatctctacaaaaaataaaaaattagccaggattgatagcacatggctgtagttccaggctgtcgcaaaaggtgagcccaggagttcgaggctgcagtgagctgggattgtcccactgcactccagcctgggaaacagagcgagaccctgtctcaggaaaaaaaaagagagagagaaaaagtctcatacttaggttttttacactgtggcttctgcttttaaagccctataattttgtgagctcctattttttaagttcacaatgttcaatctacatattaagctttcttgtgcttgtgatgttactgcattactcccatttttctgttttctgcctctttttccaagcagttacttgttgctttttccccttggctcttctacttttgcgaacatagcttcttctcttttactctcttctctctgtattgttttttctttttctttctttttttttttttttttgagatggagtctcgcactgtcccccaggctggagtgcaggtgcagtggcacaatctcagctcactgcaacctccgccttccaggttcaagcaattctcctgcctcagcctcctaagtagctgggattacaggtgcacgccatcacgcctggctaatttttgcatttttagtagagatggggtttcatcatgctggccaggcttgtctcgaactcctgacatcaagttatctaccgtgcccggcctgcattcatttgcttttaatgaattccttttttaatgaattcttatttatcaaatatttattgagcaggtacaatatgactaaccgtgttagtatctgaagctatacaagttgatgaaacatggtctctgtccttaaagagctcactgtaaagcatggaaagtaatggatgcttcccttggacctctttggaaggaatggacatctcacttgatctggtgagggtcagtgaaaaggcctactgaaggagttgattgtaccacttatttttgctccttttgtgcagtcatccaagattgaggatcggttttcttttttttccttcacatgtgattatacctcttctcaattgttttcatgccacaatttccaaatctagccagaagcgtagttgtcagaactatattgtggtgcttattgccttgtaccctatgtaatttttgtgtaaagagctcccctaatagctctttagctcttggtggtagtaacttgtttgtcctgatttttagaaattctatggaatgttatatgtgttagaaactcaaatgtttttgaatgaatgaactaattgaataacttttattttttgttcatatgtgtcttatatttcattattggatagattcataagattcgtcacttaatatgaaaataacttttttttttttttttttttttgagatggagtctcgctctgtcgaggctggagtgcagtggcatgatctcggcttactgcaacctccacctcccaggttcaagtgattccgctgcctcagcctcccaagtagctgggattacaagtgtgcaccactacacccggctaatttttgtatttttagtagagacagggtttcactgtgttggccaggctggtctcgaactccgtacctcaggtgatccgtgcgcgttggcctcccaaagtgctgggattacaggcatgagccactgtgcctgacctcaaaatagttttggattgtattaattttctagaataattattttgttcaaataataattattttgttcaactattcctttggggggcttctttccttccacgctgctggacagtaggatgactctctaacttgctactgtacccagagcagaccctttccttaaataacagatgctcgtgagctgcacttcaagattcctgtcttgggtttttcattccatttcttcacccaaaccaatgtctgttgctccatttttgtttgccatggtgaaaccctgtttctagtaaaaatacaacaaccagctgagcgcgggtggcacacgacagtagtcccaactacttgggaggctgaggcacaagaatcccttgcctctcttattcagtagctctgcttattcttgtaaagccataatgacatcacagaatagattttatttttgagcaggtaccaactagtgattatttttagataattaaattataaaaccatgaacaatgccttattgcaaatgtaatggttatgtgaggcattgtttagtgatttcattggaatgaaggtgaaacaaaggcatttaatttttttcaaattgaattatgtatttctttcaggcaaacatgtgctacttagtatccattaaatatgagggcatatagcttaattttgcttaagtgtaaggtcagaagtctttaaactcaactgtgtaatgaagtctgctgtcagcgttttatttactaaatttttatcatttacaaaatttgaaataattttgaaagataaattgtcttttatcaccagtagattttttttatttatatccttgtggggaggagtgtggtgatcatatttagatatcagataaaatcagtgtgcatggaaatgttacgtgtgccttaaaaatgtagttatcaactttgaatcaacagaaaaataagtgttttaagtgtaatttacattaggatgtttacatttctaatattcttaagaaagtaaatgtggtatttagtataaaaatgaaatgaggccggacatggtgactcacacctgtaatctcagcactttgggaggccgaggtgatcggatcgcttgaggccaggagttccagaccagcttgggcaacatggtgaaaccctgtctctagtaaaaatgcaacaaccagctgagcgcaggtggcacacgacagtagtcccaactgctttggaggctgaggcacaagaatcccttgaacctgagaggcagaggttgcaatgagctgggatggctccactgtactccagcctggagactgtctccaaaaaaaaaaaaaaaaaaaaagtgaaatgaaaaggcatgcttatatagtgagatatagcttaaagtttatttgactatgagcaattaagccttatcaattcagaggttactattaattgtttataattttaaacccaagtctgctttttctcttttccttacatatgataaaaatgcctcacttttattaaacttaataagagtttaaaataattcagcatttaagtggttttaagtgctggagaaagatttggaatgcgtttttcaagggtgaccttggtggctcccttggccttccagggggcccacagtgacaggtccatttatcagtagatcgggattactaggtgtaatttattcccattaattgcctgtctctggaattctaccttttcattcacctcatcatctagggaagagactacctttttttttttcttttttaaatgccgagatttcttgttctccctagccatgatgcttgccctcacagagaaggagctgtcccatatgtgaaccaagtaattctgctgacagccgttccaagtcccaggatctcttttgattatttctgatgttttatttattctcttattatttctgcctagattggccagaaagagttagatttgaaggtcagctgcaaacatctcgtatttttaatcacaagttggccaattgggaggtttctaaccagttccttgaaataggtcaccagacacattgtacgaatcccagagtttaatgggccatctgttgggtcactctggtaattgttcctttttataaattccaatgtacccagttaagttgaagcaaaggttgttagactcttcatgtgctgaacagtgggaccctctcaactgaaacttgccctcagagagtttttgttgactccatttcttatgtatttcttcctcaatagtgagagtttggtttttttaattgcggaagttgacggtcatgcttgctgaagataattagaaaagtggggaagtagtactgcttgggattaggaaaaatgaggccaatcatttggctgtagcaatagtgggatttctttgcaaagaagctttggacaaggcgaagggagctgggtgtggtggctcacacctgtgatcccaacactttgggaggctgaggtaggagaatcacttgaagccaagacttggaaaccacagcgagaccctgtatctacaaaaaattttcaaaaaaattagccaggtgtgttggtgcgtgcacttgtagtcccaggtacttgcgaggttgaggtggacggatcacttgaccccagaagtttgttgcagtgagttgtgatgacgctgctgcactccagcctgagtgacagagtgagacactgtctcaaaaacagaaatttttttttaagtttaaaaaagccaaagggaaatgatggacaataaacttgctccatgcagctgggtttctctgtgactcttaggagaggacctcagaaaaggtatagtgtggagtagtctagagctgaagttataagcaaagcagtttgttagctcactgaaaacatctgaaatgtgaattttacttggtgtttctgattttctggtaagatctggaaagtgagagtcaaaacatggagttcaagtctgaagggcagtgagtgtgttgatggagaaccagactgaggcagatgtctttcagtatattatctgtgaaaaagagaaagacagctccgttctgggctggtttctcttctctctcaaagcgatgttatctagttgcatgacttgaaatatcctctgtatgcctctcttgttcctaactctgcttatccaactcttcagacttgtatttccaattacttttctgatatttccacctttatgtccaatagacatcactaatttaacatggtcaacaaagaattatgagcaatcccagcacttagggaggctgaagcagaaggattgcttgagcccaggagtttgagaccagcctgagcaacaaagcgagattctatctctacaaaaaataaagattagctgggcatggtggcatgtacctgtagtcccagctacagctagttccagctagtgcccgggtcatttccctttcctctccagccacactggcactttttaccttggacacgctgtttgttcatatcctagggtctttccacttgctcttccctctgcctggaacattcatgccttgtgtagctgattcctttatgatatttagtcatttagtcatatcatcttaaatgacttctttgcaaagaggccttccttgaccaaatcagttgaggctgatgtgggaggatcgtttgatcccaggaattggaagctgtagtgagctgaaaaacaaaacaaaaaccttgatgtgtgtctagggtaatgagctcatccttgtttcctgggactttcttggttttgacactgaagtctcacattctaggaaacctcttcttcccaggcaaaccaggatggctagtctccctatttatagtccttaaacctgtttctgtctcacttgaaattccttgggagaatcatctgtccagttgctcaagctaagcattcagcagttatccctgattcatctctttctaaacccatcagtaacatatttcttaaccacatctaatccatcagtatgcctagttggctctactaccaaaagtgtccaactctgtctgcttctctgcatctctgctgatcccaccttaatgcaagctggtttgatcttgagctgcgttatgtcatgagacagtgatgtggaacctgcaacctttcatgttgctcttaaagtccaaccccataccaggccctgcaagcttcctcacagccccacaccatctgtcttttcttttctgggtcatttccctttcccctccagccacactggcactctttaccttggacacgctgtttgctcatgtcccagagtctttccacttgctcttccctctgcctggaacattcatgctttgtgttactgattccttcatgacatttagtcatcttatcttaaatgactacttcacaaagaggccttccttgaccaaatcagtttaaagtagccagccagccagccactcttgatcatattactatattttaattttctgcatggcacttctagccatctgacgtttatcttgtttattgatttgcttgttctcactctcccctactagactgtaagcccctcaagagtgatggctttgattgctgtacccgccatcctttccccaggctttaggacagttcacagaacaagggccagaaaatattattaattgtagtaaagaataaatgtatcctaagccatttaattaaaactttgagatcttgaaagttttagcaagcaagaaccagtaagtggaaattaattgtaccatagctattattactaccacaaaaggtacagaatatcattgatattatcttcatttaataggttatactgattttatgttagctaaaattttaggtttatttacaaatgtattttcccataccctatttcttttttttttttttgagacggagtcccgctctttagcccaggccggattgcagtggcacaatctcggctcactgcaagctccgcctcccaggttcacgacattctcctgcctcagcctcccgagtagctgggactacaggcgcccgccaccacgcccggctaatttttttttttgtatttttagtagagacggggtttcaccgtgttagccaagatggtctcgatctcctgaccttgtgatccgcccgcctcggcctcccagagtgctgggatcctgtttcttttaagctggtaatttattgaatggttgaacttttctcctgcagcagcttttgagtttgtatccttagtatgaaagttcagtcattccatacatcagtctgtggggactaccgagtgccttggagccttccttccttactttgacctaagggactgtcttttggaacttgagtggttataaatctgcacatttcagtgtcgaaagtatttctaaaccagggtctcaaccttaggactctggcatttggggtcagataattttgttgtgaagggctgtggaattacatgttcagctgcatccccggcctctacccacgagatgccaatagcgcctcctcagttcagattgccgatatctccaaatgctgcttagtgtcactctggagggcagagtctcccctgttgaaatccactcttctaagcaatgaatactttttcttctatttcctttatactgagagataataatttttaaaaaatcagatagaaatctggctcagcttttttggtggggtgaatgtagcagatttttaaaagctattataaggaaagattgttcatcttccaccattactaagttataagaatctattttcaacttgtatgtttctataattccacagtacactttgtgttaggaaccctaaaatattctgggggaatttgttctttcagtgtttctatatttttcgcctgctcccatcaccatggagctaaacactttgagacatgttaagttaaaaacagtaatgacagaagaggaaaaaacattttgcttctgcattcttttttcctctcttctcttcctccttacctcagtcagccaaatagggtattagtttgaatgttttaattggatgtcaagataggaaaggcatgtttttcagagcttattttttcttaggaaatgctaacagtataatttgaacagacctgtgaattgatattctgagataaggtaaaatataccaggaatgtgtagggaaggagactttttccttggcctgaacccattttatagatttctgtgcttcagagatcccattgtattgtttaggtagggctactctacatcatatacaattctttttttttcatatagaaaacaaatatcagaatgtatgtaacctagtttttagtgtagaactgattgattcattgaataaatgcaattcttgtcagctttcttaaattgagaccttagcatagtgttttgtataaagtaactagagacagactatttttcagattgtggtttgtgtttgaaattcatgtcctcatccaggtacagactttgaactttggcctatctgaatggaatattccgttcagtcctttcaaatgtagcaagaatgaatataaaattagagaaaaaagttttctttcttaatatttacgacctgtagcatcttctgttagtttgtaggaacatggtactgatacgttatttctgttcagcaaaggtagtttagagatttttttctgtttaagatacagtatttttttttctgaacaaattaatgtcttgatattgaaccttggtttcactgtgctcaaaccttcaaatgttaatttaaggaagtttagattcctcatttctttttaaacagtattactgctttctttgcacacatgaagccatgatattgaatttaaaagcagatgaccttaaaatcgtgcaacttaaacaccacagacttaaaaataaaaaatataaagatttttaaagaagaaagttaaaaaaatgtatctgcttttctgatgtaggctggtgagaaaagatgttctttttctgttgctttcagtctttagctccctgtcagttctgccccactgtgaaaccgaagatgttctcagcattcttgagtaacacttcccacaggtgaccttctgtataaagagagcttgttgttgttgttgttaacttctatattgataagaaaaagataacagttcacaaattacaacatcctgtgatttgattcttcataaaattttttggtgaggttttgggaatttcattcttgttcccctgatctgctacacttgggctaccacactttttataatatttattgctataaacatagtttgggagcatttaggttgtttatagctccttgctatcctaaataatgctgtgatgaaccctttttttgcacagaattttgtcttttgaattgtttccttaaaaaatactcaggaataaaataactgggaaaaaaagtatgtaagcattttaaaggctctcgatacatattcctaatttaaaaaaaaaacaacaatttcactcttccagtagctaatgagcacattttataaaaattaatacctcttatttttcttaaagcatacttaagggccctacgattttcagattgtaaataagcattggcttcaactttaagtctccagctgcattagcccctaataagagagtcagactgttctttgaacctttgaagccaggcattgacttctcctctgtagctatgaaagtcctggatgacattttcttctaagagaaggctgtttcatctatactgaaaatctgttgtttattgtagtcaccttatcaatcattttagctagatcttctggataacttgctggtgagcttgcactttcatgttatggagacagcttccttcccgaaacctgatgaaccaatgtctgctggcttctaactcttcttctgagtttcttcacctctctcagccttcatagaattgaagagagttagggccttgctctggattaggctttggtttaagagaatgttgtggctgatttgatcttctttctctccagaacactaaaactttccatctcagcagtaaggctgttttgctttcttatcatttatgtgttcactgcagtagtacttttaattttcttcaaaaacttttcctttgcattcacaacttggctaactggtacaatcctagctttcagcctctcaactttcaaatgtcttcctcactaagcttaatcatttctagcttttgatttaaaatgagacacctgtgactcttcctttcactttcaagtttcgcttgaacttagaggccattctaatttcagtgttgtggtctcagagactagagagcccaaagagagggaggcagatggggaatggctggtgggtggagcagtcagaactcaaacgacatttgttgattgtttgacatttgttgattgattgccgtcttctgtgagtgcagtttgtggcattccccaaaagattagtagtaacatcaaagatcacagattagaaatcaccaaaacagatgtaataatatgacaaagtttgacatattgtgggaattaccaaaatgtgacacagagacaggaagtgagcacatgctgttggaaaaatagcactgacagacttgctcaatgcagggttgcctcacaccttcaatttgtaaaaaaaacacctgcaaagtgcaataaagtgaagtgccataaaatgaggtgtgcctgtattgtatttattgaacagaaacatttttcaaatgtttaaccaattttttcttttgtgaattgcctactgtttcagaaaaactctcaaaccgtgtctttcctctgctttcataccaccatgacaatcatcaacacagaaaacacttctgtgacaaaagctgtgggtttttttctccacatgccaaacagcgtacactggctggatgttctcaattcagttccaacactatccaccctaagatagtgtcagattccacaggttgggggctcagtccccaagactgccccttacatctttggacatcattggtaaatccaggcctccagacttctgactgaccaactttaagttggtgttcccacaaccccatgtttgggtttaattaatttgctggagcagcttacagaactcagggaaacatgtttactgatttatttaaaaggatattacaaaggattcagatgaagcgttgtgtagggcaaggtatcagggaaggagcacggagcttccgtgccctcctttggcgtgccaccttccaagaacttctacatgttcacctctccagaagctcttcaaacctggtcctttgggtttttatacaaggaggttttattacatggcctggttgacaaccgtgtagaaatgtgattggacaaaaagcacattatctaaatccagcaaggcctgtctattcagacttttcttggcctttctgtgtagctttccttcccgtaggatatggagcaggactctctggaatgagtgtcttttgatccacaatcagattagagccctgccttgggcaggtgaaaggacaggaggtcagagagagagagattctgtttcctgaggcctaaagtaccccagcattataacaaggactgtgggagttaggagctaggaactgtggacaaaaaccaatatagctatcataacaccatacccattaatacttcttttcccatttttcttttggaatcttagtattttatcttccttcacaaatctttgcatatattcagtgtattcagtctgcgttgtatttatggtattttttaaactagtatttggtttgccttttaatgtacagatgtttaaaagtttcatgtacccaaatctgtcaatgttttcttttgtgatttctttcattagttttgctcatggaaaatgtttccccattagatatcacattttttccctgatattttattaatttcaaactaagtccttaccacccattaatttcataagaaaagaaatccactatttgagaattaggagcactttgctgctgatcatggttactacaggttgtatttttgtagttctctgcacaaaggggccacttgcactaattgttaacttttggctttgatgtggtacttgagatgtgagtgcctgtttaattctgtgttaatctgtggttctgttacatttggatcgttgcgaaagtaccttattgaatacaaatatgaaaatgaacaaagtaaaataaaattaaactagtcatgattgactcctatgtgagttcatactttaagaggcccagaaattgtgactcttttcagatgtaactgatataaaaaaacctaccttactttcctgtgatagttatggattgtagcattaggctcaagttgactgccaacatagtttatggtgataactgctatatttctaatttgtacaagttcaattttttagaaatatataaatccattgaagtgaaaatgcttccaatttgctggaaaatgaatattgctaacttacatcgtaggtaattattaagtgttggtttgtgatacttaaatcagttgtctcatgatttttacaccaaaaactcacttttagaagtaatattcttgttggcattccaggtgacataggtaaaaaaatattttattgaatttaaagcctaagtatgtagtgatactcttacatcatatgtttgtttattgtctgtctctcaaagtaaatataaacatttttagggcagtattttcagcatgtagaatgatgcctcaaatatttatggaataatggatatttgttgagtgaatatcagggcacggacttaaaattataggaaaaagaaatacttctgcttgagtacctagaatttaccagccattgtatgagatgtttggtgatctcatgactatatagagagcattgtttttctaaagatgaacctgggtttacctttgccattaattttctggataacatcaagagtgataggtttttaggagacagtaggaaactacagacagtggagagctccatcatgtttcaaggtagatttctctcctgggagaaggttactaaagagccttagctaaccactctctctgttttcacttggctgtaaccagaactgtaatcagaaatggcgtggaaggctggtgaaagccgtggttgctgttgaacgggcatatgtgcacttaggtagtttgctgatgtaggtttagtttgtgaatctagataatctgggagtctctttttaatttcctgaagcattttgtttttgtttttttagagacaggatttgctctgtcacccaggctgaagtacagtggcacagtcatggctcactatatactcaaacctccagggtcaaccaagtctcctacctgagcctcctaaatagctgagactacaggtgcacgccgctacacttggctaagtttcttattttttgtagagacacggtcttgctgtattgccaaggctgatctcaagctcctggcctcaagtgatcctcctgcattgacctcccaaaatgttgggattactggtgtaagccagggcacttggccttgccgaagcattttgatgcatgcaaactagcagcagatgtcaacattttcattttctactcaatcgtaatttcagctttacttttttttttttttttcttgagatggagtcacactcttatctcccaggctggagtgcagtggcgctatctcagctcattgcaacctccgcctccctggttcaagcgattctactacctcagcctcccgagtacctgggattacaggcatgcgccaccagacccagctaatttttgtatttttagtagagaggtggtttcgccatgttggccaggctggtcttgaactcctgacctcaggtgatctgcccgcctcggcctcccaaagtgctgagattatagtcttgaaccactgtgcccagcctcagctttactttttgtagagaaaggcatcaaaaggaagtttttccaacttttcttaataataggtactttttatagattttcccctgcccagtggcattggactctcccagaaaaattttatgccaggattgttgtaaaatattgtcaagcattcatgattttatcatttatggtggtaagggtctcatagagatgttatgtgaaacactgtaacattttctttacctgccaaataagtatagagtaataaaaagaacaattgtttttaaagccaaaagattttgacctggttcctgatttatcatgagtatgcttttaacctgatctatggttgtgaacagaataaaaacttttctgcattttttctacgaaattaaaatgtaattcttaaaatttccaaaagcatgttttctaactattgaaaaaataagtttattcccattcaaagtagaattatataaacttttttttttttgtataaagtttcacttcatgttactgaactggacttgacatggaaaacttgtccttgaataatcattgaaaaataggctgggggagtgagactttttcattaacacactaaatttatgctccatatgtaagatatttgtatattttttagtggactctgattattgtaactgaatttaaagatgcatcttaagaccctactgtaatctacctaccattaatgtgttcattcgtttcttcattctacttgcaaacttctgtttaaactttatctttgatcaaaatattgtctacttttagtaaaaattaaattgttaagtatttgtgaataaaattcatatttacctattcagatttacttgtgtcaggaatgcagtcatctgcaagcattagaaaacctctctagtagcataagcaaaaggaaattaattctcccacataaaaagtagccccagaaatcaacagtccagggctgttacacatgttcagtgatgccacaagagaccctggagctttttccttgattgtgttggtatctttcctcatgctagtcttatgaatgataagatggctgttgctcttctaggtaccatgtactccaggaggaagaagggggagtaagaaggtagcaggtaaaggctaggtgaatcagtccctttttatcaggaaagctaaagagtgttgcaggcttctgtttacttttcattagtcctgatttaggactaatctgttcctgactagttacccctaaaccagtccatggccacagggcaaaagagtccattagaaaatttagaaaattcctgatgtatcttctaggacacaccaaggtgtcccacacccacctgaacaacttgagaatctgttgttagtaaagaattgggagaacagtatgggttagttaatggactgtgtcttccatacctgctggagtgaggacagtatgtattagataaacttagaagccctgtgcattttgacttcttgattcttggtcttctggaataaattagggattttttttcaggttcttcagatattcttctgtagtcatacatatcctgtcattgtaggggatgatttagatattaggatagcaaatactgtgttttagagacttccttgttattaagtatatgatgaaatgggaattgagtcataacactctaaaattgaaatttgaaagctatttaatgaatttatgctttctaaaaagagttctttttagtagctctctagaagattaattttgttttatttgtaattaaaatggcttgaagattcattttcaaaaaacatgggcaatgatcatcatatatatacatttatattccactttttaggcttaccatatcataaaatttttcccatgtagtatagtactttaaaaattgctttggtgtcacaatgtacttaatcatttcccagttatacatttagttccattttgtgctgccattagcaatgctataattccatctttatataggttatttttaatgttgtatattactttctttagattcttcatattttaatgtcttttgaaacatttagctgatcgcaatccaatagcattgtacaatccaatagcattaattcgcagtgcccaccagcaagatataaaaataaaagtttttctgtcaatttccccagcattgattattggcaattaaaaatttttttgttaattaacaagtgaagaattactttgaatttcttttatggtagtaaggctaaatattttctttctttttgagatggagtttcattcactcttgttgcccaggctggagtgcaatggcatggtctcggctcactgcaaactcctcctcctgggttcaagccattctcctgcctcagcctcccaagtagctgggattacaggcatgtgccaccacgcccagctaattttgtatttttagtagagacggagtttcaccatgttggtcaggctggtctcaaattcctgatctcaggtgatctgcctgcctcagcctcccaaagtgctgggattactggcgtgagccaccatgcccggcccaggctaaatatttcctacttattttttttcctcttgtaaatggcattcttctgttcttgattagtctgttactttcttaagtaacacagtatattttttcacgttgtaaaatgatacattcttggtgtagaatatttgttagccatagacgtcacctcacaaagatctattaatattttttctgaacaatttgtgtaaacttttaatgtaagtaattatatattttattcataatatatatactatattgtctcaatctatgtgcctgatagtgcattagactcttggggatactatggtcagtataacaagtatcatatctatgacatcagaaaaaaaatgatacttttgtttatttttccctaatatttgtatcatttcattttaggacatagtaaattacccagtctttataataataataattttttgttgtttaaaataagtgtgtttatcaaaaatagaacccataagaaacttcatgtagaattttattattaaatgcttactttgtgtctgttaaatgatttttacacttttttcatgttttagttatatggattattaacagatttactaatattgcctaaaacttcatttgtgtacatcaataatgtatccaaagttgctattaaagtgttcagcacataataaatgctcaattaatagaatagctttttcagtaacttgcatgttaagattggcatcctatttaacccagaattcgttggataacctgctggtttttatttcatgttttgttatttgtatttttttccatgtgtatggaacatataatgtgtgacttcttaatttaatcaggaaattaaaatctcagctcactgcaacttccactcccgggttcaagcaattctcctgcctcagcctcccaagtagctgggattacaggcacctgccaccacacccggctaattttttgtatttttagtagaggtggggttttgccatgttggtgaggctggtcttgagctcctgacctcaagtgatccgcccgcctcggcttcccaaagtgctaggattacaggcgtggccccctttcttgctttattattgttcatagcactttgtagcatgtcaaaaaatgttgttatttatttgttgtctgcctgtttccctggactgtaactccatggaaggcaggcagggacttttgtcagtttgaccagtgctgtagtctgggtactaagaataatacctggcgtagagtagacatacaataaatatttgtctaattattgtgattcgtttcagttgatttctctttttatatctcagtttttgtcttgattttatttattactacttgacataaaatgtcatgttttagtacaaatacttcttttatcatagcatctagcttgatgtttttcttttaaacttgacaataatagtacctcctcgttttttttttttaacacgattttgttaaatatcttctttaaaattttttctgtcttcttttggtttgtacatcttggatttcgtattttctttcttaatacaaactgaggttcttttaataagttaaagtaatttgcttttgtttttgcacttatattactaaggtgttttttaaaactatgactccttaagaattacagtcagtgccttttgatttattggacatgacatttccttttatatcttcaaatgattttgagtgtaacatctgaactaagctacttctcatgacctatttatctcattgcttctgttctcaatcctattattattctgtactacctcacaatgcagtggatttcaattcattcctttctgctatagcacacactatcttctttactgaacttctgtctcctaggtttgtcctattttacctcagagtttcagctccactgttttctttgtgaaagttttcgtaactctccagcaatcttaggcagtggtcctgtgtattcttactgcactgtatgtatatttccaggcattttcttcttatactgcagtgtgctttccacagtcatacagaaagtggcatacagaaagtgctcagtagatattagttatgtttttttctcattttccttttttatttttaaaaaactggagtctcactctgttaggctgtagtgcagtggcacgaacacagctcactgcagcctccaccttctgtctcaagggatcctctcacctcaaattcccaagtagtagggactacaggcgtgtaccagcatgcctggccaatttttaaatttgtttttttgagatggagtcttgctatgttttctagattggtcttgaactcctgggctcaatcgatcctcttgcctcagcctcccaatgtgcttagattacaagcatgagctgcaatatctggcctcattttccttcttaatactattttcttttataacttaaagttatactctctatacttttcttgggtataatgtgcataaatgaatgtatttctgtgactttttttttctttttcttctttttttttttttaaacatacatggaggtctgcttttgtttcagcaggtactccatttagaaaaatgtgtagtcttcttcctcttccttgatgtcctgacttcttatcctcggcattttctttctttttttttttccgagacagagtctcactctgtcgcccaggctggagtgcagtggcacgatcttggctcactgcaacctctgcctcccaggggttcaggcaattctcctgcctcagcctcccaagtagctgggattacaggcatgtgccaccacgcctggctaatttttttggtatttttagtagagacgggattttaccatgttagccaggctggtctcgaactcctgaccttgtgatccgcccgccttggtctcccaaagtgctgggattggaggagtgagccaccacgcccggccatccttggcattttctttcttctttctttagctctttctccgcttagtgtagctgtcaacttaatagtaaaataagtactagttactttcacaggttcttatcgttacttttccatactttaattcctcacttaaaggtatgtttttggtcttttctcttcatccagtgaaccatgcctgctgtttctgtccctataaagagtacttggtttcacacgatcagattgacaaaaattttaagttggtgagaatgtggaatagaaaagtgtgtcctcttctgaagaacattggctcttttctatttgttaatattttcttcttttggagtttgtatttggaaattctcatttttatcctagtgtcttgtttttcatgtttatcctaatgtcttccattcacatgatctctccaacaattttcccttcattctgttgatcaatttttgtctgtcttatataacacaaccttttcagttgggtcaggtgttgtttttgttggttttcttcttagtaatttgctaggctctggagaccttgtcttacaggagacttttttgaagttattttccttatgtgctcttaattgcagagatactgaatttggttttgggaaggggtttggtaggcctgcctagagattttaccgaaggttccaccttccatgaattttgtaatcaagcaaaaattaattgcatttcaagaataattttgaaagtataatatcttttccacactaaagtcatgcagtaagaaatataataatataatctgtaacaaactccttgccatgtcctttagtgaaggtggtggattatatgcaatagtcatttgggttgtcaaatcctgtatcattgcataaataaatatccacatatggtaagatttactcctcctttaaatattctggccatgtttttataactttcttactgatctctcattacttttaataaaaattatggggtgtatgtaatttcctgtgtattacttccaaagtaattacagtttttggaaaactcctttatagaaaatatttataaaaaaaatccttccaaaaaattaactttctatttttccatattcctctgaagtccttgtgcttttgcatatataaatatgtgttcacagagtagaatgtaatatatttatttttaaatttaacattatatcttaaatttaggccatgttaactactagccaactcaataagacaacaaaagaaaaacattgtcattttgaaaatgacatgagtgtctaactagggaaattaaagagaatcatcaaaatattaactctaataagacttcagtaagattactagatatgaagtaaataaacaaaaaaacccaatagttttgtagtacaccagtaacggtatattagaaaatatgatcacatgaatgatcttagtcacaaaataaaataatttactttataataacctagcagaagatatgtaatggccttatgaattaaaagttattaaagcagatctaaataaataggagctgtatatgttactgagtgggaagtctcaatattaaaaataatttaaagttccctaaactaatttataaatttgtgcaattcaaaaacgaaacagcagaaccaagagtgtttggcatgaaacttgacagagtgattctaaaattagccgaggaagtagaattaatggggttagcaggatgtattataatgctgtggcatttgaattggtgtggcattagcacacggagagagaaatgcaccatcaaaacagaagagagaccacaaaaagagacctccacatgcacgggaacttgtttttgacattgtatacaagtcagtaattcaaaagtattgatggctatttaagaagtagtggtgggacagtatgataaaaatatattcctgtaaattctagatgaattaaagccatttaatcctattttaaaggaacatttctaaacttttagaagaaaatatgggaagacatctgtatgatattggtgattgggaggcctttagagcaaaacacccaattacaaatcttaccatgttaaaattttcaaatacagatatataaaaaatacactttaaacaaaagccaacacaaggtacagactctgcgaataaagtcagacgtatatgtctaatgaagggttaatatccatagtatataaaggaattctaccttatcagtaacagtgaagaaaaagacctattagaaaaatggacagaacataagtgggtaagatcagtaaacaaattaaaattctctaattatcagggaaagcctaatgaaagcaacaagataacactttatattcttatattagtcataatttaaaagcaaagctgtggcagcaagcagggccccccacacattactatgagttgtaaaattgttacaactttggagtgaagtttgactttctctaaggatgttgaaagatgctccaacttaaactttcagcagttcccattctagagctctctagagagacttttgcatgtttctaaagaagatgtgaaaggaaggttcctcctatcattgtttttaatagcaaaaaattggaaatctagacatcagtcaacaaattctggtgtatgcaaaaaatggaaaaacagaagccgtttataaaggatctataactttttgtagcaacgtggagaaatcttgatagtaatttttttttttaaagtgagggaaagtttatgtagaaagtaaaggaataaaagaatggctactccataggcagagcagcagcatgggctgctcaatggagcaaacttatagttatttcttgattatatactaaacaagggtcagattattcatgagttttctgggaatgaggtggacaatttccagaactgagggtacctcccctttttagaccatatagggcaacttccagatgttgccatggcatttgtaaactgcagtagtgctggaggaataaaagaatggctactccataggcagagcagcagcatgggctgctcaatggagcaaacttatagttatttcttgattatatactaaacaagggtcagattattcatgagttttctgggaatgaggtggacaatttccagaactgagggttcctcccctttttagaccatataggacaacttccagatgttgccatggcatttgtaaactgcagtagtgctggtgggaatgtcttttagcatgctaatgtattataattagcgtataacgagcagtgaagacaaccagaggtcactttgattgccatcttggttttggtggggtttggctggcttctttatcacaacctgttttatcagcaaggtcttaaagacttgtatcttgtgctgacctcccatctcatcttgtgacttagaatgcctaacctcctggaaatgcagcccataggtgtcagtctcattttacccagcctctatacaagatggagtcgctcaggtttgaacacctctgacatatttctctcctcccttttacaagggaacccttaatcctaagggttgtagagggacaaaaatccatcttttgtaacttcttcaggccgaataggtgtgatgatattcttgccaaactgttagggtgtcttgtatccagggaatagaggagctcagtcagaaagcatcagtatggtgagggccattcacaagcctgagttctgacaaaaggtggtatccagagttgaccaattggtgttgcactgtttcctctgggtcagaggtctccttagcatagttcctccttggttcgctaggaagatgttactggaaagaggtcccaatccagaccccaagagagggtccttggatcttgtgcaagaaagaattcgaggtgaatccgtaaagtgagagcaagtttattaagcaagtaaaggaatgaaagaggaatggctgctccatagacagagaagccaaatcctgataataattttgtgtgaaaaaagaaagttgcaaaaggatacattccaaatgataccatctatataaatttcataaacacacagtactattatgggtccatttccgttttgtaaaagtttaacaaaatgtgtgtcggaagaatgcatactgtccttaggaagacagttcctctggagaggccaggagaagcatgggatgggaagttgatattttagctatattcataatgtttctttcctttttgatgtgcagcaaacttgacagattaatagttattaaatctggatggctggtatgtttttgcatatgtcaaatattttataatcaatagttttcagttttatcgtgtagcagtttccagttaaatacgttgcattgaacatgtgtagttatttactttccctcatcaagccctatgccagtgttactcaaggaatataaaaaaaatgtatgaagacaggtaagggggaaagacataggagcagatttgaatgatcaacaccatttttgtcaccagagagaggggcatgaattttaatttaactaatttagtgacgtgaaaagagtgtcttgaatggctttactgagggattccaaaaaatgttgactctctgcaaccccaggattggagggtcccaagtagctgggaggattgcactaaggggtggaattagttttaagtagatacttggggtcctttccctaaccatagtgtaattatagaggctctggaaataggaattatttgaaacctttgttgctgagatttgttcccaggatgctggcagtcagacgggaagtggaaccattcttcttcagagacactgaaatgtatcctagaaatgaactacaaatatggcatttgtgggtcccccagtatagaaggggaaaccctctgtctgatttaagaaggaatggaatttatggtaataatatttagtagcttgtagaatcactggaaaggctgtagaactgggttcgaaaaataggaaaaacaagggaggccaggtagccaagacaacactcgttcccacaagtaggctggtgtggtgttgcccatgaacactggatgtctggcttgacattgccactgtcagtacttgcctgaggttgtcagtgtgcagcattggcactgcttctgccaccaccttccatgtaaatggattcgcctctttcctgctttctttagacactactgttgattcagagtccaggacatgcatgtctcattggctgaggggctgactgtgtgtctgcaccctgtctgtaagaacggctatgttaagtaacattgtggcatttttagcttctactatggaaggcagattttgtataacgaaaggagaggtgattccctggatgtagatacaaagtttagaggataagcagatgttaggaagtcatagtgttttcccctctatccagtttccccaggtaaaccaactagatctctacttagtccctttcatgaagtctacttagtagtcaacaagccgtgcctcacacagagcttcagtctactattttttttcttttttcttttttaaaatccatttatctttatttatttatttatttatttatttttgagatgaggtctcactctgtcacacaagttggagtgtagtggcatgatctcggttcactgcaacctccacctcacagcctaaagcagtcctcacacctcagcctctcaggtagctgcgaccacaggtgaacgccactacacctggctaaagttttgtagtgatagagttctgccatgttgcctaggctggtcttgaactcctgagctcaagagattcagccaccttggcctctcaaagagctgggattacaggtgtgagccactgtgcttggcccagtctgctattttaatgcctcaattttaaatacaaaaggatagccagttatagcagacatattagcaaaacttagcatgtaaaagacagtgatgaaaacaaaacagaagaaaagtaaatttggggaatataagatactgaagatgaaatggaaacataaaaaattagtttattagaaggacgagagaaaatactgcattcatgaaacaagaatagaatgattttttattttatttttttgagatggagtctcgctctatcacccaggctggggtgcagtggcaccatctcggctcactgtaacctctgcctcctgggttcaagcaattctccctgtctcagccacctgtaatcccaagtagctgggattacaggtgcgcaccaccacacccagccaatttttgtattttagtagaggcggggtttcaccctgttggccaggctggtctcgaactcctgacctcaggtgacccagctgtcttggccttccaaagtgctgggattataggcatggggcactgcacctggccagaatgatttttttaaacggaagaaacagagaacacaaaatttcttcaaaattgagcccaagaatcaatgtgaaagattaaataatctggttggaaaacgatgttttaaaaagtctctcaaatacctaagagaaaaagataaagaaatggagggtgcaggagaaaaaaataagaaagtgttcaggtggcccagtgtccaatgaatagaacatttacagaatgaaagaacaaagaatgggaaggaaaaggaattaatcaaagagtaataaaataaaattttactcaactgaaagttgtgaaggtccactgagtgtccagtacaaggaccataaaaagaacaacacaaagactactccagtattaaacagatgatcctaaaaaaaatccagaaaagagcatataacataaaaaaaactggaatcagactattttgggctgctcagttccaacagtaaaagctagaagttaatgaaataatacctttgtcttagtccattttctgttgcttacaacagaatacctgaaactggatggtttatttatttatttatttatttatttatttgagatggagtcttgctctgtcacccaggctggagtgcagtggcacaatctcggctcactacaagctccgcctcccgggttcacaccattctcctgcctcagcctccggagtagctgggactacaggcgcctgccaccatgcctggctcatttttttttttttttttgtatttttagtagagatggggtttcaccgtgttagccaggatggtcttgatctcctgacctcatgatccgctcgcttcagcctcccaaagtgctgggattacaggcgtgagccaccgtgcctggcctggatagtttatttttaaaaagaatttatttcacacagatggaggctgagatgtccaaggtccagctgctgctggtggggactctgcagcatcccgagaaggcgatggagggcatcacatgctgaggggctgagcctcctaacttgctagctcaggtctctcttcctcttcttataaagctaccagttctactcccatgatagcccattaatccattaacccattaatctgtgactggattaagcattcacaaggacagctctcataattcactcacctcttaaaggcctctcctctcaatactgccacactggggattaagtttcaacatgagtgttggagggtacaaatattcggaccatagcaaccttgaaaattctaatggcaaatgttttactacctgtcattttatgcccagccaaccatcagtcagtttaaagctaggcatgctaagactcaaagcttttaccacccatgcaccccttcttaggcagttactaaatgaagaaggtagtggtccatccaggtgagggagtgaattaagaaaagaagaaatgaaatctgggagacgtgggatccatccaggagagaaagaaaggaactgtcaggatggtgattggtgggatgttccccagaatacctcttcaggagacctagagatcagcagctagattggggcatgagaagagccctaggagagagttcttcagggaagagaaatggaattgataggaatctgttgtttttgactgtgtggaaagaataacaagatttttttgcttcttatgttgtatgtaggaaaaattaagcgtaggtatatagaaataaagcaaatgaaaataaatgaaactgttactaagttcgggaaaagtaaagtaagcaactgagcaaatatagccgtagtaacgtaaatcctaatatatatagctatgtgatataactaatatacacacatgtgaacataaataggtacatagaatggggtaaggaaatgggagagacacttaatggaagcatgctgatttctcatcttccacaacaggacttcaacatttactacgtaagattgacaaattaaaaagtagcaatatgagcgtgttatttaggaataaggaaatagtgagggaaacagtgctatgtattgaaagtggctgtggctgttcttgggactgaagaagatggagtcaagcagtatcggtttcccccactttatatgcctgtggtactatttgcctttaactactatgtatattactttgataaaaacataaacgaattaaaaataaaatagcattgcagtaagtatctttggacaattattacagattgtaaaatcacgtctcagtgtttgttttaccacctattttcctattcaaatgtggttgacatttatgattaagcctctgctaaggactaagtatcctaaaatcaaataagatgcagttcctggcctgaagcacttacatttcagtgggtggcgcatcagaaaactgagcattcacagtgtgtcctgtttgattgtcttttgggaaccaaggatgtggagaaagtttgggacctcaagagaaagagtggatgtctacagctgcacaaggaagggcaaaccagcagagctcctgggacctgctgaaggaggaaagatgcccgagagctgggcagaggaaaatccctcctgctttcaacaactatgcatttccaaatgtcgaaagagagattgcagagctcaacaacatgaatattttctggcttacctgccaatggtttttttctccccctaaaatgaaacaatatccattatctctagcgacatgtctattttaactttgtcactgttaacagtggttactggtattccagtactttttcctaatgtgtatagtgttgttttgatttgtatgcctttgatgcttattatactcagaacagtagatgggccttttcttgtgcttgtgttctgtcaaagaatttttcttagttcaacatattctttctttaaaacttgttttaactgcagtgatgccagaaagtttcaaaaagacagttcctcactttttcttggcagcagttctggtgttagaaggtaataacacatagtgaaatcatgatttatttaaagtagaaattttgatttctacaacaaaaatcttgatttttaaccaccataaatttcctgtagtaatcccaagggatgctgtaaaaagaataaggtggggtaggggtgggagtggaaggggtggacaacttcctgaaagagaacataccccagtgcaatcttgaaggaggagtaagagttagaggagtaaagggtggataagaataaaacaggaggaggaaggaagagaattgaatggagttgtgttccagcaaaagttaccacttggcttcacctgaagtctcacgagaacccggtgcattcaagaaattttaactggtttcctttccctttgactggagctcagggttcagggagcatggtgggaagagtgtggagagattgggctgttaattagggagatttatcttgcacttaggaaattctgacattgcaaaaacagagaggctatctccttgaggatttaagcgaaggaggctaagactcgtgctaatatgcaccttataaacagtcttgaataggcaaagtgatcagtttttaaaataagcattattgcagacacacaagactatgttttaagatcaaacttacattctagttagaggatttattttactttgtcacaaaaatgaaaaggttggcaaaaaaaaaaaaagacttcctgccacaaggttttatctttgaacactttattggtttgcgttttgattaattttttttctagttaataagagtttaaatgatcaagttaatacatttgtgaggaaaatctcacttagaaatcagagatttttaagtttaggggattagattaaaaataattttatttgaaagttaggcataaaatgtatgtatatttgcatatgtgcatagtttttaaaaaaaactggaaggatgtggtatgcattaaagaaagatactttgtttgctcctgctttcatttctgttgacaagttgccagaattatttgtatagggcctctattttcggaaccatgatataaataaaggattcaaaatgtttccaatatgaagcatttcatccagcatttttacatcagctttgaatgggaggaggtcctttgctgcttgtgagcataagtggattctttggctcttaatcatccacccctttgcctttctttttctggctctgtaaatacttaagttgctgcggaactgactgtcccttgcactggatcctttctctcctctgcccttatcattcagtgtcttactgtctgtgcccccagcccacacacagtgcctggaagaatatgtatactatgatgagtgactatcattgggcttgggattgggacatgtagaagaagacgtatacttttcactttttctgtactatttcaattattaaaattttcagtaagcatataaccgggttcaaaaatgactgaaaaggggcaaaggagagacttgtgtggggagaaaaattatttgagggtaaaagataaaaattattttgaccatcattaatttgatggtaattgttttaaatttctggttttagttgtctctccctttaatgctgtattaaccacactgccttccattgtcctgtgagaatatgtttatttgctgggattttaaatagtcgattctattgtggattagtttatcttttagttacttcattgtgacagtgttttatccagttctgtgtcacttcttgttaatcttttaatagatttgctcctttttatgcctgtttttcatgctcctttgatgagtggattggggtgagaaggtcaaacccactattttttattcattactgttgtgaaggctcttcaagagagaaagatgaagctgaaacctttattaaattttgctaatgtggacttgtttttggcatttctccgtcaacacagatatgtgtgaaataaccatgattacgttttagattacaatagaagttctgataatttatcagttaatttccattctattttagctgaaagcacgtaacttttatttctagtgattacatttcaagggtactaagcttaggtgctttcaggataaggattggacagatcttttcctcaagagcctgaaagtctcactggggagagaaggctgaaccacaggtagactgaatcttgaaatttcagtaagtagcagaaagggaagcatttttagaaaggagggtgccctggtacaaggaacatggcttagggatcagactctcgagcagtgacccagtctcgtctaagctgctgggtcttcatgtacaaactgcagtagataatagctctttaaagattgctttagcgagttagtgagataatgagcagtgcctgatgcatacataactggttacaatggatggaaacagattattgaacaagcatgctctgaaaggacagcatggtgcaacaggcagggtaagagtaggggaatgaggaaatctggatgtaaacctggacttgacacttgctatttaatcctaggtggacttacagtttctggctactactggtggaaaatgatgggctcagacaaggtattctttataatttacagttttaaattgtcaatattgaattcttcatgcaggctgagtcacttggtagagctttatgaagagggcacagtggtttgtttagggcaagcctgtttccttctgttaatataagaaggaaacagtttgtgggcaggtgccagttactcttgaattccaggcctaaaatccaggcctaaataagaaaataatggcaggggccaggtgcagtagctcatgcctgtaatcccagactttgggaagccgaggcagctggatcacgaggtcaggagtttgagaccagcctggccaacatggtgaaaccccgtctctattaaaaatataaaaattagccaggtgtggtggcgggcacctgcagtcccagccactcgggtggctgaggcaggagaatcgcttgaacctgggaggcagaggttgcagtgagctgagatcatgctattgcactccagcctgggtgacagagcaaaaaaaaaaaaaaaagaagaaaaagaaaataatggcatggcagttgaggagccactgaaggttctcaaagtgacatgactaccatagcatttttaaaaagttaaagttaattatcaataaatactttttctctcactgtatccatatccacaggatatagaaattcatgcctgcgctggactgcagaagtggtacacaggctataagggagccttttttcttttatattttcaaagtagtttttctaccataaattttgtaaccactagcccagtattgagagagagcctgctatatagtgagcacttatttttttttttttttggagacaaatctcactccgttgcccaggctggagttcagtggtgcaatctcagcttactgcaacctccgcctcccatgttcaaatgattctcctgcctcaacctcccaagtagctgggattacaggcacatagcaccacacccagctaatttttgtattcttttagtagaggtggggtttcaccatgttggccaggctggtcttgaactcctgatctcaggtgatccgcctgccttggcctcccaaagtgctgggattacaggtgtgagccattgcgcccagctgcactttgtgttatacacaatttgcttaactttatggcttgttgggcatgcctttttttttttttttttttttgaaacggtcttgctctgtcacccaagctggagtgcagtggtccgatggcagctaattccagccccaaacctctgagctcaagcagccctgccacctcagcctcctgaatagctgggaccacaggcacacaccaccacgcctggctaattttttttattttttattttttctttctccgatacagagtcttgctctggcacccaggctggagtgcagtggtgcgatctcgcctcactgcagcctctgctgcccggattcatccagttctcctacctcagcctcccaagtacctcggattacaggcacacgctatcatgcctggctaatttttgtagttttagtagagacggggtttcaccatgtgggccaggctgatcttgaactcctgacctcatgatctgcccaccttggcctcccaaagtgctgggattacaggcgtgagccactgctcccggactttttattttttattttttagtagagacaaggtcttgctttgtttgaggtcttgctttgtttgagtccatgctggtctcagactcctgagctcaagtgatcctccctcctcagcctcccaaagtgctgggattacagttgtgagccgctgcacctggcctgaccactcctttacctctctatgctctttcttcattcgtaaaatggagatacagttaacccttgaataatgcagcgattgtggcaccaaaactcccaccctgaatgcagttgaatatttgagtataacttttgattcctccagaacttgactaatagcctactgtttaccaggagccttactgataacatgaacagtgaatgaacacatagtttgtatgttacatgtattatatagtgtgttcttacagtaagtaaactaatgaagagaaaatgttattaagaaaatcatcaggaagatacatttgcagtactttactgtatttgtcagtactgtaaatttacttcatctgtctgacgtggcaggcaactgcagctgcagacttcagtccatggtacagatcaaacaatccaactctttcttataaaatcctgactttgcttcttgggagcacttttaccatcactagtggcacttcatatgggtcccatggtgttatttggggttaacgtattttactaagcgtgaaaaatacaccagaaccacgagaggtcacttttttactctgacatgaagtttgtcagagagaggaactgctcacctggagaggattagtttttaatcagagaattgtaatacttgagctcaccgcaatagcagcaggatatggctatgaaattattttaggaatacagtatgtattacaattaattgtatgcagttatgattgaatattacgtctttacatttgtttacatttctctcagctgcagaccgcaccgtttatgatctttctgtgcataagttgtgatacattttagctccttaagtagatttatgtattttctatggtagtaaatgataaaatagactaatatcttacatgtattttctgcattcatgacattccttactttttactgatttttttttctatatttctaggctatgtagttttttcaaattgtcacagttctccaaaatattttttagtgtatttattgaaaaaaaatctacagataagtggccttccctgttcaaacctgtgttgttcaagggtcagctgtactcctggggtgctggtgaggactgaaggagaggaatgagcatgtgtgaggaaacgaaatgggtgacagagtcctgctgtcttagatcccttgagggagagaggttatgctcagagataacggtacagtcagacagacagaggaaccatatgcagtctgtatttaaggacatgctaaggcaatgtggagtaattttaatgtttttcttttacgttctaggttcttgggtggtatttcaaaatctgctaagggaaatatgcttactgttgatatcaatcatgattaataatagtttggatattatgttcacccattgttcttatgctcctttctacttttttcctcagctaaatttaaacgtgttttttcaagtgcagtttcttaaattctttttggaacataaatattcaaataagaaaactgcactatccttaataaagccatttgtggtgttccttcctactgagccccttcccgtttcctacatacttgtcttctttttccagttagataatagagacttgaggatagagatggcgccctgtgtcactgacagtgactgtctcaaatcgccaatgttagcagcctgaaaatttgtcttagagatgcagattctctgctgcgttttttacagagttcattatatgtggatcaaaggcaattttcatggcttatctaatgtaaatctgacttcatcgctttctcttctgccctcaaagaagaaaatcagtactaccaggttcttcttccccagtatgcgattccttgagccactgataccacgtagcactttagtaaagctctccagggtgttggtgtgagtccacatagagacattcttcagatttagcctcaatcctgcagaaggaggactgtgaaaaggacagaatatacgtaggaaagtagatgcttcccaggaaaggggaactaatgatggcaacctgtgctctgcgtaggtaccctcatctgattttcctaggtcactacagtcttgggaggggacaaggtgaaggctgctgggcacaagggaacttttatgtcaatattaaatataaggaaagcatctgtaaatgaggagatataagcaattgtgttaatcatctatgtgaaataattattcaaatcctataaatactgctaatcttataatctttagtactctctactttatacagccttctgtgatttcattttaattaggggatttagcacaagaacatcttacaggaaggacctgacatctgttggatttttactttttttggtgatttgaatggctggaggtttaacaaagtatagtatcttagaattagtatttaaacgtgtggtcatcatactgcattcccagatcatattttatatttttagcaacagaaagatggctttttttctcataagttttgtttctgattatgaaggtgacacatgttcatttcagaaaataaaaaatataaataaaaaaacagaaattactcataatcaaaagacaaacattgtcagtcctttggtgaactaactttgcccttttaatctgtctgcctgcctgcctgtctatctgtctatctataacatatcaaaatttgtaatgtattttcagttttttatcctgtattcttctgaaatatgggcctgtttgtccccagttatgttcaataggatgcatgatataaaatgtttgatttttttttttaagtgagtccatggtcaaatcagttaagaaatttcttagtttaataaaattagtggtggtagtggtggtgttttctgctttttaataaaaataatgggaactcactatgttacccaggctggtctcaaactcctgggcttaagaaaccctcccaccttagcctcccaaaatgttgggattacaggcgtgagccactgtggctgcagatttcttggaggctttaatagagcaacatatatcacgatgtcctaagcaaggtgatatatacagtgtattactgccttatttaattatagaatgctttttctgtgggtttcttgaatttgagcatagtttgggaaaaaggacaagcacttaccccgtgtgctggatacttactggttgtcccggggcatctatttctcacattcctctttccccagatatatttggtaataagttatttaataccagatttgatttgataatcagttgttcaatttacagtattgggtgaataagtttttttaatgtattttaaatgtatgacagttgtattttatcatacaattattatgataaaaacactcatttacttcttcggtctcatctggtctcttgctatcctgatggcaggcatggaaactctcaatgcccccaataagttagtgagcttttggtttgttttcctttaaagtgttattataacttatcacacctcaaacactattttcctctaataattctgtttcacttttacctttctacttactaccttttactccttttgcccttcctactttaagctgtcccaacttaggtctttgatattttattatgtgcttattgcatgagattagtcatatttaaatgtaagagataaacattgacatgtacttctgttctccttcattttgccagctgttgcatcaatttactacttaccaattattccaccatgggttgggtgcactggcttactcctgtaatctcagcactttggtaggatcccttgaacccaggagttaaagatcagcctgggcaacatagcaataccctgtttctacaaaaaattttaaaaattaaccaagcatggtgaggcatgcttgtagtcctagctactcaagaggccaaggtgggaggatcacttgagcctgggagttcaaggctgcagtgagccatgatcatacaaccaaacaccagcctgggtgacagagcaagaccctgtctcaaatagtaataataataatattattattccaccacgtaacttgttcccgcattctttatcattcttctgccctcaagctttctgccaaacttttgtgttctttccttcaccttcagctatacaaactatattcaagcttaacaaaaccttagaagcgtaactttcttcactgaacttttttagctacgagggtgagtgggagggaaatgtgattttcctttttgatccttcctgtgtccaaacaggcacattttaagttgctttcttatctctaaattcaaatacagctttatcatgttacatgttttgtatctataacttttctattcactttgttaattttaccaaaagtttttttgactcgactttgtttccatcagtgttgtctctttcagagagtgaacattaggagagcaggaactagatttatcaactgtttttctcaactcttcctgctttttgttgaagggagaatacagaaatgaaaggaggtagaaattccattctaaaaagttttacgctgattcataaatcttaaattatccatgacattgcactaagatgtgtttcaggctaacttgaaagagtgagccatcccttctgtctgagatgcaacttttatgtaatgtgagtggaattcaggaaagccaagaagggatgtaaagaaaatagtttgccttatttgattatcttagctcatctaatattcaagtactgtgaagttatatttctgtttttaaatagtgttttattacattctgaagtaagaatatttacaggcattctaagtctgtgtttacaagttcaaaaactatttctatttttttgttgtttgtttaagagcctgggtattaccatgttacctaggctggtctcaaattcttgggctcaagccatctgcctgccttggccttctaaagtgctgggattacaggcacaaggcactgtgctgggcctggaaattttcataaatacttctgaagtgtatatctctgaattattggggcatttgaatagttattcatcagcacagttccttctactgccctgaaacattgagagctggcgttgtattttaggctgtaccagttaaagaatctgagaagatctcattttggaatgtggaagtattttatgaggaacgctacatctttctggtgaccctaccatattgcactgtaattctttcacaacaggaactgtagtgttcccccaaccccacccccttcccacatcttcttcttgtaacctttaaactgctctttatgcccttggcacgatgttgtttctttcattctattccttgaattaggaatagaatgtgctcccttccttaccacttaatcatttcttgaaaaaaaatttttttcattattctgcttgttggttatttcattgtaaaataggtaaataaagaagatgtcaaatgagcacctacctctattttatctgaagtttagtggagaagatcatgaccagagatttggaggtaacagcatagagatgatatttaaagctgcaggcacctacagtatcaacagacagagtactggttgccatgcagatttccagccagtaacttaattattctgcctttgttcagctgcacagacaaatgtgagccagcccaatcaacactctgctttccacagtgatattattactccagtggacccatgcttctgtctcatcctaatacactcagtgctcacatgcatcctgatagaaataccttttatacccctttccagaaatatgaaaaatgtcaagagagataaaccatagacaccaccttttcaatggaccccaactaaagactgagtagtgggcaaaaagaggcaagagaaaatgaagaagcacatggttatcacagaggtccagaaaagagaggttcaggatggaggatgggttcaggagtacagatgcttcacagagccagaatgacaagggatttttggcaatcaagagatcccataagaggttctgctttcagcattctcagggacttgatattctaaatggctgacctactgtggtacaattagtcccagcaggagattgtaagctctgttattaaagagcttacaatcaaaatggaaagtgtataggaaggaggcatgacccatgcatcccccgtcatcttcttacttgtctgtgtctccctgctacacctggagctttccttgaaggagggactggtggatgtatggtccatgctctgaagacactacagaaacacagggggtgatttggatgagaggaggaagcatttcttctggaagaatggtgggttaggttgtgagagatcttgagtgatgaaaagactttcaactagttgaattgaactcattgaactaaactgtgggccctctagatggaattagtattctagctacctggatctaccatagacttagatagtatctagagctgtaaaattaaacatgtaataaggaaaatttttatatagcctgctctttcaacagatggaggtgacatgctgtgaattcgtattgctcttctgtttaattctattgctttttaccatattggtacttaggcaggtttgctgatatttaagagagttgctgatcattgtcaacataggtttgctgtttcagtcaaccctaaggaatagatgtgaaggtattattgatctgtcatcatatgatacacatcgatggacagcattatttttgactggtagtttaataagtgcaaagcatgtatatttccatatatgctagtcagtgcccaaagtttatattgtaccccaaaggggtttgatgctataaataagaatgagaaaagggagggagggagggagggagatggaaaatgagagggagaaaaaaaaaacatagaaaaggaaggtccttatgactgaaaaaaaatctgttatttaacataattgcccatctcgaacctcatcagtttttacaagccattaaaacgtggcttctctctctcccatgtgcttatttatattttgaaatgaaaagaaaacattgagtcgttgttatataatgtaatgggagtcttgaaatttcttttgaattggtaagaaatttttatatttaaaaataagattttataaactcattaaaaatattggaagtatatgagatggtttggaagagaaatactgatggtggagactgagcatttccaagtcagttttatttcttgtattttactgccagcttttagtttcctcctctaatggaaataacttcacatatcctgggaaagacagctgtgcagtaaagtattttctaaggcacatgaaatgtggcaagagtttttatcatggtgggattggtgtgttgtccttttagagaatgaatgtttggggaatgaaagatgatttatttggatttctgtgaggttgtgagaaatgttgaaagcatctaatttttataaaatctactttagaagtattatttatgctatgtagagtattcattgaaataatcagcttttggggagatgttgaacaggtgtttgcattttggttcagttgttcaattttccttccattttatgagaatcacttcttgaacctttgctatggccatatatgctgtcctttgatatcctcggaagcaacagttagcatgttttgtcacttgaagggttatcattgaaagaggaacatgtaaagttctggaatgtaaagggaataatagcagtctgacagtagaagtatctagaaagctcaaaagccatgtttaattaggtagcagtgcaaaactattatcccttttacaaaagatggtgaagaggagtgctagtgaaaacaaatggcatttatctgaatggctccacagactcagccagcacgagcccagccagagctcgcctcaccctgcattctgcaggcagcatgcattttttttttttttttttgaaacacccctacatgttccagcctttaaatagcagcgagtcttctaaagtgatgctgtgtgctgcaagagaaatgaaagcgcctgccttggaggcaggaagccgactagggagatgcttaattatcgtggaagtaggtgcttgttaccattgagtggagagtgcagcaagtgcaggtcgtcctccggtgtcagagccgtgatttgtagacaatgccgccctgtcagctcagtgctggttcagcagcatctttccaaacatgtatttggcaagaatttaaaggccacctcttgtgtaatttgtggagtcttggaaaaggagcctctgcctttcttttcagaatgtacgcaaccatgcagaattttgtactcagaatctgtgtctcctgccttctgcctgacgtgctcatgaggaagtttgtttccatgcccgtcacctggaaggatgctaacagttctctgtaatctgttggggatatggagagggccacccagagctgtgttttgtttctgccgtcttcataaattagcactgatggggtggagtaggttgtactgcatgaggaaatgcaggcattttgttcattagtgagatacttctagcttttaagagtacaagaaactaaggagagcttgggaagaggtggtggtgaatgctggattcattctgcaatatcctcgtctcggtaagtaataaagtagaggaaaatacaaaagagtgctaatggatataatggctctgggaaaactctttttatttattttttcctgctgtatttgtttttgccaactatgttaagcctttgtaaggaaacaaaaaacatgtattgattttggaatagaggagttaaaaagtgattgttgcagcatattcagtaaagtcatttttcagtttttacttttgtcaaaaaactctgttgctctaattatcttattcacttggttacatctcaaacttctggtcatcacagtagctcatgatgttctacatttttagaggtcattggagcaaaagtctgtactttgggtaggagccatgatatccagaacaagatgtacccctccccctgccccccattttatgaaacagttcaattaagatgaagtcttaatagtttttttttttagaatataaattatggattttatcaaatggtttttactttcttcctttctttcaaacctgctttactaaaaatacggattgtggaactgtgaatcctaatccattattgagtcttttatcttcatgtgtctggttttgacaattgcatgtttgtttttagatgtatttatctgctaattcaaattatccttttctcttttagagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaagggtaagtagagatcctttatttcttacattttcttttgcagtactttctgaagaaaagtactgtatattaagatatttattaacaatgtgacataagatttgcatgtcttatctttcttgatggtaaaatagctaaataaccatttgctcaatttatttctttttgcattttttgagttactttctcctttcagatatataaatgtcttgtatgttaaatagtacttttacaaataaaaagcccctttgacttagcgattgaaattatagtctttgttgtacagtagatttgctgtgtcacctttagggataaatataccaagttgaaaatatttgaaatatagctgttgtttaaggattgcaaaacagttttaatgctactttcattttttatcacttccacagtaagtacaggaatcatttctttgctgcttcaatgttgtcatcagtaggtggtaattataatatattcctgtccatttacaggaagtattgtgaaaacaaattacattatttgacaaaagtcacagagccaataagtctcagtgccaagaatcaaatctcggtctttgagtagaaaaggcactgaagagagaagtacctttgacataagggccacttcctttctaatcttttctttgagtgggagagtaaaaaaaaaaaaaaaaaaaaaaaatatatatatatatatatatatatatatatatgtacacacacacacatatatacacacatatatacacacatatatatttgagattatacacagttttatctcatacttttaagaaagaccattgtgatttaccgaaaagtaagtagtataagtgaacccttacaagctttttgagcagcgttaattaaggaatgagtttaagtcatccaggtagacaaacgaggaaacaggatgcttacccacgaaggacatacctctgtgttccattagctagattggtcatctctgtagccaagtgaagaggcctgtggcgagaggctccctgtctgcaagctattctcacagtgttttgatttccactgttttggggttttgaatggtatttaaaattatttaaaattattgaatggtatttaaaattatgagtgaagtttagtttcaaatatagtactcatagctttataacaattgctttagaataaagcatatcttaatattactacatgataggtcccattccagaaggcttgttgacggaaacaatcttgtctcgtgactaaacatccatgtctcattcctacatatctatagcgtgggtcttggaatcaatatgtattgcataccctgatgtcatttttaaacatttatcttctcagaataattttctgaagtttatattttagaaattacatctctgttacactgtcctttaaggtacaaggtttctcattcttgccaacttggcatttgggggtgcgatgattctttgttggggtagcgtggagtagggggctgtcctgtgtattgtaggatgtaggatgcttagcagcatccctggcttccacactattaatgccagtaggttttcctcctccctctagttgtgacagcctaaaatgtcttcaggcattgccaaatgtctcttaagaggtaaactaacccctagctgagaacccctgctttactgtacctgtgcaaattttctgcaggtgtgtctgagctgtcgataggtggaggcaaaatggcctccacccaaaactgacactgaaacatattagttataatctaatttatgtaataatgggtacttttttcctattaggcagtataataatattattataataatgaacattttgggtacttactgtgtaccaggcactgtactaggcatttgctatgccacattttctcatttcaatctcttgatgcccaggaaggtaggtactattgttaaccttattttccagttgagaaaactggagcttaagtgataagactctcatggagctagtaaatgttggagccaggctgtctgaacagagtcatgttcttaatcactgttctctgatctctgctaggttaaagagatggagaatcttaaagtattttatctttcaaaagtctggaataaaaatgtgaatgcctagattccagattaatcctgtttgttcataataacctcataaatctaatacccactaatccagtagttactaacttgaagcatggaaaatacccttttacccagcataattggaactagtgaattgaaaatatcaactcaagcagggaattgttaaaaagtatacattcaaactgttttattatcattaacacatataagaatatgtttgccaaactcttgtgagaccaagggcttttctttgacaatgattctactcttttaaattcttaattgtgttaataggctaaaccataagaataaaaacatagagactaacaacataatctgagtacaaaatcttagatttcataaattttttctcattttttcatagctgtcctgcccacatttaatccaacagctttctttttaatgacttgcctttattaagtttgtataaagccttagtttttaataggaacaacgtttatcttttgtactcatatttcatcagctttcatgattaaatttcataattaaaatagcaagtcaattggtataaacagctcactctttgtcagcatgaggtccagctggcaggaacagaaagtatgtatggcacctagggatcacccactagactgctagtgccattgggtatttgtcagcatggtttgcagggaaattatgagcagtggttaatccaggaagttgttcagtggaagtcagttacacagagtggttactgtaagagcttttcttgggccacacaactttcaagtcagacaggcaatttgttacagtatgataatataccacaaatagtggctctggataacaaaatttggagcagaaattaagctctgtaaagtataaactgtacattttaaaaattgttgtttatacttttatatagtataaaacatatctaaacaaacaactctgtcttataatagacaactttgattcactgaaattagcagactaactcatttttcctaatcagaaccttaaagcaagtcttcttgttgaaggagtacatcagtgtcagatgtaatttatcctctagcaccaaggtgtggcagagctgacctggctgtcactcagccgcttatcaccgggtagtttccatttggctgcctaatgcattcctgacttcactgtggctaagtctcaggtggggagggggtggagggggagtactttactaaagtatgctatacagctgatattatatgtaaaaatcatatttggctgatgaagctataatcactttattattatgttgtttttataaacattattttacaaatttagacttcagaggctattttagtccaacatagaagccaggtccattgctggaaaaatactggatcagtagaggaatcccattgtttgtatttagtaaaataagcaacatgccattgatgcttttctttccagtcctttctcatgcccacttctctttgccattttgctagtgagtgtatgtttatattgagaaccaggattaaatgacagtaataatatagctaacatgcatcatgttacttctttgtactttattgagttcctcacttaatgcccattggacattaaggtggatctgtactggtgatagaagtccaagtgatagccacatcctccttatggaggcacagactaggcagtagggctgcattcagattaacctgaattacttatcttcctttgagtatgtatgtgttttgtgttatttatttatttatttatttatttatttatttatttattgagacagagtctcactctctcacctacgctggagttcagtggcacgatctccgctcactgcaatctttgcctcctggattcaagcgattctcgtgcctcagcctcccaggtagctgggattacaggtgtgcagcactgtgccaagctaatttttgtatttttagtagagatggggtttcaccacgttggcaaggctggtctcaaactcctggccttaagtgatctgcctgccttggcctcccaaagtgcggtattacaagcgtgagccaccgtacctggccttttgttttcatttagatagtcaccatgatcagagtactaaggaaatttataagtggaaaatactaagttatagaataattataatgttgcctatatcctgcatagcttgttgaggaggagaccctttccaagccattactcatcttggtttctgtggccccacaggacttcttcaattttgcaccgagtgtataattgtctatgaagtgtgttctccttgaatcctatagagaggaatgcattaatgaagacagaggagcccatgggctcttggcagtggcatttgttgctccactgatcaacagtgttgataggcttgtcttcatggtaggtggagtgttactctcaaagtcaagttactgaagatgctgtgatagggaagggcctccctctactgcacactgcccaggagaaacacagtatctggtctgaagcgcatctaagagtattttcccattccttaaaagagggacgactaatgcttatgcacctaaatattctttggataactgtaagccaccagatttgattgttcttactgttcaccttccttctcctcctcctccattccaaaacacatacaaatcaggttgaacagtgattgaggagacaaagcacatttcagttgctgttttctgtctttacctctcaccctcttgtaatcagccatctttaacatagtttctttagaataccacacttatcttgatttgtactaaagttacagctttagcactctcatatactctcaattttgctatcaagagctgtttttcaagttccagtctgtcaaataagcatcattaaatagctgttataaattttagtggattattttttagtgcatatagaacatcagggaatatgattagctaaatatatttctaaaattgtgtgcttattttgtttattcagttttttttgctttttaaaaaatccttctgctatgtaaatattaggcttgagaaaagtaccatagaatgccttacaattcagtgttctttaaatataattattctacttctagttttttgatgtggacagttttagatttcagataaatggtaaactccaaggtcaatgagtctgttctgctgaaccatgttgtgttctacgctgttgaatttagcagttattttctgccaaaatgaattgaatggtgaaagtttttatacatatataataattgttttaatgcccttgcctttcatgtttttattgaagtatttttcaatgtagtttcatttttaaacactctatttatatataatctatgtaattcattcgaaggtagctctctatgtattccctcacagggagatttgaggcactaaatgccttcctgagaagctaagctaggagtgtgttttgctgctgtccttttatctgctcagggcttccagaagcaagaaagctagtagtaggtattgtggttttgtgtgtttgctctttggaaagcagaggtcctctcttttcttcactgtgatctcaaagtcccagcgtggctcagctgcaagcgtggctcagctgcaccctgatctggaaggctttcacagtgcctgagcctctcaagccagaggtttttggaagctgcttaaaagggcgtgggcttcaactgctcctacatgtgttttattttaaaatcaagataggccatcaaagaccacactagttcaacacttgactttattaaaggtcatctttttaagagccagtcatataaaaacagagtttgttttgcagtaaagctggtgatgaagacattttcattgtgtcattcatcagcccctttagaaagttcacgtgaaaaatttattttagaatttgatgccagaagttgaaaccggtagctaccaaatgcctgcctttctgatgataggtattttgtgtgtgtgttttgtttcactgtatgtctagttttacttcaactcccagaaccaaatttgatgctcaactatacagctttgattattaacacatctgcttccactttcatcttttattttcctattctgtttcattagcatgatttatatatatcctgtatcattaatgacctcaattctttttggaaaaagatgattagcctacatttatatccaaataaaacgcctttgtccccaggctttctccttagttccggctgcatttctcaccagctgttaatctgcctctacccagatggctacctcattggcatctgtaacccatgtgcagagagatttggagttcaccattttttcccctcctcatcattgctctccttctgtaaattaaagcttctttgatgcctcctttatcttcattgtgttcaacctacgatctctagtctaccttcaaattgcaggtaacttctgttccttctgtcccattcccaattctttatgtaacttcagggcctcatgcttcttacccaaattctaggtttcttagtccctttatagtctaccctgctcaaaatctaaccttttgtctttgccagatagtcctttattcaatcatgtaacaaacatgtgggtcatctgagaggcagatgctgagactatacaggactgcaagtggttaggggcttggatgagagtaacttaggtctgtgaaagataatttcgcagagaaaggcttcagtccttcaaaggaaagaggagacaaaggaagattaggcagggagagcctcagaccgtgatgcaggtctgacaaagtgtcagtcaatgcaaagggtcaaaaatgagcattagagaagcattactagagcattactccttgttggggagtaatagccaggtcctgttaccccagcatgctcagctattgactaggggctgcccaggaggagtgtggcccagctcaaaaattgtagtagatttgaaggcactgcatccagagacttttaactaatcctatttcttgtgaccgaactggttgcaggttctttctagaagggaaatcagagtgttgcaccaacatacaaaaatgtattatccaatttactattgttaagagtaccttcattttttttaaagtagttttaaaaattaaaataactgcacatttattcactcatttgtccatttgttcagtcattcaaataatatttagcatctattttgtgccagatacagtgtctggaggagaacaaatagagatacacctctgccttcatggtatttatagcctccaattagtgcagttaagatgaatgggaagctattaaacagacgttttttaaaaagtcttctacaatctctttgcttcctttgttggaactctgttttgatgggtggtgaacccctggacttatcttccctttttttctcttttgtaatttcaatttctttttatttttgttctgtactcatcaatttcatcttatgacaagcagttgctatgtagttctgtacgttctatcagtcctttcagtgaattttatttttagcagtcatatttttaatcccccaataactcatattttttttgtttttagacagggtcttccactgtcacaggctggagtgcagtggcgtgattatggctcactgcagcctcaaagtcctgggctcaagggatcctcccatctcagcctcctcaacagctgggatcacaagcgtgcatcatcacgcctggctaatttttttagattttttttgtttgtttgtagagatgtggtgtcaccatgtcacccaggctggtctcaaactcctgggctcaagcaatcctcccacctcagcctcccaaagagctgagattatgtacgtgagccactgcacccgccttatagttatctttcataatcgttttttcttatataacctcccctcccatttctctattggtattaattaagatttttttctaagttctttttcttgagtaacctgtatcttcctgtttgtatattttacttttcttatttttcttgttttttcttcttcatgctgttagttgtccagtgatctttatcacatttatgaataaatgctgaggtggcttattgtaaatggcttgggttcccctgcagctccccagctgatctcttcttacataggagaagtagtgtaaccttgtataggaaggtgtccctgtggagtaaaggagcaatgatcaggctgcacgatagaaacccacatgtgtgtcaaaattagaagggttttatcatgttccactcttgcatggagctgagtttccttcccctgcctcagggtatacactggaataggttactcttcctttcctctcttgcctacctgacaggctcctgcctgtcctccagggttatgcaaccctctgaacccctctcctgcaaggtttagatgctctcccaccactgacctgacccaccctagcacctcttgttctgcatgatgatttctatgctgcattaattcacagccagcctaagcatgctttgaaggtaagggccacagaatagaaggtcaggttttacaaatgaatgaatgtttgttgctgaacaaggcctaaaatttattgagttgaggagccaatatgtcttgtattcatagcatcaggaagaaaaaggtagaggaagccgtctgtgtatatggccttgtgttatactccagacactgaataatatgttgcagttcctcttcctctcttttcaggaaatgacattacagacaggtctgtgtgtggtcatggtggttaccaagaccaccaattgatccccacaggcacaaaacgccatcacagagactgatttttactattgtaaactttactggacacaactgatggaagctaaaatcagtgaatgactgtttcaggagaaatgggaggagaagcaggatttgcatgatctccaggtatctcccttaagacattcgtaaactacaggaggaaagatagtaactttatggtggagaaacctggcagacacagccttacctaagtgaatcaaggttgttatgaacctcaggacgcactgagaaggacacatcatttctgtagtcctcttgcccaagaggcacaaccccagcccaatcacttgaaactatcagacaaacccaaattgagagataaatactcttcaaagctgtcaaggtcatggaagacaagtagactaaggaactcttagaatctataggggattaaaaagacataacaacaaaatgcaacatgggattctgaatgggattggggggattgcacatagtggaaacactggtgaaattcgaataagaactttagttaatggtattgcaccaatgttaatttcccagttttatttgtgagggaggatatccatcaccttgagtatcatttctatgtgttggggacatttcaaggcctctcttctagctattttgaaatatatcagtagatcgttgctaataactatagtcactctaatgtgctattgagcattagaacttttattgtctaactgtttgtactcattaaccaccctctcttcatcctcccccacttccacctacacacccttcctggtctctgatatctatcgttacactctctacctccatgaaatcaagtcttttagctcccacatgtgcctgaaaacatgcaatatttgtctttatgtgccttgcttatttcacttaacataatgatctgcagttccatccatccatgttgctgcaaatgacatgatttcattcttttttttttttttttttttgagatggagttttgcacttgtctcccaggctggagtgcaatggcacgatttcggctcaccacaacctctgcctcccaggttcaagtgattctcctgcctcagcctcccgagtagctgggattacaggcatgcgccaccatgcctggctaattttgtatttttagtagagacggggtttctccatgttgatcaggctggtctcaacatgatccaacctcaagtgatccacccgcctcggcctcgcaaagtgctgagattacaggcatgagccaccacgctgggcgatttcattctttttttttttttttttttaatcaccaaataatgttctgttgtgtatacataccacattttcatcattcattcattgatggacatgtaggttgattccatatctttgctattgcaaatagttttgcaataaacacgtgagtgtatgtatccttttgatatgttgatttattttcctttggataaatactcagtagtgattgctggactgtgtggtaattctgtttttagtttttttccatactgttttccatagtggctgtattaatccatcaacagtgtatgagttcccttttctctgcatcttcaccaacatctgttgtctttttgtctttttaataatacccattctaactgggataagatgattatctcattgtggttttgctttgcattcctctgataattagtgatgttgagcatttttttttatatacctattggccatatgtgtgtattcttttcagaaatgtttattcatacttgttttaataggattatttgttttttgtttttgttttactgttgagttccttgtgtattctggatattagtcccttgtcagatgaagaatttggaaatattttaccccattaaactcatggtttcttcactcttttgattctttcttatgctgtacaaaagctttttactttagtatagtcccatatgtctattcttgttttcgttgcctgtgcttttcaggtcttagccataaagtctttgcctaaaccaatgtcctggagcatttctcctttgccttcttctagtagccttatagtttcaggtcatatgtttattatgtctttaatccatcttcagttgattttgtatatagcgagagacaggattgtagaattttcccagcaccatttattgaagaggggaagagggtgtcctttccccattgtgtgttcttgacacctttgtcaaaaattagttggctgtaaatatatgaatttttctgtattctggattctgttccattggtctttgtgtctgtttttagaccaatgccatgctgttttgattactgtagcatcgtaatatgttttaaagtcaggtaatataatgtttccagcttcattctttttgctctggattgtttcgtctcttctgcctcttttttggttccatatgaattttaggatgttttttctatttctgcaaagaatgacattgatattttgaatgaggatttgcactgaatctgtaaaatgttgtcattttaatgataataattcttccaatcaatgggcatgggacatgtttgtgtattcttcaatttcgttcaacagtgtttcgtagttttccttatagagatcttttacaactttggtttaatttattcctaggtatttttcttttcttgttttttgtttttgtttttgtttctgttgtagatgggattgccttcttgatttctttctcaactaattcgttattggtgtaaaggaacactactgaattttatgttgatgttgattttgtataatgcaactttattgaatttaatgatccagatctaagatttttttggtgcagacttaagttttttctagatataagattatatcatcagcatagagggacggtttgacttcatcttttccgatttagatgccttttctttctttcttttacctgattgctctggcttgaacttccaatactgtattggagtggtgaaagtagacatccttgtcttgttccaattcttagaggaaaggatttcagcttttccccattcattgtgatgttagctgtgggttggtcatatatgccctttatgatgttgaggtctgtttcttctatgcctagtttgttgagagtttttatcatgaagggatgcaaaattttaccaaacaattttatgtgtattgggatggtcatatggtttttgtcctccattcagttgatgtgatatgtcatacttattgagttgcatattttgaaccatctttgcatctctgagataaatcccacttggttatggtgtattatttctttggtgtgttgttggattcagtttgttcatattttgttgaacatttttgcatgtatgttcatgtggaatactgacctgcagttttctttttttgttgtgtccttatctggttttggtatcagggtaatgctgacctcatagaatgagttaggtagaattccatcttcttcagttttttggaatactttgaggagaatttgtattctttataagtttgatagaattcaacagcaaagccattgggttctagactcttctttattgggagactttttattactgcatgatcttataacttgttattgttttcttcagattttctacgtcttctggatttgatcttgataggttgtatgtgtccaggaactcatccatttcctgtacgttttttagtttgttagtgcctctgatcttttgtatttttgtagttatcagttgtgatgtcttttttttcatttctgattttattttggtcttctccctttttttttcttggttatcctaccaagtggtttattgattgtatttgtcttttcaaaaaaaacaactttttattttgtagatttttttctattgtgtttttagtctctattttgtttaattcttctgtgatctgttatttctttccttctactaattttggatttggtttgttcttactcttctagtttcttgaggtacaccattagattgcttatttgaaatctttatttttgatgtgttgctcattgttataaaattatcacttaacactgtttttgccatatcccatcggttttgtacattgttttttggttttcatttgcttcaagaaatttcttcattttctttttagtttcttctttgacccagtggtcattcaggagcatattgtttaatttctatttatttttacagtttatagagtttctcttattattggtttctagttttatttcattgtggtctcaggagatacttgatattatttcaagttttaaagttttgttgagacttatttgggtcctaacatacagtctatcttggagaatgttctatgtgctgatgaaaagaatgtgtatgctgcagctactgaatgaaatatattctgtaaatgtctgttatatccatttggtctaatgtgtagcttaaattcagtgtttctttattgattttctgtctggatgatctgtctaaggatgagagtagggtattgaagtctctaactcaggagtccccaaccactggtctgtggcctgttaggaaccaggctgcgcagcaggaggtgagcagcaggtgagccagcattatcacctaagctctgcctctagtcagaacagcgtcggcattaaattctcataggagcgcaaatgaaccctactgtgaactgcacatgcgagggatctaggttgtgccctccttattagaatctaatgcctgtcccctgtccccaccatccatggaaaaattgtcttccatgaaacctgttcctggtgccaaaaaggttggggaccactgctctaactataatagtattggagtctttctctttaaatctaataatgttttgtttatgtatctgggtgctctggtggtgagtgcagatatgtttagaattgttacatctttttgctgagttgatctatcttatataatggccttcattgtctcttactttgtttgacttaaagtctgttttatctaagtctacctattcctgctcacttttggtttccatttccatggaataccttttttatcctattactgtagtttgtatgtttcttcagaggtaagatgagtttcttgtggatattatatagttggatcatatatatattttttttcaaatcagccgatctatatcttttctgtggaaaatgtaatctatttacattcaaggttattatttataggggggacatatttctgtcactttattaattgatttctagttattttatatatcggtttctttctcatgttatttaccactgtgatttggtggttttctttttttttctttcttttgagacagatgcttactctgttatttaggccagagtacagtggtgtgatcatggcctactgcagccttgaactcccaggctttaagtgatcctcccacctcagcctcctgaatatctaggactacaggcatgtgccaccatgccttactaattaaaaagaaatatagccgggcatagtggcccacgcctgtaatcccagcactttgggaggccgaggcgggtggatcacgaggtcaggagttcgagaccagcctggccaagatggtgagaccccatctctgctaaaaatacaaaaaaatcagccaggcacgtgcgtgtaatcccagctactcaggaggctgaggcaggagaatcacttgaacctgggaggtggaggttgcggtgagccgagattgcaccactgcactctagcctgggcaacagagcaagagcaagatatatataaatatatatatatttatatatctatatatatttatatatatttatatatagatatatttatatatatttatatatatataaatttttttttttttgagacaaagttttgctctctcaaccagactagagtgtagaggcctgatctcagctaactgcaacctcttgcctcccaggctcaagtgatcctcctgcctcagccccctgagtagctgggactatgggcacatgccaccacgcctggctcacttttatatttttttatagagatgaggtttcaccatgttgccctggctggtcttgaactcctgagctcaagccatctgctccagcctcccacagtgctagaacaatataggtttgagcaactgcacctggccttagctaatttttttaaaaatttgtttctagggatgaagtctcactatgttgcccaagctggtctcaaactactaggttcaagcattctttctgcctcaacctcccagagtgctgggattacaggtgggagccactgcacctggccaagtttggtggatttctggagtggtaacatttttgtgtgttttcatgttggtagtagttatcattctttcacttccagggctaggactcacttaagcatttttttttagcactgaatttaacactaaaaaaagatgagttatctcagcttttgcttgtcttggaaagactctttttccttcatttatgaaggataactgctgagtatagtagccttggctgacaggtttatttatttattttttttcttttttttccccagcacttctaatatatcttcccattctctactggcttataagttttctgcttagaatccactgttagtctgatgggggtccctttataagtgactacacacttttctcttgctatttttgtctttggcttttgatggtttgaccaaaatgtgctgtggagaagacccttttttattgtttctgtttggggatctgtaagcttcctgtatctggatatctaaatctcttgctagacttggaatgtttttatcttattatttcattaaatatattttctaaccctttgattttcttttcaccttctgggactctgaaaatttgaatatttgattgctttataatgtctcatgtcacataagctttgcatttttttattctttttttgcaatttttgactgactatgttatttcaaaagatctgtcgtcaagtactgaggttcttttttttctgcttaatctagtctattgttgttgctttcaaatgtattttgtatttcattcaatgaattcctcacttctaatatttctgtttgtttctttttataatttctatctctttggtaaatttctcattcatattctgatatatttgtgttgtttttcagtatttggttgtatttcactgagcttcattaatcaacattttgaattctttttctaggattttgtatatttctttttgtttgggatctgttgctggagacttaattctattccttttaagatgtcatatttcttagttttttcatggtttctatgtccttacattactatgtacacatctgatgtaacagttgcttcttgaagttttttgagtttactttcatggggacggactttttctgaaaatgtatctgtagtgctgattgggtagggcattttgactttgattctgggtgcatgtagtagtatagtctctgtataatgtctttgtctgtaaacagcataagttgtgtctgtgatttcctcaataacttagggtacagttgttaatggaggctctgctgaacttttgctggtgcctaggaggtgggccaatcgtcgagtccagtggtagcagtgttggactgagtctgtgtgtgtctgggcctcagggcagcaaacaccagcacttgtgccagcaggtcctggcaggttaattctggggctacaggtagcttgcttggataccagtaatgttggcagtgggctgtacagttgttggagtcctgggccctgggaagcaggcatgataggggtgatagcagtaacagtagtgggatgaccctctgagttctaagtggtgtgcactggtgttggccatggctatggtgggccgagaaagcttgacctctgcctccttgatggcacatgaaacactggctatggtgggcaggggctgagttatccccagacccctggaagattgctcaggtggggatggcagtggctgctctgtggctgtgctcctgggggtggcgggattgctttcagtagcagcagccacatgcagacgggtggaaaacatgcccttcccttgtgcttcagccgcggtgatggcagcccacaacaaaggcacctgcaggccgtgaagtctgtctgggcatgtgaaaatgggtgatcttcctctgctggaggaagggggtttgctgccaggtggcccatgcttcagccctggtggtagcagtttgctgtggcagtggctgcatataggggatgttggtggggttccaggaatgtggagatgcaagtgctgttgatccctagggcagggtgcagtctttttgggactaggctgtcaaaatggtgtcattatgcatgctgtagctgcgtaggactcaggagggtatgttggaccaattgtgggcttcgtcctgagcactgccctggcacggtttccaggcatctccttatgtttgtttcagggcctgcaagggtcatggggctcttccatagctaggattacaggagtgagtccacaatggaaatgtggctcgtgggggatctctcacttaccctgcactagggagtctctccacgctcccaaccggtcccaaccaagcaggttcaatttcctggttttgacaatgattattgtactgtatgtcgttatgtaagatgttagcactgggggagtctgggtgagcaatacggaaataacctgtactatttttgtaacttttctctgagtctaaaaggagtccagataaaaagttaaaactttttatttttttcaggcagaagaaaaaaataaaaacaaataaaaaccttcatatacagtcatatacatgcataaacacaggaaccatagaagatgtgacaccaaaagattggctagatgattgaagcttaaatagcacctccttcatagtgtagagggaattgggggatgtaggcaattgtgagggtagtaaatgattttcagggggaatgaatgagcccaaagaatagataatgtcctggaacaaagcttctccgagttccagggggaggtgacaggaaggtgaggggcagaacttcactatgaacaatggtggttttaatttgcagataaacttgcccaggtaatttccagggactgccctcggcataatagatgaaaagcctgcatggtgtggtgactattagtgttttctcttttaacgtttttgcaactgtgtttcaatatgcttggtgttttgctttgtatttttattccatgcactttaaaacattactctggccagggggcagtggcttactaataccaatgcttttggaggcaaggtgggagaactgcttgagcccaggagttcaagaccagcctgagcaacatagtgagacaccatcactacagaaaattggcctgtgatttcaagtggttaatctttcctggttatctgatgtgattcctagggagggagttttaagacagtgccacttcttttggtaagaagtttcctcagtcagataaggaaattccagagtccctccctttgctttcaggggagaaactagagaagatttagaaggtccttggttctgagacagcttctaagacttttcagtttctttaattaaaaagtgcccagcatgcaaaagcaccatactttggggtattgttatctgtgccccaacaccatccacataaaaagatcaaagtaactaccttgcttgctgatttccatattccagtgagtttctgtgctctttgtttggcattctcgaaacaaagggccttttagatctgttctttcagtacaagttgatgacacacataatcaaacttgccacctatttcccaaatgtatacctcattatatcttcagtgagaccctcattctgagccctgaaattaggtgctcaaaaaaaattttgctttattgcatcaattccttttccagtcttctaatggagctccctcctctgtatggtgagcccattaatgtgagcatcaaggcaatgagaggagacatcttcctatttgcattcaagtcaagtctgagagaagcatgagcagaagccatctctaggactcatgtgaacatttagtcaacaaagaggtagattttgctaagtgtttgggacactgcatggtccctgtccttgttagcggtagtgacttctgccttaactgaatttctggctacctgttagagacttccccctaaatccttcaatagccttttccataggaagacatcttgctgcaatatccctggtaaggaggtatgaagggtgctttaaatataaggaaattcatttacatacaagtgtttcattgtaatttctttcatttagatgttaattttttttcctaagctaatgtttgaattggtattaacattaaaaataaaaagttgcattaatatgcaacttttaaacatactctttatagtcattgaccatttgcaaaccaaatgcattttttatacttaaaaaaaagaaatcttctggccaggcacggtggctcatgtctgtagtcccagcactttgggaggccgaggcaggcagatcacgaggtcaggggttcgagaccagcctgaccaacgtggtgaaaccccgtctctactaaaaatacagaggtaagccgggcgtggtggtgcatgcctgtaatcccagctacttaggaggctgaagcagaggaattgcttgaacctgggagttggaggttgcagtgagccatcgtgccactgcattccagcctgggtgacaaagcgagactctgtctcaaaaaacaaaacaaaacaaaaacaaacaaaaaacttccaattataaaagttatatatgtatatcattatagaaaaaatagaaactatagaaaataaatttttgggaatgctattgattttatttctgccccatcagtcttaatacatgcatactcctttttaaaataaataaggagtcttaaatacagttgtatatttttgtcctgcttctatattgggccatgccatctcttatttaaagtttttcagctgttttttccaattcttgttataataaataatgcttacattagctggtcttaattttttgttgttgttgccccattgatcccaataacagtttagtgaagcctacgaactctccttggaataaatttttatttatttacctatttgagactgggtcttgctctgtcacccaggctggagtgtagtggcataatcacagctcactgccaccttgatctcctgggttcaagtgctcatcacacctcatcctcccaaatgactgggactacaggtgtgcaccactgtgcccagctaatattttatttatttatttatttatttatttatttatttatttatttattgagatggagtcttgctctgttgcccaggctggagtgcagtggggtgatctcagctcactgccacctccgcctcctgggttcaagtgattctcctgcctcagcctctcaagtagctgggattacaggtgcacaccaccatgcccagctagtttttgaatttttagtggagaaggggtttcaccatgttggccaggatggtctgcaactcctgacctcaagcaatccatccacctcggcctcccaaagtgttcggattacaggcatgagccaccgcgcctggccaattctttgtagtgatggtgtctcactgttgctcaggctggtcttgaactcctaggctcaagcagtcctcctaccttgaccttgattagtaagccacttcccctgcgccccccaccccaccctgccctgccagaataatattttaaagtgcatggagtaaaaatacaaagcaaaccaagcatatattgaagcacagttgcagaagtgttaaaattttgagatatagtaatggacgtgcttctttcttatttcatgaaaaaaagacctggcagcagctctgttaattaccatcatttcaaagtaggggtgagtgtagttaatattctgatatgtctgcaacaactttaatgtaatattaaactgtgatttctattggtgtcaaagtcacatgtacaactaatattgtttgttgtctgcatttataattgatgaaaacactaaatttcagttagaagttagtaaaaataaagatgcatttttttcagtcaagtttatagaccccctaatttctgttcctagccacagccttgtaatataagttttttccacatatctaattatttccataaggtggagccctgtaaatgaaatgtgagccttgatttttattgccaaattgctcttaagaaagcttagaccagaaagatccactggtgtgtttaagacttgtagtttaacattctcttaactactatgaatatttacagtttatatttttgaacatttattaaagaccaacaaaagacattttgtttctttgatcactagtgagtttcagtttttaaaaatataactattggccatttgtcatagactgatagcaaccaataaaaaatctctcatgattctgctaatcttcatcctctctttatttaaaaataatttttttatgtacagaaaagttggaatgtatgtccttttgttttaaatagggttttctttgtatttttttctttaatcatttagatgcaatttattaatatcaacataacttcatactaaagtttgccttttactgaaaaattagaggcctattaggtgctactttagatactgttttaaacccccaaattccatgtaatcttggcaaatacatcaccccactttttaagtgttacctatgggaagaagaaatggaatgtcagagtactatgcagtttgtaaatgtgagcaattactcttaggcaacagtaattataagcttagtgccatgctttgggacagaattctggcatgtggccagtcctgtttaaatgtccccatccattactctgacctgcttttgattatggtgcgaagtcctaggctgtttagttctcatggaacctccacccttaaaattaggatgagccctttgaggaccagaaactgagaatctgagtggtgcacttcccaggagagccattctttaaacagttggcctcttattatgtccactttggcagacctgtgtttccttttaacaagataataaatttctttatttttaacattgaattctccaatcctttagctctgtcctctctttcttagtcattagtcagattaagatgtaagaagttggacaaaaacaaaacctgaaaaatttgaacagtgagtttttttcctagttgttattttaatttaatttaatttaatttaatgttatgttatgttctaggatacatgtgcaggacgtgcaggtttgttacataggtgtacatgtgccatggtggtttgctgcatctatcaacctgtcatctaggttttaagccccatatgcattagatatttgtcctaatcctccccttgacccccaccccctgacaggccccagtgcgtgatattcccctccctgtgtccatgttctcattgttcacctcccacttatgagtaagaacatgcgatgtttggttttctgttactgtgttagtttgctgagaatgatggcttccagcttcatccatgtccctgcaaaggacatgactcactcttttttatgactacatagtattccatggtttatatgtgccacattttctttatccagtctatcagtgatgggcatttgggttggttccaagtctttgctattgtaaatactgctgcaataaacatatgtgtgcatgtgtatgtctaatgaaaatattaaactgatgaaaacattgagggtgaaattttatgttgttaactgtactgatggtggcacacatgtaaccaaccaagtcgactatttaaaaaaaaatagtttaaatgttaaaaatggtgaaataattttaatttaagctattgaagtgtcactgttccattctttgacctgctgatatatgatgaagcccaagtctgtctgcttattacttgtatatttagcatccccattatacattgacttatggtgtttttttcttgggaaaaatggaaaagattttatttttctttctgtatgatcaattagggtaattctaagatttggatgtgaacatttttgtgactttaacatatcttgccgtgttgctttcaaaagcagttgataccaatccacagtgccaccagcaatatatgaatatattacgtctctaccaagggctggttttttatttcagaaacattgttttttatattgggttaggcatgagatagtagctaagttttatttgctttgtgtttctttgattcatgtttatgatgtctattttttctattaaacaatttaaattaactattgtaaacatgtttcaagcaataaattataactttacagattacttgtaaaactatatttttactgttcataattacattcagttcagattatgctatagatgtcctcagggaagtatgcaactgaaatattaatacatagcctgcagataccatgataaccagtgcaagtgacaaaaaattgatagttaaagccctgtaactcttgtaattgtagtttcctttccccttcacaagtaaaacaccaagcttaactttctttgccttgtacacacatgcttatatatcttataatcaggtgattggactgtacctgatctaattactttgagctttgaactattcgctgtttcccctcactaagaatgtgaaatttttattataatcattattgtgaaagtatcaaccaaaaataaaactatttacctggaatattttaatgatgacataattatttattgttactctttgtaccatcctggttaaaactcaagaaccagaactaataagaaaacttcacactaaacatttaaatgtgaggaatggagtaggtggaaggaagtcaaccgtatatggatataatgttaatctctccccctttcaacaaaaccttagctaaacagcacatcaagaaataaagcattatgtctcgtctgactagataaatagtttattcctttaggaaccaagttttatttaatgatttttttattcataataaaattttagaaacttatgggaacataatattgtgtgtaatggctaagtaaatgagctgattaattaacattaaatcagcagttaatatgtttaaatctggtactgctatatactacttctgactaagtgacttatcttctttaaatcaaagttgccacatgtataaaaaagaaggaagtacctttttttttttttggttgatatgattattagagtacttggcaaaatgctttgctttgctgcattatatcattctaatatggtgattgctgtattggtttttggcatcccggtatgctggctctaaaatattctaatttctggtggtttaatacctgtatttcagttcatccatcagaagctttatccactctacttgagtttccaattcctcttcccttcccctgacttttctcatcctgaatttgctcatcgaagtcttccttgcctttctttgacacacttcatctgtaactccctcatccttactccccttccctgctaaacttttcacttcagaagaaagagaaagacagttgtggatttgactagaagaacactttgtaattatggatatcttcactagcaaacaatggaagtcgatggctgataggaaaacaaatttaaagtgctacatcacagagcaagtgtagacatactgcccggggactaggggcctgaaggaaggaggagactgcagtccagtatcttctagcttagatctcaaaattgtaggcatgtgtggtggctcatgtctgttatcctagcactttgggaagctgaggtgggaagatcacctgaggtcaggagtttgagaccagcctggccaatgtggtgaaacctctactaaaaaaaatagaaaaattagctaggcgtggtggcacgtgcctgtagtcccagctactcaggaggctgaggcaggagaattgcttgaacaattgaactccttttaacccaggaggcggaggttgcagtgggccaagatcatgccacggcactccagtctgggccacagagcaagacgctgtctccaaaaaaaaaaaaaacaaaaacctgaaaattgtgatgcatggtgatttgctgaatgaaatgctcctgtaccagagggttaaatttaaatagtacattaggattttgaatagaataaacttatgttcatatggaaagagttttttctatacttctgtaatccttaagagaaaaaaaagacagtggaccaaaacagagcttttattgtaaaaataattttttttcaagttcaaagactttttgaaaaagtagagtctggtgatgatagtggtgaatttagcatgggaaattggaccggagtctccatccataccaatggaaccgatactgatgaagactggctggaaaagctatttgggaaataatagcaagagctcttttttaatgaaaaaacttgacacaagttcaaaaatatcttcctagcgttatctaaccagagatgagtttgtttaaagctagagtatgaagaaagtgttggaatttagtttataattatcccatcaccattccccaaattcagaaatatacttcattagcagctgggaaaagttacaaaaaaatgtagtcaggttttgataatgacacaccaaaagtttgaattatcattaattttacagtttttattattaacaaagtaaccttattaacacaatttgtattttgtctaccagtaatactaaaatgattgtttaatatttttagtttataaatttatattttatttacatttttgtaatgtttctatttttgttcttgagatatattaaatatttggttttaataatttgtgttgttatgaattcataacactttaaaataaagttattggtatcaatatccaaagtaaacacttttattttcttccagtattcagtccctcttttcaaagatgtctatgtcatacttcggatgagacctaaaaattagaggacttagacaaataaagaggggttatggaaagaatgttctcagcagatttttttcagatgataaaagactgtgagtttgagcacctgaaagagaagtttagtatcattggttttcaaaatttaagagggtgaaaggtgtgagctgaggctggagtgattgacagtgacaggttatgagaacctttgggtaaccatgaaaagggtacaagaacctaagtgttttaagtttcgtagtagttggtcagatttgcattttagaagggtcatctggcagggtgaattaagttggataaaaacaaaccagttagaagactactacaaacactcaggcaagtgatgataggataaatcagtggcagtcggatgagaaaagatggatttgagagatgtccagaagctggaattcacagagtatggcagtgggcctggcatgagcaactgggtgaatgtggtagcagttgctgaaatagggactggacggggagctatataggtttctgtgggaaggtgataggttcacttttgcagatgtgcgtgggacaaacggttccattaggtaaatataaagagctcaggctttggcccggcacagtggctcaggcctgtaatcccagcactttgggaggccaaggcgggcagatcacttgaggtcaggagttcgagaccagcctgaccaaccatctctacaaaaaatataaaaaattagccgggcatgatggtgcacacctgtaatcccagctactctgaaggctgaggcaagagaatcgcttgaacccaggaggcagaggttgcagtgagccaagatcacaccactgcactccagtgtaggtgacagagtgagactctgtctcaaaacaaacacataaacaacaacaaaaccaaaaaaaggtctcaggcttagagatgtctggagaggacatgtagacctctgagagtcgtcaacattgaggtggcagttgaagttctgaaagcaggtggattattcagatgggaagagggaggaaaactgagctagaacagccagagcggtagaaggaaaatcagaagagggtgatgtcataggaacaaggaagtaagagtgtttctagaagacatgaagtgatcatctatgctagatgttatggagagtttgagccagggaaggaccaaaagtaccatttgttttaactttgagaaagtcattggtgacccatgcagtggaagtcagatgataattctgaagtgaggaattggacagctatttcaagaagtttccaatggaagaaaggaaagaggagataattctttagttctgacaggtcgtaaggagttgagaataaatgtgagtttacggtaattaaaggatgatgggaattagcaagtctagagggagaagttgaagataaaaaaagagggtcatcaaggtacctgagtccctaggaaggaggaatgggcaaatgggtgggggtggggctttggatcatacagaaaaagaagctagagtgtggatgctggtgaatttgtgtggatggtgattaggtttgcatctgaaatggcttctttatttcctttgtgttgtagacacattgtcatttgccaaaattgaggagaaggtagatgaggagtggttaccagagaatagagcatgtttgccacatctgccctggagaaacggagagagttgctgaccagggaaagcttgaggatgaggatgaattgaggttattggtgatgaatttatagtggccctatatctgggaatttctccagcagcagagaactgccatgccacctgcccattgtgagatatgtggggtgtacttgaggggttcctagaagttggtttttattagagtccatgaagtacgaggaccaggtaatgagtgtgactcacactctgatgcatctactgttgatctgtgctgcagcggtacaatatcctctgagggtatcaaagcatgttaagctctttgctccttcagtaaatggccccagactgctgtcttgtttctctttaagttcttgtctgcctttttgtactatttctgtctcctccctttctgttttcttccttgttgtcagttgttctatcacattgctgtctgcatgcaagtctgtatcagccctacaccctggactttgtcaacacctggaattatcacacctctgaaataaagctgtgagcttgaagaccagacaaccaagcttattagaattgtgtgcaaagtaagagtaaataatctgagtgtgtttctcatgtgctgtgctttgaggatatgcataagtgtctgtacatgaattttgtgacatttagtgggttatttcttatatatgagatgtttgttgcttgtattcccattgtgtttttcttcttttgaatttccatggcttatgataatagtcttagagagccctcaacatttatgattgtagcttttgtaattgtgctttagtacctgcaaagtattttcatatgcattacttaaattttaaactacatgattcgatatttatgctattttttcttattattctcatggattttcaaatacttatattttgtatggaaataacatgtattttcaaatgtgtatgcattttgtgtgataatgagatattatgtcacaatccagtcatttagccgtgtcagatataaatgaaatacaataatgtataaatgaaatacagtaatgtaaagtaagcattttggaggtttgaaaaacaaattatctgttccagtttttcatatattttcatgttttgtggacttcctcatctgtgaacatctcatgtatgtatcaacagtttaaatttttaaaagatgtatatgcacagtaaatatcacttttcaacattttctataaattaacttaattttgatccctatctttctttttgcaagagaaaggtaaattcagcgccagtcctttggaggcttgtgctaaggtttggggccttaggcaaaaggccagaacattgaagagaggccctaggctcatcggtcacctggacacacaagttacattagccctgcactgtgggataccgtgctatggcccagagccctgggtcctgcctccctggggcactgtgaagctctttcctctgagctcctactccaccatacacaggccacctgggagcagagtgctgcccagagactcgcagcacacatctctctctccaatccagggacatcttttttaatctggtggaatccccctttcttcaaactctgttctcaatatgtttagaatgtttttgaaaaacaaaaactaaaaagccctggcacaagccttctcttaggcaaggaagtgtgcacaaatgtagcctatttaaatggtgggagatagggagaaaatacaaatttattttgagaaatagtagagtagtaatctgtagagtagtaaaaaactcaacaggccacccgtgttcagtgttatcttctctggaactaaacctgtgtagccaagtctttgtttttataactaactgaagaatattaatatttgttaaatgtttacattttattgataaaatttctgagtgacaaccttaaatactgagcagaatgtaacattttcaaagtgttaggtagattttctaactttgttttgtcttattttacctaagaacactggaactattttggggctgatgagaatcttggtccagtggctgtgagcattcgaagggaaaaaccagatgaaatgaaagaaaatggatctccgtacaactaccgaataatttttagaactagtgaggtaagtcgcaaatgagagaggtttgaggtttaactgaaatggggaagaaagcaaatagtagcagtagcaaagcaattaaatttaatagcacatggttacagctgtctttggagtaagcaaagtcccctttcatttattctggtggagatcgaggtggacaagatggttagatctggacctcttcttttcatcagactctgaatagatgcagtctatgaatgaggagttttgattcagagaaagatatgtccattaagtgtggcccaaggaaattggagccctcagatccccactgggatattgtgtatcctgcttagggctactggaaagcgccaagccaacttgaggagccaggatattagatataagagaaggccactgaagacttaattcactcttccaagctcttgctgagctcatgtcttcgcccaagaagaaggagggaaagagattcttgacttcttccactatctttgggacccattgtctgagacctagaaggtacattctttgaaccaggggctatctaattgtaagtgaaacaggctgttagagctctttaggaatctaaatatacacaatgtatgagttttttattttaaaatgaagtttgggctaaaaaaaaaagacatggaaaaataaaaagaacccacacagcattttttttttaaaacacctatgaacaagtttgggactatgaggttctcctttttctttgtaaacttgtataattgggccacttatcgatttattgcctctcagttgctaattcactttaggatttttgttatgcattaatacttaatacccttgagtcatctagaaaataatggttttgaaactagtttaaatagggcatttggcttcatttcccccattgaatgcaaagcaagtttccggggttggcatcatttagtaatagttcctaagcctgaactccggggaaattaaatataggacttttaaagacaagacttaaatatctaatgtgttgtctacactggccagagagaaatgaactaacatactctcatgtgctttttctccatggcaaagctaatcattaagtggtgtaaattatttttttgagcacaaaggcacgaagaacgtcatgttctgtgttttggacttgtatgcaggtagttgctcctctctagcttcccagatcctaacagtttagtttgtttgtttgtttgtttttgagacagagtttcactcgttacccaggctagagtgcaatggcgcgatcttggctcaccgcaacctttgtctcctgggttcaagtgattctcctgcctcagcctcccgagtagctgggattacaggcatgcgccaccatgcccagctaattttgtatttttagtagagacgaggtttctccatgttggtctggctggtctcgaactcccgacctcaggtgatccacccgcctcggcctcccaaagtgctgggattacaggcgtgagccaccacacctggccgttcctaccagtttttagtgatactctcttatcttacttccaagtatttttgtctttcgcattctcttctttttcccttcccaaggccactctgatttaaatacccatcatattcttccttttctgtgttgtttttttgtccacctaaattcatttccttatcacttgttcatcctatccttcatgccagaggttaaagtttcctatgattctttctgagtcagatcctgtcactggtttccatgagcttcccttctcagcagatcctgtcactggtttccacgagcttcccttctcagcatgtcttgcaggctctccacatctgatcccagcccctgtctcctacctatctgtcctaaattctgctctggtctgtgaaccacaccaactcttacctttcccacctcttttctttctgctttactcccttgacccgaaatgttctacttgaattctgtagtcataagattctcttcttctccagctaagccatttgaataagctgtgtcccttgggtctgtttccttagcctttgactgaaaggttcaagtcaagtgttcaaaaaaaccattaccacttgttttttacgttcaaattaatgttcactttatgacaactctattactgtattttctcaggccagaaaccattaaagccacactttattcccatcttctccctcctgcccctgagatctggtctgtcagcaacacttgttcattttgtcttcacaatatgcccagagctcaactacttctcccaccctcactacccagtcctggtcctggtcttgctctgagaactgttctccctgcttctatgctgaagccctgcctccttttgacccaacagggttcctttgaaatgtcattccagatcttgccattgctcagttcgaaatccttgaaagcttcctcatctccctctgagaaacagccactgtctttgctagcctaggagaccatgctcttctgtttcccggttatctctctgcgcctcatccctgataactcctcctggctcagtcttttcctgccacactggcctccttcctacctgggccacctcaggacacctctgcctcagggctcagatgcccgtcattcctccccactgctgtgttctgcatcaggctgcctcatctccatttggcctttactcagaaaccacagaggccttccttgaccgctgaatctaaaatttctattcccctcccatttcatatccaattcagtgctttatttttcattaatacttaacactgtcttctctgttatacttagtcattttgtttgcttttaatctctcccactagaatgcaggccccaggagggtgggggcttctgtccgagttgttcagtacaacgtgcccgattcctcaaatggtgccttgcctccctgtttctcacttcccctccttgcctgtctccttccatccctttctccatgtctttcctccttttcctctcttcctttcttccttcctcccgctaatatttatgtaattaattgccactaggttttgtataatttttttctctctaataataaataatccataaatttgatttaatggtaatattgtattaagacttttgatagaaatgtttccagatattggttcctgtctgtagctcctgcactttgagagatagttccttcacttttttcactgaagcccatttacctattacaaatgaaacaagacttaatttgtatcagggacttctcatgttactaatttctcatgcagataagaaaaaagaaaacatgacagtgacactctagtggcttcagtaagcggcagcaagataacagaaatacaaacaaatctctttcattttagtataaataaacattgcaaaacataaaagaagatatatacctttgtaggcatggcagtttgtttatgagcaaaattttatggcatgtgagtgtttttaagcataggaacacgaggacttatgaggactccattcttatttctggaagtcattaagaaaaatatcagtaatactagtgattcggatgtaaaaaatgagccattctttttctcatctgctttggctttcatgagttagctgctttctatggctcaggatgcaatggcttgaatttggtcttggcttctaagttgagaacacccctagcctttgtggctccctatttcaagctatgtattatctcatgaagaaaacagtcaaataactgagttaacgattttccatgatttaaaaacaaaataaaaactatttgtgtcaaattatacattaataggaaaatgatttttacttgttatttgaaaagaaattgtttataatgaaagaaaaaaggtactcattctaactacattctctgcctccagttgcttcctctcacagttcatcttatttgcagcttaatttctgagtatacatcgtccccctacgaacacgtcctgtgctgacctgtaggagcccagtgaggcgtgtaccactcagtcagcttcagggtcttctgtgcacccccagctcacagctgcctcatccatttctccctgtactctccttgtgtccatctacaataatcactccttcccacttactcccttttttcccaatctccatacctttgctcatgttgtctcttgacattttctttttgtagaaattgttcctctatttcatggccatttcctaaaacccctcctttcagtggggcctttctttatgccctgagccactgtggtccattctctgcctttggactgtctgaggtcctgaccttgttatactttgttgggtatacttgtccttctgagattgcagtgtgtctttctgacctctcaccctcatatttgacaatcctcaacttgcactcctagcttttgtagctcctgttgctaaatggaaatgtattcagtttgatgggttttctcttctttccccatgcagcagttaaattaggttaacaaaactttgccttgtagacatttttggaaattaagactactttaggcttcatgtctggttaacttttctctgaaaacaacatcattacgtaggaaaatgtctttgcttaaggtattaatggagggtattttaagaagggaaggtattttaagaaataagagaaaatctaaagtaatttcagctgctattgcctgtgctgctgtactgatggtgataattgtccggtggcagcagcatttggtaatatgaatagtttatgcttgtcagccatgccttatgaagcttaaaactttatctccccctttttataattcaaagaagtataacatccaaattctaagtatttattcttcagacattgctctggggttctgccttcttaatttcctaattagtatgcatagtgacatggtatagccatatagagaccttgatctttactgatctctttaaggaaatgttattttttgtctttaaataaatatcctcagaagtcttgattatgtgctcctttggacccaccctggtcttgaaagcattggtttcatttttcatattacagtatcctacatcacttttctcattctttctccctcactggctttacccatcaaaaatcattccctagctctgtgaggagccccacagttcaggcctgcagtgcatgtacatgtgttcaggcatctcacatcccagaagcctcaccacagcacctgtctctcttgcagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaaggggtgagtttgcctttctgaggagagcattcttgctcaggtttattgctaggcttccggaatacagaccttaatgtttcttgttttgatggagataattgatactttttattgtgaaagacactctctttgcaattactcattttgttttttcttaactctgaactctgaacatttctcatctgatgaaattctgcatgtcagaatttataaataaggcactttaaactacgttaaattcttttgataatcttccatatgtacggtaagtttttcgagtgtccaagaataaataatagcagtaatcataataatgttgtgttaatgacaatacagtaataacagtaattaataataatgagcatatttgcaagccccttttctaagtgccttaaatatgttatctcatttaatctccctacactgtgagaaaggtactattattattcacattttagagagaaggattctgggacacagagagattaagtaataaatccaatttcacacagttagtaagttttggaaccagggtgcaaacatagtctgcctcaaagtctgtgccacttcaccgcgctgttcttaaaagcttagagtttcaaagtctattagtaccaccaaagatatattctagccaagatttttaaatataaaaatgtaaaatttcacattctgcttagagtaatttgagcatatgggccaattttatagataatatatttatatactcttactttaattctttcttttagcattttagccatattgcatcctagtagtgggtggtagtagttttaacattacatttaaaaattactccaaaaataaaattggttcaggtagtttatttattttttttccccattatgttcatttttcacagaagggtccagctattgaatgtcattttgtgaccagatttggataggatttccttaatcaaaaattcaaattttattaaaatgaatgagagtccaaaaaatcagttttaaggtatatttattgttttaattcagccactgagaatatataatgaagcaatagttagatgtctcttttctctcttctctttttttttttttttctggagacagtttcactctgtcacccaggcggagtgcagtggcgcaatctcagctcactgcaacctctgcctcccaggttcaagcgattctgttgcctcagcctctcgagtagctgggattacaggcatgcgccactgcgcctggccaggtgtctcttttctaatctttgcctttttctatccatttcacttttcataatgcacagctaatatctatttgacacatacatctgaagaatgctgtgagtatccatgttcataatgtgaaaatttgttgccctttgaattcttcaaaagactactgacatataaacgtaactattttggaggctgttttccagtaatattctgaacatttattctaacaaaggagtagaaaaatgatgtttaggtccaactttattgattcggtcatttctactactgtgtttatcaaggagaataaaaacatttagacattgataatatagtcatatacttaacatttgaaatttctattaaaacagattattttatgtaaaggagatagttattgccattttcttttgttttaactatattaaataaaaatggatactctacttgtagacattatggggatttctgacacattttatgtcctctgttagtgatgccaagtgctggatcacagacggtgctgatctgtgataaatattttatagtcctatccacatgggaaagataagaacactataaagagttgaactcaaagtttatttaattcacaaaactggccattattttgaaattatggccttcctattcttggaagcattaaaatgtcccttccttcataaattattaatcataatatatgatagttgttttctttaatatctttactaggcaaaattaaaatttggcaatcagtcagtctcttcaattttactttgaaagtaagtgccttaaatatgtcatcccgttcaacaggagtattactattagacagtagttttttactagacagtggaatctagaggttcaaagcatgctattctatatgaacagctccatgtctggactaaagagcaccgggggttagcctctgtcttttttttatctccatacatacagcattcaaagcctggattgtactgagataaagcagacgacatgcatacttaggcttttagtcttgggagtaatttttttggtaggaaatctcattaatgccttggaattattttgagaaactgattattttggtgcctttacaaatacagattttaaaaaggaaatgcttataagtgcagtggattatgcatatgaatcattgcaaagcatttttagtttccatctgtgtcgtcatattttaaaatttccagctttgtgtgtcgttatatttaaagagattcatagtgtgatacaaggaaactggactcatcagaaggagctttaaatctctttttatatttggtttaaatgattcttttaatatattttatgtttttattaactgtcttacataaccatgctttgtaaaagaagacacaatttatttcctatattgtggcattttgcctttcaaatctttggtgctttaattcctcattttaccactatcaaaagctaaagtgaacagaaaaattaaaattttatctattaaatataaaagaaagcactgcacaaaaatctaataatttttttatttaacttgacagtgatatatatgtgggagctgaagtatgcatttcaattcctgaagaaacttattttagaaaacgaactaatttttttagcttatccaagcttttacattctccatcctgatgcctttctgggactttcactactttttttttttttttttttttttttttttttttttttttttttgagacagggtctctgtttctgttacccaggctggagtgcagtggcgcgatctcggctcactgcagcctctgcctcccgggctcaagcagttcttccacctcagctgggattactgggatgcaccaccactcctggctaatttttgcatatttagtagaaatggggtttcatcacattggccagggtggtctcgaactcctgacatcaggtgatccaccctccttggcctcccaaagtgctggaattacagatgtgagccaccacgcccgcctttcactacttagtgatgcccatgtcagttgttaaaatggcaatgagaagacaaaactaacctcctaatattttcacaccaataagaatttataacacttgatgctttagaaaatttgtgttcttactgtcaggcaccttgatcttcacttacagtacagttgggggcatctcatgataaaaacaaatgaaataaatacatatttcattttactatgttctaatcactttactggcataatctgatttaatcctcacagcaaccctgtgcaatagattccaactattggcctattttacagtcaaggggattaaggcatacagaaattcccagagctgtttttcttacctgtcatcccttaatagccctgagcactggatataaatttgcataatacagctcttcaattttaagatttccaagatcccatttacatatctcgaattactttctttttaatttcttttttaaaaatctgtcatctttatttttttaatttctaactaggaattcagtgtagaatattggaatattctgatgcttaaaactatgctgtaggctgggtgatgtgattcacacctataatcccagcactttgggaagctgaggcaggaggattgcttgagcccaggagttcgagaccagcctgggcaacataatgagacccccgtctctaaaaaaataaataatttaaaaaactacactgtgaagtattaggaattttgttatttaatcaagtcagcttttaaataatgtagaaaattcagatacttttaaatttgccatatcagagccatttttcttcaacagtcatttaaaaatacctatatttcatctactctgtgcaaggggaatgaaagatgattatgtcaagccctggtttaaggcgttcccacatgtaaagcacttagtacagtgctgagcatgtgataaaacgttgaagaaataggagctgttgataataagataataacttgttagtagccctttacatacattatctcatttaatctttatacatatcctatgagagagcttctgttgtagttgatacattatgctcactttcacaagtaagcaggactgtttcaaatccaataaatgctttttaagtatgactctgcaggttgttaaatactgtagagaacaaaataggctagtaagacatagtccttatccatgaaggagacagggtcataaattactgtaatggatgtcagggttaatataataaatctaataagagaattgcaaacaaagagcatggaggtacaagccagtggggacaagtcataatggttaactggatcagaatgagatgggccttggaggggaagaagatttcatcaggccagggaataagcagttgggtggtccatactcagaacaataagaacgagactcggaaggacagaagcacacagtgcgttcatgaggcagcaaggaatcccgctgagcaggagtgtgaggcacatgtaagggagtaataaaagtagatgattttttttttgagacggagtctcactctgttgcccaggctggaatgcagtggtgcgatctcggctcactgcaagctccacctcccaggttcacgccattctcctgcctcagcctcccaagtagctgggactacaggcacccgccaccacgcccagctaaatttttgtatttttagtagagacggggttccaccgtgttagccaggataatctcgatctcctgacctcgtggtccgcctgcctcagcctcccaaagtgctgggattacaggcatgagccactgctcttggccaaaagtagatgatttttattgacagtgactaggccaggcactgtgtgaaacagtttccatgaattattttaattaatcctcagaatgctttgatactattattgttcctgttttatagctaagagcactgagacacaaagaccagtcacaattagagtctgtgcaggctggtcttgaatccaggcactcagactctagagcctgcattctcaaccagtacatcagccaccctgtcctcttttccctccccatgaatggaagaagaaactggaattatattgctgcagacttcagtgcccggtattcagtgtaatatgttaaacccaaataaaattggaatgggtctggtttataaatatttaaggtacagttgctagtttgcagtagagaaaattggtagttctgttttcattaggaaatgtcaggtttcatgtaaatggtagtgactttgcctaaatgaatcttcactgtttttctagattattaaaaatgcagtgaaatgaaaatatttattgagtttcaaattttaagaagttatccttcaggttattaaagtcagagtaagggagaaagtgatcatatttaatttaactctgcaataaatatctcaagaatggatataaggaaatgagcaatgtttatgtggtaatgaatagcactgaccctttgattaaggacatgaatgaaattctctgctgacttcgcctattcattgccttgctgcgttattttattgtgaggataaatgagtttgactagccattttctctttgattcaggcagctagttttgaaaaatgatccataggggaaatattttttccaaaactgattttctctaaatgaagctttggcagaacaattgccattcctagaattttaatcgtctcttagattatgatattagctaatgcatgtttagagttcagatggctaccaaattgattccagacaactggtggatccgtatgtacattttcaggaaggagatatccaccatggccatctagtcaggggaagaaatcagtggcatctgtagctttgtcttgtgtgttcacaagtagtgatcaccctgtgctggcctatcgctgttcttttgcctggctgaggctggattggatgacaggatagagtcccttccaatgagaagattttgtgattaatgggactgatagcattagcatttggaagacatgcggctgtggtaggactgcagtttgcagtgagagaacacagcaagactaagatcacacgtgaggacttggatcacgattcagaaggatgcaggaactggtggcaaacatttgtcttctggattttgaattgtggattgtgttttaaattcagctttaaaataaaagttaaaccaatttctttcctataggatttatctaaactaggcaatagtttcaaatggtcccaaaatcaaagcagtatgactatgtttacattcaggggttccatttctacctgttcctatgacccttttctcccctgccttgtagttaatcaccttattaactacaaggtgtagtatttctgtttcattatgcagtttctgtatttctgtttcattatgcagataccaccaaatatgcatatgcagctttatttcacccctttcttttatatattatatatatacatatatatatactttaagttctagggtacatgtgcacaacatgaaggtttgttacataggtatacatgtgccatgttggtttgctgcacctatcaacttgtcatttatactaggcatttctcccaatgctatccctcccccagccccccagcccctgacaggcctgtgtgtgatgttccccaccttgtgtccatgtgttctcattgttcagttcccacctatgagtgagaacatgcagtgtttggttttctgtccttgtgatagtttgctgagaattatggtttccagcttcatccatgtccctgaaaaggacatgaactcatccttttttatggctgcatagtattccatgcatttcacccctttcttatacaagatataacaggctgtagacacttgcttttttcatttaggaatatatttttgagatttttttcgtcagtacatagaaaggtttcccagtatttttactactgcatagtagcatagtattttgttgtactgctgtgccatagtttatttcatcagtttctctattgatgggcatgtatgtgtagatttaagtccttttctcttacaaacagtactgcaatgaagactttttctgtagaattgaaattcatctcaatgtcaaaaaaatcaggtacctttattatcaacttaatacccaatatgaaactttttatctttgtgagaaattttgcacaataacattattaggtaaaattattgtgtgtggattatttcctttacattatgccaaagataaaaataggttagaatatgtctgtgtacttatatataaataattttgaaagcatctgtcaggttttttctttttacaactttactatttagtatccatatgtcatttttttaaaacagttggatttttgttagtaattcccaatgaggatatacattttctaactggcattttttgctctcaatacggaatttttccagtttctttgtcattctttttggaggacagtatagaaatttatcttcaggaagtagttaagagagttatgtatatgaagaacaaatcaaagcaaataatgtgaattagaacaattttttttgttttattttaatgaccaaggtctttactttcagtaatggcaaagttgcttattgcagaccggcccatccattgagaataaccaggaaaattgaacaaaatatttttaaaactaagtttggactctggattctggaaagatggagtagatgtatttctctgcgttcttcctgctaggtacagccaacaaccttggacacatatataaaacaaacataaaatgaatctgaaaggtggagagaagcagcaggctggttagggaccttgagatctctggaatggcatagctgtgaggtccctgggttttctctttgctcatatatcccagtcttgggctgaagaagtcagcaaactggaaatgcctataggcacagccaaaatgtcccccaaatgtctgttctttttagcaaaaggaccaaaaaaaacaaacttagaaaactttaaaacaggaatctctctactccaactgcacagtacaaaaagaagctaacaacaacaacaacaaaaaacccacagccttccctcctccctaatccttgctgaggcattgttagagaaggctaagtgaggaactggaactttcatcacggtggagtggtaatgaagtgcccctccagctccccactgtgtggcatcagaagaggcctggtggagagtcaggacatttttgcacacccagcaataacggggtcttcttaccaaagtgtcagtgaaagccacgtggggagtagtaatcatgcatgcctgataccaaccagggcagtatcaggagagactcagcagggagctggaattgttgccactgcctagcaatacagaggtgttgctttcccttaggtgtcatggagggaacttgatgttcaaccccacctagcagtgtcattttttccataccagaatggtaataaagaaggcctgctaaatagaggatttaaataagatccagagtctcgtaagttaatatccaaaatgtccaaaattgaatttaaaatcactgcttataccaacaattgggaaaatctcaacttaagggaaaatttgatcaacacatgccaacactaagatgacacagttgttagaattatctaacaatgattttctgacagccatcatgaaaatgtttcaatgagcaattacaagcatgattgttatgttatgttatgttatgttatgttatgttatgttatgttatgttctgttctgttctgttctttggagatggggcctcactctgtcgccaggctgcagtgcagtggcttgatttcggctcactgcaacctccaccctccgggttcaagcgattctcttgcctcagcctcctgagtaatgtgtgtatttttagtatttttgtatttttattagagacgcccagctaatttttgtatttttagtagagacggggtttcaccatgttggctaggatggtctcgatctcttgacctcatgatcctcctgcctaggcttcccaaagtgctgggattacaggcgtgagccacagcacccagccacaagcatgatttttaaaaatgaaaaaatagaaagtcttagcaaaaaattgaaggtattaaggaacaaatggaaatgttagaactgaaaaatagaacagtcaaaatgtaaaactcagtagataggtttttaggatgctagtggaccctgaatatgggccattagcagtctaccaaaaattataaattctgaaatgtaaggtacttcaatgggctagacaccctagaagcccctgtccccagagacaaaatggaagggacagaggaaaaaatcagtgaacttgaagataaaacaaataggaatcaccaaatctgagcaacaaagagtagactgggggaaacaaatgaacagagcttcacggtttgtggggctataataaaatatttaacaattgtgtcttggaagaagaggagaaagatggcaggccttgaaaaagtattcaaagaaatatttggtaagaagtttcccaaatttggtcaaaggtgtaaacccacacatgacagaaactgagcaaatcccaaacagtataaatccaaagaagtccacagcaagagacatcatagtaaaatttttgaacactaaatacaaaaaaaaaaaaaacttgaaagaagcaaaagataaatgacatgttacctataagggaagaacggctgggcacggtggctcatgcctgtaatcccagcactttgggaggcagaggcaggtggatcacctgaggttgggagtttgagaccagactgcccaacatggcgaaaccctgtgtctactaaaaatacaaaaaatcagctgggcatggtggcgggcacctgtaatcccagctactcgggaggctgaggcaggagaattgcttgaacccaggagacggaggttgtagtgagccaagatcacgccactgcactccagcctgggtgacaagaacaaaactccatttcaaaaaaaaaaaaaaaacccacctataagggaagaacaatttgaatcacagattttttttttttatcagaaatcatggaggccagaaggaagtggcatgataatttttcaggagatggaagaaaagaactgtcaacccagaattctgtgttcagggagaatatccttcaggaatgaaattgagacattctcagataaaggaaaattaagagaacttgttaccaggaaacctacccttaaaaagtagctaagttggccgggcgcggtggctcacgtctgtaatcccagcactttgggaggcttaggagggtggatcacaaggtcaggagatcaagaccatcctggctaacatggtgaaaccccatctctactaaaaatacaaaaaattagccaggcgtggtggcaggagcctgtagtcccagctactcaggaggctgaggcaggagaatggtgggtacctgggaggcggagcttgcagtgagcagagatcgtgccactgcactccagcctgggcaacagagtgagactccgtctcaaaaaaaaaaaaatagctaagttatctaaacagaaaggaagtgataaaagaatggatcttgggagggcacggtggctcacacctgtaatcccagcactttgagaggccgaggcgggtgggtcacctgacatcaggagttcgagaccagcctgcctaacatggtgaaaccccgtctctactaaaaatacaaaaaattagccaggtgtgatggtgggtgcctataatcccaggtactcgggaggctgaggcaagataatcacttgaacccaggaggtggacattgcagtaagctgagatcacgccattgcactccagcctgggcaacaaaagcgaaactccatctcaaaacaaacaaacaaacagaaaaaaagggatcttggaacttcagagagaaggaaagagtaaaaatatgggtaaatacttttcttaatgagttttctaaattattttgccatttgaagcaaatgctataacaatgtcaaatgtgcttttcaaacatatgtacaagaattttttaatgtaagtgttttataaatggcagagagtaaagagactaaagagaggtaaagtttctacacttcgcttcaattggtaaaacggtgcatgtagatatcaactacatagataaagatatatatagtaatacatagagcaatcactaataatacttaagttctaagagatacattcaaaagccctatagataaatcagaaaagaattctaaagagcactcaagtaattctcagaaagataaaataaatgaaagataaaatgacagacttaaactctaatgcagaaattagttcattaaaagcaaaagatctaaatataccaattaaaggacagagattggtagactggattttaaaaagcattatctaattatataaactatagagttacttgaaatataagtagttgaaaggaaagaatggaaaaagaccatgcaaacatgaatcaaaggaaagctatagggcttagtaatgtcaggtaaagtaaacttcagagcaaagaaagttaacagagacagagaggatcattgcataatgatgaagaggtcaatccaccaagaagacagcaatcctaggtatatgtgcatcaaacagagctgtaaatgtgaaggaaaaaaactgatgaaactaaaaggagaaataggtaaatacacaattatagttggtgattttaacatctctccttcaacaatggaaaggaaaactagacagaaaatcagcaaagacatagaacttcacaacatcaaccaataggatctaattgacataaagcactttactcacaacagcagaatacatgttcttttcagttgcacatggaatgtatgccaagatagacatcctgtcccatgaaataaacatcctcaaatttaaaagaagtgaaataacaaaaagtatattttctaatcaaactggaatcaaactagaaataacagaaacataatggaaaaatctctaagcacttggaaactaaaaaaacagatttctaagtaaccagtaggtcaaagaaaacacttcaagggaaatgaaaaaatgtatgtaaactgaatggaaaggaaaagacaacatatgaaactttgtgggatgcaattaaagcaggctgagggggaaattgacagtatgaaatgctgcgttagaaaagacaaaacatctcaaaccagtaatctaagctcataaccttatatgactagaaagagaagagcaaaataaatccaaagcaactagaaagaaggaaatggtatagatcagaaatcaatgaaattaaaaatagaaaaacatttgaggaaattaatgaaatgaaaggctagatctggccaggcgaggtggctcacgcctataatcccaacactttgggaggccgaggtgggcagatcacttgcgatcaggtgagtggatcacttgagaccagcctggccaacatggtgaaaccacgactctactaaacatacaaaaattagccgggcatggtggtgcatgcctgtaatctcagctactcaagaggctgaggcaggagaattatttgaacccgggaggcaggggtcgcagtgagctgagatggcgccactgcactccagcctgagtgacagaatgagactccatctttaaaaaaaaaaaaaaaacagctacatctttggggtttaaaaaaaaattttttttttttcataaaacccagatcctgtgtgtgcacgcgtgcacacacacacacacacgctagatctttgaaaagatgataaaattgaaaatcctctaacaagactgacaaagaaaaacagacaatacaaatcttgtcaacacggtagtccctcagtattcatggtttcgctttctgcagtcaactgtgctctaaaaataggagagtacaatacaataagatattttgagagagagagagtacattgtacattcacttaacttttattacattgtattgtcataatcgttctattttataactagttgttaatttcttactatgtctgatttataaattaaactttatcgagttgggcgcagtgacacacctataatctcagcaactcaggaggctgaggtgggaggatcatttgaggccagaaggtcagcattagcctgggcaacatagtgagacactgtctctacaaaaaatttaaaaaaaaagtatccaggcttggtggctcatgtctgtagttaagaggctgaatcaggaggatcaattaagtccagaagttggaggcttcagtgaaccatggtcaagccactgtactccagcctggttgacagagtgagactcttaaaaaaaaaaaaataagaactttatcatagatttttaggtagagggaaaaacatggtatatagttatatagggttcggtactatccatggtttcaggcatccactgaaggtcttggaacatatccctcatgaatacaggggtactactctatcaggaatgaaattagatattaccaccaacgcccccaatagcaacaatgtattaaagaaatactgtatacagctgaatacatacaattttgacaagatgaaatgggagaactcctcagaaaacagtcacaactcagctaactgaaacagaatatttgaatagccctatgattattgaaaaaaattgaattcataattttaaaactccaaaaatgaaatctactgggccagatggttttcctgggaagtctacctaacatttaaagaattatcaccagttctgcacaattgcttccagaaaatacaagataagaaacattttaaatttaactttatgaagccctaataccaaagccagacaaaggtaggaaaaaagaaaactactgaccacatccctcatgaatatacatgtaaaattccttgaaaaaaaaattagcaaatataataaagtagaaaaaaattttgtagaccatgacctagttggatttattctagagatgcaaggctgattcagtattgaaaaatcaattaatgtagcccatcgtactaacagactaaagaagaaaaatcacgtggtaatatcaattggtgcagaaaaagcatttgataaaatttgaacttatttatgataaaaactagtaatacagaggaactttctcagcttgatgaagaacatctacaaaacttctatagcttgcattattcttaatggtaagagactggagaaagggaaggatatgtgctgttaacactgctattcaacatagtacaagaagttctagtcagtgcagtaaggcaagtaaaagaaaaggcatgtagacgcagcagtggaaaaataaaactccctatttcagatgacatgctggtctgtttgcaaaaccctaaggaatctatagataaacaacctggaactgcaaaatgtgtttagcaagcttgtatgattcaacatcaacttacaaaaatcagttagatttctttcagtgaatatgtggacactgaaattaaaatacaccatttgcaatccctaaacaaacaaacaaaacttggagccaaacatgatagcctgtgcctataatcccagatagtcaggaagcagaaagatcacttgaacctaggagttcaagacaagcccaggcaacacagtgagatgtcatctaaaaacataaacaaaagcttgggcatgcatctaacaaaacatgaataggacttgtattttgaaaactacaaaaccctgatgaacgaatcaaaaccctaatgttgggcatgatggctcacttctgtaatcctagcgttttgagaggccaaggaaggaggattgcttgaatccaatagttcaaggccagcctgggcaacatagtgagatcctgtttctgcaaaaaaattttaaaaatttaaccaggcatggtggtgtgcatttgtagctccaactactcaggaggctaaggcaggaggatcgcttgagcccaggatttcaaggctgccatgagctatgatcatcctgctacactctagcctgggtgacagattaagtcctgtctctaagaaaccaaagacctaaataaatggagaggcatactatattcacaaattgagagcgttaacatatattaatcatgtcagtgttctccaaactgatacaaagtttaacttcttaatttttatcaaaattccgccaaggtttttttgtggttatagacaagattattctaaagtttacatgaaaaaacaaaggaactggaatacctaaaacaatctgagaaagaggaattaatgtgggagaagttattctgtctgatttcaagacatgttatatagctccagtagtcaagactgtgtggcattgctggaaagatagacatgtggatcggtggaacagaatagagaaaccagaaatagccccacacaaatatatctagctcatttttggcataggtgtaaaagtaattcagtggaggaaggataggcttttccaacagtactgggacaactggacatccataaacaaaataatgaaccttgactttttgggtttttttgtttttttgtttttttgagactgagtcttgctctgttgcccaggctggagtgcagtggcatgatcttggcttactgcaacctccgcctcccagattcaagcaattctcgtgcctcagtctcccgagtagctggaattacaggtgcataccaccacacccggctaatttttgtatttttagtagagacggggtttcaccatgttggccaagctggtctcaaactcctgatctcaagtgatctgcccacctcagcctcccaaagtgctgggattacaggtgtgagccaccaggcccccggcctaaaccttgacttttaagcatcaacaattaattcaaatggatcatagattgaaatctacaagtattaaatttttttgagaaaaacataggagaaaatctttgggaccttcagcttggttaagaattcttagatgtggcaccaagagcttgatctagaaagaaaaaaaaaatttgagaaattgtagtctatcaagattaacaatatcttacagtgctttttctcttagacatttgctgataggttaagaatcttggggcttttccatctagcataaagcagcagataaaaagttaggagacagatcagagctttcagtgatcagatcaaatcagagcttgtatagggctttggaggttacaaattgaattcaaggcttactagagaactcaaatctgtaaaacaattatattgaaattcattttttttcttcttctttgagacggagtctcacactattgcccaggctggagtgcagtggtgcagtcttggctcactgcaacctccgcctcctgagtttaagtgattcttgtgcctcagcctcccgcagagctgggattacaagtgtgtgcccctacgcccggctaacttttgtatttttagtagaaacggggtttcactgtgttggccaagctggtctcgaactcctgacctcaagtgatccacctgccttggccttccaaagtgctgggattacaggcatgagccaccacacccagcctatattgaaactctaaaactaaaaaacccctaaagttagactcatttaaaagtagatatgtttaagaacatactggacacagtaggagagagaactgatgaagacagattaccagaaaaattttaactaaagaacggagacaagaaaacatagaaaaatacagaaaaatgtctgaaaggcatgtgggtaacagcaaaatatatatatgattgaatttccagaagagaagatatttatgcattatttgggaataaaagcagtatttgaggaaatgctggtagagatttccagaactgatgaaagacaagcattaagataaaaacaaggagttctgtccaccctaaacaagataatctaaaaaaaaaaaaaaaatcaaatataggctcatagtaaaaattgctgaaaataaaagaaaaagagaaaaatctttaaaaatagccagatggaaaaatacctttaaagaacaacaagactgttaaacatttgctgggctataaagcctaaagaaaaagtagaggccgggcgtggtggctcatgcctgtaatcccagcactttgggaggccgaggcgggcagatcacgaggtcaggagatcgagaccatcctggctaatacagtgaagccccatctctactaaaaacacaaaaaaattagctgggtgtggtggcaggttcctgtagtaccagctactctggaggctgaggcaggagaatggtgtgaacctgggaggcggagcttgcagtgagccgagatggagccactgcactccagcctgggtgatagagcgagactccgtctcaaaaacaaacaaaaaaagtagaaggcagaagacatttctaaagtgctgaaagagtaaccctcacaatggattttacaccaaaaattttctttaaaatgtaggcaaaactaatttatagtaaaaaaaacaaaattagtacagtggttgcctgaagctgttagatgatgcagggatggactgcaaagaggaaccaggagctattggggtaatggcagtgttctgtattttgattgtgttgggggtttgtcagaagttattaaattatacgccttgcatttactcttcagaaatcatacatcaataaagttgatttaaaaactgaaggcaaatttctgcttcttgctaagattaagtaagagggactgcatttaactttccacctgaaacaacttaaaaactagacaaaacaatgaaacaatggtttttataatgttggacatcaggcattgaaggacattgattgcttgggagatgggaaacaaatgaggtgaaccctaagattgcaccagctttctgcctgaagagagtttccaggctacagtacaggcagggggtacccagttaaaggccagaagcctccctgattgagattgagatgtgagtccagggaggctagaattcgcagagcacagagaatcagggaggagagagccgtaaacagtctacctctggtgcgaatagtttcaactcctacaaaccagactggaaaacttcataattgacatggcattgagtagagcctcacaatgcttttgcctcaatagtggggcagaattatccttagactaaacactgctgtcgtacaaccaagagtttaaaagcaagaactacaaggctcaaactcttgccaagtaatttaactatgaatccagaacaaagtcaaaaatactttataggaatacaacaatatccagcacccaacaaggtaatattcataatgtctgacagtcaatcatttaattaaaaactacaagcaggagcatatgacctatagttggggaggggataaaataattaaacaattaaaaccacaaaaatgactctgatgtctttttaatgtttaagaagcaggaggaaagattgaacattaagtagaaatctggaaaaagaaaagctttgtatttatggatatgaaagctacaatatctgagttgaaaagtacactggacagaattaacagcagattagacattgtcgaagaaaggattagtgaacttgatgacatagcaatagaaacaattgccaaaaaaaaaaaaacaaaaaacccaacatcaatatactgtgagacaacttcacctgacctaatattcatataattggagaccccagaggagttaggaactacctgaaaaagtagttgaggaaatagttccagattttccacatatgatgcaagcagacccaagaaactcaatgagccctaagaataagaagcatgcagaaaatgacaccaacagatatcataatcaaattgtttcaaacccgtgatacagagaaactcctaacagcagccaaagggaaaaatcttgattttcagaagaaaggttatcaaaataaacaatgaacataggaaaagttagatgacttttttagtcgttagagaaatccagaagaaagcatagcaatacagttctcagatgtttacgtctcagagtcccttcacccttttaaaagttaaagatcccaaagagcttttgttcataagacttttttgtgtgtttaccacattacaatcaaaacaaattttaaaatgttatttttaaataaaatgattacattttacatgttaatataagtaacatgtttgtgaaaaaagttttctaaaatgaaaaactagtgcaaagaaagtatcgtttttgcagatctctttaatgtctggcttaatagaaggcacttggactcacatatgtgcatctgctgtcagtctgctgcaatatgttgttttggttggagtaaatgaagaaaatctgtcctcacagagtttatgtacttggagaaagaaggactttcatacggccttttcagataattgtggatattttcctttgatataacaccaaaactcaacaagtggtagtttttgtgtgtgtgtttttttcttttgaaatggagtctcactctgtcgcccaggctggagtgcagtggcacgatcttggctcactgcaacctctgcctcccaggttcaagcaattctcatgcctcagcctcctaagtagctgggattacaggcgcccaccaccacgcccagctaaattttgtatttttagtagagacgggatttcaccatgttagtcaggctggtctcaaactcctgaccttgtgatttgcacacctcggcctcccaaagtgctgggatgacaggcgtgagccaccatgcctggccaacaaatggtagtttcttaaaggttgatagctatgtggaatctgaaatcatgagttaatctgaaatcattctgttaaatgaaaaattcattgactttcatgcactttgaatgaatctttcttttcctttttctttaattttttttgagacagggttgcactctattgcccaggctggagtgcagtggcacaatcatgtaatcatggctcactatagccttgccctcttgggcttaagccatcctcccaccttagcttccaaatcctgggactgcaagcccatgccaccatacccacctgattttttaattttacagagacagggtctcactgtgttgctctggctggtcttgaactcctggcctcaagtgatcctcccaccttggcctcccaaagtgctaggattacaggcatgaaccaccatgcctggccttgaatgaatcttttattcatgcatgattttgtaatttcatacagcagtcatttggaaaaattggttctcttatggagattttataagtgtttgtttagtttacaataatgaaaatattccattgatcttattagaaaaagagttaagtgttgggaaacccttaggctcatggtgataggtgtaagtttccaaaaatttaaattttgctttagagcttaaattctattatgtcaggaaatactgtgagttgtttttcctgaagtaacaggctcccctttatattttcaagacaatatctcccaaatacacaagcctgaatgactatagtttgtctcttgtttgttctttcatatgaaaatagtgattttagttaggtttttattgctgctgtaacaaattactcctactcagtgccttaaaacaacatagatttgttattttacagttctgtaagttaaaaattaaatattggtgtcactgggctaaaatcaaactgtgtcctttccgggggctctaagggtgaatctgtgtttggccttttcaacttctggtggctgcccgtgcaccttggctcatggcccttcctccatctccaaagccagcagtgttgcctccctttgaccctgcctccattgtcttttctcttttgtctccgttgtctttttctgatgatcatcttgtcttcctcttccacttttaaggacctttcagttattgggcccatctggataatcctggctactctccccatctgttaattggcaatcttaagtccttctataatctatgctcccctttaccattaacattacgtattcacaggatctagggattaggaagtaggtgggtttgaggagaaattactctgcctgccagtcttctatgaaaaagacacaaagttcatcttgcaactcagttgaacaagtgcttttccttgagaaagctatcataaagcactttagtaggcaacagatgctttatatatacgctgcatttcatcacatggaatattaaaaagcatatactcaagtgtctagatttaatacaagttaatattttactgcttcatcaaggacattcttaactgggtttttatttggggaaggggtgagtgtatagcggagaaaaagaatgcaaggagtgctggtatagtttggagccactgcttgattcatgcaaaagtgccagcagtttgactcaccatgagtgcatatgtccgtggaaaataccagattgactcttaatagtgttttgaagatagttttgatgtcatgatccatcactccccacaagaaggttctcagagatgctcaagagttcacagtccacacttcaagaactgttgcacaatgaaatacctcatagtgactattttaaatttctaaatttaattaggcaatagtagaggtttcataagaatgtaagaattgagttgttctcatcgtttgttctaccccagtggccgctttctggccatgataccagggaagatgaggtaaaatgcaaaacttctgaagaagactgagaacttggttattcacatctctttcttctggtacagggctgtgactttatcgtccatctttccaggaagttatggctgtttaagtcagattgcactgtctgtttctttctttctacttttttttttttttttgagacggagtcttgctccgtctcccaggctggagtgcagtggcgctatctcggctcactgcaagctcagcctcccgggttcacgccattctcctgcctcagcctcccgagtagctgggactacaggtgcccgccaccacgcccggctaattttttgtatttttagtagagacggggtttcaccgtgttagtcaggatgctctcaatctcctgacctcatgagccacccgcctcggcctcccaaagtgctgggattacaggcgtgagcctgcagtgtctgtttcttaactctgtgttaaagtgcctattgtatgagaggaagagcaaatttatgtactgttgtttcccagctgtggaagctcacaacacttttagtaagtgttgaaagacccctttactttgttgagatttaagaccttcatctcaaatatagcccttgtcccattggactgaccaccatcacttttgtatgtacaaacatttattgagtgcccagcacttccctcagtgcttcatatgaacagctgatctgcaggcatgaattatggtaccattgctaaatgacccagaggttatccaaagcaaaatgctaaactgtggataggagggcttctggtgtcatcataactctattttgatcattaccttaaagtattgtatatgtagatccataagcccacgtaggtatgtttgtgtgtttctgagacaataaatactgttttatataacctcaaagcaatccaaaatccccacatcatggctttacaactccatgtacattagctccttctcttagaatgttcctgattacatttacttaacttctgcttgtcaacatctcattctatctgggagcatggctgctaaggattctaggagcctgagttcggagaatgctacctacctttgatctaattggagtagaaatcaagatacagtcacattgtcacctttgaggatacagcaagtgatatttgacacagtttcaaaccagaggaaacttgacattgtaaggaatttcctaatcctcttaaaggatcattcctttcacaactggcaaaaccggtttgttctgtcagcaggtggagctcactagggtatagaattcagtcaaaagaggcacattgtcctgtccttgaattctgcttgtccactactttgggggatgttttcttatcttctttctgcaggaaacttttttttttttaataaatgaatctaaataaattaatccttttgagtgttgcacagtgaaatcttaggcctctatctatgaagttttaaataggcacccacaaattcagtgtcgctgtaatgctttccattagtcagggtgagttttgttttaccctgttgcaagcgaaggctgttctggaaggcatagccagacagcatgtaacttaaagccccttcctgtctacagattgcttgatctttttgttctccctggagggagagagtcaggtaatgttcagccctggaatctggctgtattaaggacttcttttgtaatagacatcgagactatctctccctttttatttgttgagacctaatagggtacttagctcaattctaaagccaagatgaaacctttacctgtgggagcgttcccttctaagcattagccacattcagccattagaagcaggcccgctaagaaaggggttaaatgtcagtagtgtgcagcaagttttaccctgatttttttttcttatgtgtgctatacaaaaatgaactaagtcccgaatgtgtgcctgttcataatcaaggtagcagtaggtcagattgtatgctgttttaaaaatattccaggacaggcacagtggctcatgcctgtaatcccagcactttgggaggccgaggcaggtggatcacctgaggtcaggagttcaagaccagcctgaccaacatggtgaaaccccatctctactaaaaatacaaaaattagccaggcctggtggcgcatgcctgtaataccagctacttgggaggctgaggagggagaatcgcttcaactccagaggcggaggttgcagtgagccaagattgcgccattgcaatcccgcctggtcaacaagagcgaagcgaaactccatctcaaaaatatatatatatatccaggaaccctcctgtctatgcacaatgcaaaggctgttgagctttcttgtcagctaagcagggtgcaggggagggagacaaagcaagcaaaggtgtttttttgtttgttcatttgttttctcccctgtgacattttccgttatcacgatttgaaccatttgatttggaaagctgaaaatggtagttcaggttcgtagtcccttaatataaagtggcagggctggctgtgtttcagaattgaggaattttcagattttagagggataataaaatgtatgacccatatagtaatattcccagtgagatctggggcagtaccccacaatcaattatgcaggggaaacatgaatattcacacaaagatgaataaattaaaagtactaatgtcagccccatgtcaagttttgctgccaaatatgtttgcctaaatttgctttctacctttcaacttcagaattgcaaataagaagttgtagacatatgttgcagcggttgtccaaagacaaacctggttgagttctggtgatagttaatggagctgagtcacagaactgactctttatgatcttgtgtctctccctactgtactagttcctctctcttgcattctctgatctctttgctcatctgtcaaacaggggtaatatttgccttgtgggctattgtgagagtaagaatttaatgtatgttaaacactgcacgtagtgcctggcatatgataggtattcaataaatgttagctattaaaatttcacctcttctcttcccccttttattagataaaaccttactgatgtggtggttgtaatgacactctggaaataggattaagtgataagaattgtcccaatgtcattggagaattcaaagtccaatttttttttttttttttttttgagacagagttttgctctgttgcccaggctggagtatgtggtacagtcatgactcactgcaacatcaatctcccgggctcaaatgatcctcgaacctcaacctcccgagtagctgggactacaagtgtgcaccaccacacctggctaatttttgtacattttgtagagacagggttttgccatgttgcccaggcttgtctggaactcctaggttcaagtgatctgcccccctcagcctcccaaagtgctgggattacaggcattagccactgtgcccagcccaaagtacacatttttatgttgaaaactcattgcttgttaaatgatcagtaacaccttaaaatttctttgcaaaatgactggacttttcaatgatgaataaatgttttgattaatgttataagtaaatctcttaatccttcattttaactgcatttgaggaagaaatatttgccattagctgatttgccattgtgaggcctcttttaaagtttctctgcagacactcatcctttggaaaactatttgaaagagaagttgctctaagtacagtattgatgatagtagtgctgtaacaaagatataggcaaggtttataatttaatatattgggaaaagggtattgggagataagtcttttctaattttacaaaaaaaaaactgcaaaaatattagtggaccttttagtgcaaaacagtttattttaaaatatgttttataaagtagacctctgcttttaaatttgtaaagacctcccttttaaaaggggggacaccataaaaaaagaattgcctttagttaccaggattttttaataacctcattttgtactttgtaattgattaacagaaatttcctatagtaccaacagatctgtttaatggtgcatgatctttacatacaggaaattttcatttatttttctggccttttctcagttcatgaagttcgtagatacttgctccacttaattttggatcaaagacggaaaatacagaaggatttcaagagaagaaaggtgttagctattttctgggcatgtgccctataggaccttttagcatttgactgggacaaagtggatctgcctatatttatatgcatcgtattacctgccttcacagctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaagtaagaaatacttacaccctcctactaggcttattttccccctgttgtgctgttgtgcatctgctaaattatccgtaaagcaacattgccatttatcgcagaacactgctggtgatgggggagagaaagccagagagggaggatgtagcaccagaacagttgaagatcataaccaaagtagctagaattagactctaaaaaaatagtgttgtcagaggtgtgtgcatggagtggggcagtgacacagatcgtgcagaattgctcctgggtgagcattgtgtaaatttcattacatttagccaaatgttagggtgattaaaaactccggaaacttacaactgtctgagtgtaagcctggaatttttgacttccattaattcatttcatagtcttcatgtttatctatgtagtcagcctttgtttttgtttttttgtattctttttacatctagggtttttgtttctattattattattcacagtctacttaatctctgagaaaataggctttttagctttggtattagtttagctcataaaatgtgttgattaaaagcatgataatgaaacaatctgtttaactatggtgcatgaacctaaaaggttgtccatgtccagtccccaagttgtcagtaaaatagttaacattctcaaatgcctattttggttagctgggactaatcaaagagtgtgttgacttttgctatgtgtctgtgtgaaagcagttttaaattttatctttaaattcatccatagacacctgtgacctgtttttctttgagagggtcttgggattagcacatctgtattgcagtctatagtaatctctctgattttctgtacaggaaattaaataaggagttgagtcatgaaaacagaaaagcattcataaactccactgcagggaagaatttcctgttgccatggttttgctgttgccaacttggaaacgacatgcaagagagactattaaaacccataaatagcctagctgcttaaatattattttaacattctgtactctgcttgcaactgcataaagatgttaaatttcagtatgtccttaaactctttttatccagctattctgatattcacctggtacagttcattcatgttgcccccatttgttgtgctgtataaattatcactaccacaaacagttattgaaaggatctgggaagagaatgtgtaataagctcagtgatactataaatgaatggtcagactgggagttgataagattgtgtgttatctgtgatgaagggtgatgtgagaaatgtatagctagggtatcgttaagcaacatgacatgtagtaaggcagtggaatacacaaaataagcactttgtgcacagtttgtccaattatcccaacaactgcaaaggctagagggggatgagcctggattaccaaacagcctcttaatgtagttttggaattatataataccttcaacagggaaagattctttttcactgaactactctcctttaagtagttcaactttatgaggcatgtctgacctttcagggcatatttcctgagaaggattcaaagaatccttctgtccttttaaaatgtcgcatttcctaaaatgaacgaaaagtagggaagtattcctactctgaagccccaaagaagacagtacgcaaaatcatctcttttactccaagcttattaataggggcaaaaactagagtctattcactatgccatttaaacctgcattaaataatcatagaccaccaaaataggcaacagccagcctctgtacacctcagctgcctcctactgggctggacactactagagataagacttcgttctgtgtgctgtgatgtaatctcaccatacttaatctaactttatgttgtgtcaagaaactttgaatataattctttttctaaaaaagtgcttttcagaacaaatgttcaaggatcattcccactgtagatgtcacttgaatctatgggtttgtagtttttatcaaattaaagtactatctgctgttatttctttattttttctgtcttaacctcccatctctctgagactccaattacacatatgttatatcactcactggtgtaccacaggttaatgaggccctggttcttttttttttccccctaacctttttttttccttctgtgcttcagtttggataatttctattaatatatcttaaagctccttgtgtttttcttttcttccatggtatcttaattcattgttaatcccgtccagtgaaatttccatttaagatattatatttcagggccaaaagttgcatttgataatctttttaaatgtcttctattctcacctttttaggttcacgctgtcctttagatccctaaacacatttataatagttgtttcaaaatgttcatctgctaatttcatcatttctctcattttcagtttctttttttaatggggttcctttgtatatattttacttcctcacatgtctggttgtttttgataagatgttggatattgtaaatgtttcattgttcagtgtcttaattttgttatcttctttaagtgttgagttttgttttggcaggcagtgaagttgcagaacagcttgatttttatgagtcttatttttaagctttgttaaagcatacctagagtagcttttactctggctaacttagccctactactaaggcatgacttttcttgcacctcagtacttgaatattcaatgaagtgtctactgtggctgttcagaactcattaatgtctcccaacccagtgtgaactgtggaattgtttggcttataattcgttggtagttgttctttccctaatattttgtctttgcttggcttttggaatttatgcatatgcatatgcagcttactgtccaactcaagactcaaagggacccctattcagatttctgaacctttcatctgatatttctttctctttggtattctgcctagcaaatatcagtcacctcagacttcctgaactcgagtctgtcttggcttcccccttcagtaccttgctctgtgtcaactgtcccacaagtacctctaggtagaaagcccaggggtcatagggctcatcttctgtattcttttttctcaaggatcactatccaaggctgcctgttctccaatgtctgcaaacagttgtttcagctattatatcattttttctagttattcacaatggcatggtaagtgctgtatcaagcacttcattatggctggaagcagaagtcccagatacttttgatatgtatgccgtctcgtttaattccgacaaacctgctagataccaattatccccactttacagaattggcttctttagattaagtaacatgcccatggttagatagctagcaagcattaggaaagtagaatagatcccagtagtgtggttaatgaagtgttcagagaaagcataaatgtagaatgaagtatagcaaagccccaagaccggcctttagcctatgtcttcctccctcttaagcccttgagctaacagtactcaaaccagctcatgagatagctctacttcatgcattatcatcatattcatttcttagtatttttgtaaaggaggacgaggctcagggaagtaatgaactattgaaccatttcttctttttcccagttatctgtgcaaagaccatctacacatttcaaaaataaggatttgtagcaaacaagcaagctacaaataaatatgtcacaggctggaacaattctgcaatgaagaaatttttaataggggatttttccttcttttttgttttcttatttggatgatataacctagataattaccattctctcacactacaataaatacaataaacttcccaccaagcagtttgttatttgaaagctggagaccatcctcatttttagctacgtacgtggattatttgggggaattatttcctgactgaggcttgtttgtcacgtcagtacacaggagacttagaagccgtttgtaaaagctttccttcaaagccctgccttcattaatttgctgcaatgttagtgactgtttgttttctcctccatttttcagcagtgttataaatgcagttgaggttcaagatcttaaaagagatataagacttttcataaagaaagatttggaggcagatcatgtgattgtcaaggaggcagatcatgtgattgtcaaggtgacctatataatgcctgaatttacttattaattaaagctctatacaaatatgaagtagcatcattctttcatcctccttctacaagcacattgtccctttagagttgctcaatacgctcttcaaccagataaaaaagcattttttttttcattttcctgatagtcattctattaaaactttcatagtttcagggtttcatggtcactaaaaatattataataagagcattggatgctttattccttagtaatatagtaaacagtcttagattcgggaggacatgtccaggtttgttaacaggggtatattgcataatgctggggcttgagcttctagtgaatctattagccaaatagtgagcatagtacccagtaggtggagattttgaggtggagtagggttctccaacccttcctctcaaccttcctccccacttttggactcgccaatgtctgttgttttcatctttatgttcatgtgtacccattgtttagctcctgcttgtaagtgaaaacatgcagtatttgactttctgtttctgcgttaattcacttaggataatggcctccagctgcatgtgtgttgttgccagggagatgatgatgttcttttttatggctgcgtaccattccatgatgtatatgtaccatgtttcctttatccagtctaccattgatagacacttaggtcgattccatgcctttgctattgtgaacagtgctgcaataaacaaattagtgcaggtgccatttgataaaattatttcttttcctttgagtagatacccagtagggagactgctgggtcaaatggtagttctattgttagttctttgagaaatctccatactgttttccatagtggctgtattaatttacattcccatgaacagtgtatgtatattttcttttctcaaaatccttgccaacatctgttattttttgacttttgaatgatagccattctgtctgatatcagatggtatctcattgtggttttaatgtacatttctccagtgattagtgatgttgagcattttttcatgtttgttggctacgtgtatgtcttcttttgagaagtgtctatttgtgttatttacccactttttaatggggctgtttgtttttttcttgttgatttgcttaagtttcttagagattctggatattagtcttttgttgggtatatggtttgcaaatattttctcccattctgtaggttgtctgtttactctgttaattatttctttatagcaaacattcttttttcattctttctggtaaagtttaatacctctatgaagtgcatagtaatttcaggattttggaattcttttcttcttggaaagaaaagtttcattattttagccctagtttcatctctgaaacttctgaaactattcccaaactgttgaaaattatcagcaaaactctatgaatctaaaagacctcagaaaaaggctggtcagatagcatacattgtgtgaaatgagacgtggaggacagagagaaggggctagaagtagaaaaataaatgatcttcagtgttttcttccccagcagttttcctctctggcagtaatccttttagaactagcaggcatataaagcacagtgtaataaatgaataccaatgacattttttttttctgtttcattaattttgcttaaaattgacttgaaacacatgtataagtacacgtcagtggtgacacattcactttaaagttttaaaatgtgctgatctgttctatacatatttatagaaagggttcttgacaatagataagttcttcacgttcaagacctgtcttaaatagttcagttgaatcctttgttgtagtaatacacagtttttttgttgtgatggtcattaatacttagaagatatttttcttggatatttatatgttgttacatagttttccaatttttgaaaagtagtctttgctttgttctatttttgactatttttaagccttcgcattttatgtcagcttcaaaattaagattctccaacaagctcaagcttgaaactcagagctctagaatatctttagaaagctgtctgcaagccacagttgtagtctattcttagagcagtacctaacggcagcggagttactgcattagagctacctgggagtgtctgtgaagaatagattcccctgtgaggccctatacccactgaggagtattttggggggtgggccctgggaatctgcctcttaatttagctccacagctgatgctgtgcatactaagttttcagaactactgttgccttttggtatgtgtcagagactttgtctgagagcatcgttctctaaaatgccatcaagtgttttggtcctcaaaaaatagggtcgaggccaggtatgttgggtcacgcctgtaatcccagcactttgggaggccaaggtgggtggatcacaaggtcaggagattgagaccatcctggccaacatggtgaaaccccgtctctactaaaactacaaaaattagccaggcatggtggcatgcacttatagtcccagctactcaggaggctgaggcaggagaatcgcttgaacccaggaggcagaggttgcagtgagccgagatcgcaccattgtactccagcctgggcgacagagtgagactgtctcaaaaaaaaaaaaaaaaaaaaaattgggttgatagagggttgagtttacctacagtgaatgtacttctgttccttttgcaacccctaagtccagatcctttgagtctaaacaggtattccctttgagttgggaagttaataacttttttctgcagcttccaggtacttgtgggaacactgattctgaaactttgttaagataaaggcagtagaggttttttttttcttaaggaaagtgagaacacaacatgcttaagtcttaaaaaaattgttagacgttgctgtgtcaactttgttcttcagtgttaatggtcttgttaaattattgtctttttttttttttttaagaacaaaacaagtctcttgcttgaattggaagtattagaaaaatgtttcctaacttgatgtgtcgacagaattcaggggtctgtgaacttggatgggaaataagattttctttattttcactgaccccaagttgaaatttagcatttctgttcattatggccataggcagtaaaccacagtaattcatttacctgtgatttcattgccaatagaaagcacagatattttcgtattatattatttgttgttgcagacatctcaagagtgtttgtgctcatcatgtcttcagcattacagtagatattagaccaactgctaaatcttgttatataaatcttgtgcattcatatttaaaattatttgatactgtgcgcttcgatataatttcttttgaaatcttatgttttttattttatacttttacaaatattattctgagaagggatctgatccgtaggcttcactagactgccaaagaggatcaaatacaaaaaaaaaaaggaagaacacctgtcttgtctagaatcttttcatcctaaatcattttcttttcttctcttttcttttttgagatatttctcttaaataaattatttttcctgttatagtcatctcatcattatattttttttaactgtagctgactccactggaacccattctctgtacacaacatacaaagattatgaaattatgttccatgtttctaccatgctgccatacacacccaacaacaaacaacaggtaagagatcctcctgttatctgtgttttcacccttgtttcatttcctctagaagcctaagtggcaagtttgtaaaatcttaaaccagaatttagtgttgcacctgtcacagcagcgggaagctttgtgctttgtggaagtaaggaatagcaaatgaactgaaaacaaatgaagagacacaaattttaggttaacagccagctggatgcctttgtgaattaatcatttgcttttcacccacggggattgaggttttcatgaaatctgaggaacaagttgaaatcattggtgattacatgactctgcagggttgcaaagaacatccatgagtgggtgaagtttcatctcaagaggtcagtgcacagaataggaaagttctgaggttgcattatagatttcaaaggagatataaaatactaacttggaaaaaagtcaaatgtcaacagaatgatattcttccttaccatgttcattgggagatagcaaagaacataaataacaattgcatatgtgcacatcatacacagagcttctcttaaaatgatctaaaagctcaatgcccaattactaaagtgtaagtgaggtagtaaaatgtggaaactaagaggtgacagattgttacagagcaaactggaaactggcactattgttttagggaatatgtggtagttgattttttaaaatattttaaaataaatagtagcaaattgaaatttaaaagaaccagagagctaacacacacttcttttaaaagctattacaaacttgagcagtccaattttacttctgaccttcaaatggatatggatttttgtttttgtcaattgttgtgctaacagagcacaggccagctgcagaatgaatcacatcctctttcacagaagttaaccaaacactgatctaatctaacactttatcagtttacatttgattaaatcacaaatctaggtaacaaagttttgcctttcatgattgccagtgtaataaaaaatagagagcaaagcaatgaatcagctataaatctgaagtaaacctgttttaagataaactccctgatctgtactttgttgataatttgttttatgcaaattccagattttagctctctttgaaagaaaaacaccatgctaagaaaggcataataaacttattctgaccagtcagtagataaaaaatttaagaacattaacaaaatgatccttaaagagagcataaaggcttattctgcctgatcacttagaagagaaagatgagatttgtaagggtaaaaaatttactaacaagattggattgattatttgtaactaaatgagttgaagtggtaggcagagaaagtgggcatttaaatggcagctctctcaattatttaattttggagtccaatcaaggcaaaaatgttacagtcttaaatcagaatgagaaagaaattggtactgcaacatatgaaaaaattttcactctctagccaaaaaatttattttcctctatgtagattactttatgcttggaaaaaaaaaccaggaaaaatgtatctttaaaaattcttttgcaaatatttttaataaaatatttttcattatatgtagtataagatggaaaaatggatttgtttctatttgggtcctttattaagacatttatttttatatgtcaagccatattttgaagaatgaataatattacagaaaatgacatcatttatgcaggaatggcataacatgtagataaatagtatttgtttttggtatgtccaagatcttgagtagattaataatctttaattattggtatgttctgtagagcaatcaatacacaccagcctttattttcataacgtctgtttgtatatcatatttagaaatgaactcagaaataaattgcttcattagaagacaatttgggatgctttcaaattcctgaggttaaaagtgcatttcctgaacattctaactcccaatttgcaaccctaatctaaaaggctattatttctcccacctggcagccaatactagatcactgattttactggtttgcaatttgtatgccttaatgtcaccagagaatatttttttaaatacaagttttgtaagtacaagcttatgtctaatggatagtttatataaatgtcacacttagttgtttttcttttttaagagcctccgtacagtaagtttgagaaacacaaattttgtttggttttcctttacactattgaattaactgctgaaaggcactgacctaggatgatttggggtgcctgagtttgaaagccacccatccaaaacccagtgaatgtgaaacagagggtgtccctaagcagctttcattgcagttaaagaagctgtttaaacctgaaatttacctgcttttaattgttgcaacattctggaatattattcttttctacatgcccagcttgtgacacaaaacatatatcagaaaacaccttagccacattttctttcaatgaggccagttaaaccagaacataaattacattgtaattatttcagccattctcatctctaaaaatcttccctgtggcacgtgtttttcttatgtgaaaatggaacaacactgttgttatagaaactgagggtttggtgatgttgggacctggcataatatgccagatattgggtagatctatttgaatggctgtatcttttatgcaaatttcagaatgttcgtttctatgttcttccttagagggaataaggcaggtgaaaacattgacagtacctgtgtagattacctaccttcatgtgtactgattaggaatggatgttttaaatacagctatataagggaattggggtggcgggggaagcaaatgattgttatttatgttggttgcttattttttcttgtagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttataggtgtgtatgggtgtcacagcaggggctctgtggatgttggctggttatcgcatagaggccccattcagctctgcattctaaagtggcaatgggaagtctattactatttctttttgtctttaaaccatgcatgcggatggctgaattcacatgatgatgtaatctggtggcattgacattacccaagcatgttggttagacacctgccgtttccatttgcacctccttcttaggtgatgtccttcatccataccatctggtcaccaaccaactaattactcatattgctaattatatttttcttttggcatggcaagagcagagaagaacgattataataaatagggaagagaagttaattttttgaaaagcattgttattaaagaagcctaaatccttgcctctgacttacttgattcacgttagcactctgactacaagcttagaaacgcttctatactttatttagcattattgaaattgtttcagtgttacttgttgacgtagtcacatgagtatcagaattcaggcctctatctgcagagacctttcttgtaagaatactagagttaggagttgaaggagatagggacctgtcacgctagctcgataggggtgtagtgccagaatgtgtaagggtaatgttctggcatttgtaagatgtttttaatgtgcatcagttcctttcaaaatatggacatttggcgtatctttccatccctaaaaaatgttacctgcatagaaagtgacctgtgcacattgacagtttgtgagatccacaattgtatatttctaggagtaaggcagattaattctaggagtagagtaagcgtagcttagggaaaaaaaacaagtagaggttatgttggtctcctgctggctgtcaccatccttgcacatatcctaataactgcattggttgagctcttgttataagccccaaactattctagacatcttacatgtatatcccatttaatctttaaaacctatgaggtaggtactgcttttatctccattttcagatgatgaaatttcagccaggtcacttgcctcaggttagctggctagtgttgagcagaattagacaggaatgcagtcagtttgattctagagcccagtctcttaaccacgctgctatgccgcctctcttacatgctgggaaagctgggtttttcactccgagctcccaacacagaggctgttccagaacttttcaggtgctgagcctaggtgaacacccaagaccagggaggtctgtagtttcctagggttggggcagaacccccaacaatgaagacctagatctgaaacctcttatcaaggaaatggtgtctgagagctgctctggttagttgtagaatgaaagcacagaacaattgactataattgggatggataactatttgcatttagaaaatactctgagcagttaaaacatgctatgtactagattcatgcaaaggatttcataccacttgacaggtagaaagttaagcccattttgaatgggcacttcaaagtttggggagtggaaagctatgcagtttcttttaaagagagtttcttcttttcaagcctttgtctgaatcagtaccgtccaatgggactataatgcaagctacatattaattttacattttttaatagccagatttttttaaaaagtgccaagatatagatgaaattaatgttgacactgtttttgaccaatttatacattttatttactcagtatatctaaatattatttcaacatgaattaacatgtgatttcagcatttaacaattattgtgacatcttacatggttttttggactaagtctttgtaacctgaagtacattttagacttaccgcatatctcaattagaatgctaaattttcattggtgatacttgatgtatatttagatttcataaaatttataatgaaaaggtagatttaatatacctagattcttccaaatggacttttaaaaatctttaaaataacagaattaagtatccatttttaaatcatatattaattaaaatttaatataatttgatattccttggtcacactagacacatttcaagtgctcaatagccacagctggctgtggccactgtaatgaaccacacaagtctaaacagactgctcagggaggtatgttctccttcttcagtgctttgtttttttatttttatcatccctcccctgaaaattaggatttttgctttctctctcttatttttaatctgttgcctggagagcccaccgtttgaaccccatcatttaatgctagaagtctttgcgggaagtgggatactgaacacccctgctcaagacatgtgggcaggtctggaatttcctagttaccaggcttgtttgaaggcccaacacacagcttttaagctgtgaattttggcctgtttataaatccaagaaaacattagtttgtaacatcactgaaagaaatcacaagagattatagagcagtgacctatgcctattgcaaactttaaagatcaataattttttgccatccttctcaaaagaggcaggcacacctcctcaggtatgtggtgatgtcaggaagtgtttgaagacacagaataaacaggacacctttcttcaagcctttaatgttggggggaggcagggtaaggacgagcttattttctcatgaaaataaatgtattatgaggtagaatggaaaatatcagttttcagataaaacatgggtcttcaaagaatttctacacctgtgaatttttctcaagccccagccactccccgaactactagggatatgaatttataggcctgttttattaggggtggtttggtggaaaaacttagacatgggttgatttatactcattttatttaaatctaatttaattttatccctaagtgatatagctagagtaactcaaatgcttttttaaagtttttttaatttttaaatttttgtgggtacatagtaggtgtatatatttttgggttacatgagatatttttatataggcatgcagtgcataataatcacaccagggtaaatggggtatccatcaccccaagcatttatcctttgtgttacagacaatctagttatactcttttagttatttttaaacgtgcaattaaattatttttagctatagtcaccctgttgtgctagcaaataactaggtcatattcattctttctattttttgtaccccaagtgctttttagcatttaaaacctcttggtcccaactttctccaccatgaacacacatatttatttacttacacctacctggtatctgaactgtggaaaggggagaagtttccttgaaagagtgtcttgcagtaatagtgtggagaggtgtggggtcattacaggctgaagttatatggatatttatgagaagatgggatttgatgtgtgtgttaaagcatagctggatggaattcaatgggaaaaagagaaaccattctaggagtggtcagtggaaaggacagaagcctagaaatgggaaggaggatggaaagtacaataaaaaggcctactaatgcagaaaagatgaccaggcagtagaggcctccagaatgctaggccatcaattcaacactacataagtagaattccaggaaaaattatccagtgttaccatgctaggtaatttgtacacagaaagataaatttggagactgtcattatccatttatttttcattagttctttatccagcccttagcatatatgtgctagacactactctggaccctgggatataacatgagaacaaagagagaaaaatccctatagtggatctagacatgagatctcaaaataatgtggtattatacctccctggggactagaaagcttatataggaataactgactaattcagactaattccagaggccagttaatgtgagtcatcatgtagccaagaactcagaaatcagtcactaagtctgcatactaaagcttatcccataactgatgagagccctccagtctctattgttttatttgtatcgttgcagtgaccttaattatctgatcccagttgatagagaagattagaagcaaaaaaaagaagaaggagctgttaatagcgagtatatactggaaacaaatacttgtttattgatagaagagatgctgaaaaactattcacatcaaagatatgaattcaataagcatagcaatctggggccatttgattttggggcaaacagccaaatatagtagttcctccttatctgttggggatatattccaagacccccagaggatgcccgaaaccatggatagtgcctacccctatatatactatgtttgttcctatatgataacgtttaatttctaaattaggcacagtaatatattaacagtaattaataaaatataacagttataacaatatactttaataatagttatatgaatgtggtctctctctcaaaatacctcactgtactataccacggctaactgaaaccacagaaagttaaaaccatagataagggggaactattgtgtgcttcagtcactcctgagggcttcactgtggaaacacagtgtaagataataccatttttcaacaactacagaattaatggatttaagcattgatcatcaaaggatgcaaatactataaaaagagacaaatatgtgcctcataatggaagaatacaacctcacctatgaattatttttgctaccccctaaaaaaaattaaatctgaatctgatcaagcttccagaaaagccaatttataggaaatacaaaagacagaggaacatgtttgtagttgacaaaattcagaccctgaataactctgcagacacaatgccccatttcttcaacaagtaagttgcaagaaatagtgaggaagtggaggggaatctacagaataaaacattttttaaagctaaattaattgcaatgtgtggatcctatttggatcccaatttagacaaaaagactataaagaaaatcctaggacatcctaaacaattgtaaattggaacattgacacactatttgatgaaataaaagagttgttattcattttaaaactaaaatagtaataagtagtcataacaaggaccctgattgttcaaaacaaatattaaactgtggtcagtaggtatgtttaggaaggtagaaatatgtgttactcctctcagagaggtttccatacccggtaattaaaatgtaataactgttgaaaggaatctgtatgatatagtacaaaaagcacttggaattagaccaaattgttaaacagtgcagtgggaagttgcttgacatccacttaaaatcctattaagtaaaatgtctagcataggcagggaggaagcgtgatgcatgtccattaaatgtctgtgttcatcctctttcctctctgtaaaaaaaaaaaaaaaaaaaaaagaatttgcaagcttcagctgagaagaagaaaaatccaagtaggtcaagtgatagaaatttctttcagaaggtctatttcaagcctcaattaatcagcatccctattgtccactgcagctgacctttctaagacaagaatctgattatgtcatttattgtgcttaaaagcatttagaggaaagttcagacttgcaagcatagcttactgcatgggggcttcaggtttggcctcctgtctctcagtctcatctaccagtctgcaccccatgcctacctcactcctttggagctactcaccactccccagaacagcatgctctgcccctccgctctgcacatgctgctcctctcacacattcccctttccctccatctgatgaattcctgcttttcttttttctgagaaggctccctggacctcccaggactaaagtgcctttcctaagtgctaccagtagcaccctgtacttcgcaagtaggagactcaaatcactggctgtggctcccaccagactttgagtttctggagggctgagcccgggacatcttcagccttgatcctcagcaaaggcaaagtgcctagcacatagtaggtactcagtgactggtggatcaatactattagaaatcgagagaatgattggcacgtgtttgatctttcctgtcctttgcccagatctgctttcttggaagctgccctggccagtaatctgattcaggctccaagaagaggaaacttccttctcccatttgatgttttctgtatcaccttccttttaaattttgggctggggattgttgattattgctgtttttccattgtgcttccaaagttcaaatgtcttatatttctcaatttttatccactaaactgttcagaagtctttgaaacaggccgggcgtgttggctcatgcctgtaatcccagcaatttggaaggctgaggcaggcggatcatgaagtcaggagatcgagaccatcctggctaacacagtgaaaccctgtctctactaaaaatacaaaaaattagccaggcgagatggcgggcccctgtagttccagcttctggggaggctgaggcaggagaattgcttgaacccaggaggcagaggttgcagtgagccgagatcgcgccactgcactccagcctgggcaacagagtgagactccgtctcaaaaaaaaaaaaagtctttggaacattttcatgtgtcagcttgaagttggctttgggtatcaacacttgttatttcattcaagctctttgatgccaaccaatgttacatggcccatatcgagtagaaatagcctcatcatctcttaggccatgtgacccatgtgaatggtcccttttagcaggcacctcaggagtaggaggtttgaaagcacttcctcagagggagtaagtgtgggcttgtcgtggagcactctcttggctgtccagaagcttacattccaatcctggctctctctaacaaatctgggtaaatccttttacttctctgtatctgttcctggagaagtgaagaatttgtaccagctgctcaaccggaggttcatgaagatgtcaaaccacagaatacaaacaagacaccttcctggtcgctcagtgtacccaaagattttggagtgagaagatatttttatatgaaaatgaacacaaatatttttcagtagaatgtaaaatcgaggtgaattttcaaatgaaacccaaagattttactgaaagaatttgaggaacattgagttctgttaagttcccttcctgtgataactttccatcactgttttagcctctagctctgtctgtctgtcatctagataaccctgctgagtagaacattccagtcctcaacaatgctgggtaaataaagcatggctatgattttaaagcatgtattatttccaagaagacacagaattgccaactaggctaatatacatacagccaagcagaggccctttggaatctgcttttaaaaataccaagaaccgtttataattaatatatcttaagtaactacatgcagcaaactgagattctagaaaggctttttttctaaatattctgtttagcttaaaccaggccttattatcaagagttcagaatttgtggcatctaaattaatgagcttttaaccttgtagaaaccttgccagtttgatttatccaaaacaaaatcatttatttgaaaagagcattccagggtatcatcttcctcatcttctgtaaggattctatttctgactatgcgaagctgatttcagtgcctgtatcatttacctccctaccacagtgaatcattgaaaattatatggtaaggattcagttcttttcctcacagttcattatagctgtttctaattattggtaggttttcagtgtatgtttgtctaaagttctatcaattaataaatggatctgcagaaagccagttagtttaaggggcaagtagatggagggtgcttaaaatcacaccccctgctaaacattttgctctccttatttaaaataaaatcacagatattttctgagaaggaataacaatttgagtgaaatagcagatgagaagttgccaattttaaagtgaaagatattaaatatttctggattcttacaggattccacttagaaaaatctagcaaacctggatttcagcatcttttgcttgactttaagagaaaaataacacgatcaaattaaaattatacagctgtcagcgttcaagtcaggcagttcacaatagacaagaaaaattgccttcctaatacatattggtataattaagccatatggaagtctctgaattctctcctccagttagaaaatggagtgttggttgccactgttctttgtcatgaagtgaactaggtagtcttttaaaaatacacttgtaaaaccaacagataggccatcccatggcatcttctgagcatgtagcttttccattccaccagaaatataatttgcctcctgaggttgctgatttttatttttcttattttcacaagaaataactatttcttgaaaaacaaagctgaatatcttaaagcaaacccttcctaaagaaaaaaaagtgaaacagagctcttcaattttatttgaaagatgcatactctctgatgatgccatttctattccaagagttcagaagaaaccgatttttttattgtttccctaatactaagtataattgcataatttgttcacttttaatttggaaagagcgatcttcgatgtgttagaatcatttccagtcatgtcaaactttactaaaatcttgggaaatgatataaaacactcaacctctctatttctatatcaacaacttcctttgttgttttaggagaaacttactttttttccttttgaggttaaaaataataagttattacaaatgttcatatgatccttttcttaggcccaattttaggaatatatagtcagaagaaatgactggaacaggctttcttatatcaatcttgcttaaaggaatgggagaaggaaaatatttttcttagaaatagattatcagaataaaataccaaaaggaccaaggaatagctcagtttaaaaatatgattttaaagcgttgttgctattacataaagattctcatactattactcagattccaattttcattttaaaattatgcttttaatctggttgcataatgcctcacacttaggccaacaaatactagttaagttttattgaaatttaattcatttcttttatggcatgcatcttctgatattttcaatgtaagctgtctgcttatagccatcatatctaaaatggagaacacatttgtgttctcacagaatgtatgcttgttctgaaagatgatgtggttacagtaacctcccttgaaaacagttagtaggtatttaaaatgtcttacacagaatattacagtaaacctattttttttcatggagttttggtcagtttcctgtctggtaaaaaaaaagttaatagtgttagcttttgggattttgggaggtttgtttttggcctagaaaaaaaattatgttgtgtaaatcctaaatgcggtagaatgaaaaaatatactcgtattaagcagaaatgtgtgttgtttctcatggaaaaataagcagctattttgtatctgaggtacatctttgtctttgagaaagtatattttattctgatgttgtgagactgagaaatactgacgtggctctctttgatctttgtctctcagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcaggtgagtctctccttcctcttccttacatgcagtttctctttcataaagttttcaatacagactagagccaagttactgaaccttgtgctctgttattagctcctctgaaaactcccttgatgtgtgaagcaaacagagtttatctcatgcttgtgttttccatggatgtttcggaaaagtagaacaaattggggaagacacatttactctgtgtgtgtgtgtgtgtgtgtgtgtgtgtgtgtgtgtgtgtgcgttcatgttcaaaacccatttgcatgtgacctgttccctggtgctgcagtccagtcatctggtggtggtgttgaaaagaattgcttgagtatctgctgccttgaattttacaaaggctaaatgagtagcagtatatggtttctatttactgccagctccctgtaggtctctggtagaggtttccttgtaacttcagggaagccgttgagctttttggatgcaacaagtatattccttttggcctaatgaataggagattagtgaagaggaaataaccagactgctcttcagctggcaataaggtattcagaactaaccctgcttgcaatgattttccagttccatgtccaccacttaataccctattgctttaaaccacagtatcttttatttccttgtctagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggtaggtctgaggagacagctgtgggcctgagactcgagtgcagggtttgtgtaccatgtagaacatctcttagcaggtagtggagtagggtgttgtgaagaacaataggttacatgtgatgctgaatgtttcatccatggagtctgactcaggacgaagctccctttcagtgtgtggtgacagcagctggaaagagtgactaaatgggaccattcccaggatttacatcactggatttataaagttgccatgacagatagagaagtctggtaatatctatcttaagaattttccactgggagctgagaaacattgaacacattgaacattaaaagacactcaacatctcaaattgtcagattgcttttcttctatgttccatgatgctcttattctcttctctctcctaattgctgcccaaaactcagcaattgtttggacctttgctgtctcagtctggcagctgctttcctaactgtatctgcatgtgctagggtttggcttcaggtgagctgcccctgctcatggtgctttggcattttggttcctagtcttttccagaagggaaaacctaagagctccctgccccacccaaccccccacagctcctgccaagccagcagcactgttgaaaatttaatttctctgtctctggggaggtttattggtggaagaaatttaatcaactgtttattttctcctttggacatgcacatgctatttttgctagtttttaagatctctctttttagtttatgccattattttctaagaatttctcttaagctttggcaattgattcttaggctttctaaagccaagacagtgttctgtgtcctattttgccactaagatgaccagtcctacacctgagctctcatggatttgtgaatatcagatggtagaaagttaatggttatgataggctatttgtgtcttttaaaaagtaaagagcagcaaatatatatgtgtgtgtgtgtgcgtgtgtgtgttttatatactttgctcaggatagtatttcctaatactgcttacctcctagatggcctagggattatgtatatatgtcaaaatatagaaaaattcctttgtctgatagtttgaagaacttccttttggatgactgcatttccctggaaatcaaaatatgaacttttaatttcacctgttttggagaggagtaaatattcagaaactgccctacccacataccctgccttagttaaccaggtctaatgaaccttattagccttttctggtttccccaagcatatcatcattaaatgttaagtaatgtgctgaactgtgatttaaaaaataatgtgaggtggctcagaaaggcagtggggttcttgcttatgacagtctccagtcttgctgcattccttgtcttgtctctttctctgctgtctctccttcaaattgtctactttattgcttctgaacagacaattataaatgggagaagatagccaagctttgtaaattgtcaaccttaattacctacagtaaagagttacagatgttagtctaaggaccgtctactgaaatatggagcccttgaccttatgatgccatcttgcccactcagaagtctttcccttgtatctaggctcccaggtttatatgcgggaaaggagagggaaatgggtttgtgtgactgtgggtgggatgagacaacagtacagacatcgaaattggaaatagctgttactagaaagatggataagaggcctgatcctggatagatggagccatgataggaggaatactagactagatatattgtggtgtgtcagtgaaaataactaatatactgagttttttaccttaatatgccaggccctgaaaaaagcacttttttatgggttagtgcatttaattctcataacaaccctctcttgtgatagtgttagtagcattcctgttttttttttgtttttttttgtttttttttttttagacggagtctcgctctgtcgcccaggctggagtgcagtggcggggtctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcattcctgttttaaaagaaaccgggactcaaaggttagtaacttgctaagctcatctgacaaatttaggtctaacatcagagtccaggctctgaactgccacgttgtgtgcttagagcacagatcctttccttatacactagaatcagcagtgatgtgctggtgagttggctttctgctggggtgaagaaaactttatttgtagtatttgctgatttctatggtgcagatactcccactgtggctggttccaagctaccgatgtgatgtcactgcaggcagcattggggtagatgggatgattaccagctccagcacaccagggagtgaatgagctgtcacaccgctgtgacgctctcaggccttcccggaggagccagtggagctgccagtgacatgtcacttgggtgccaggaggggaggctgggggaaggattagtgcactgcacagccccaccagcctggagggagacacagggcccctttcactacagtttccatctgaaaagccatacagtttccatctgaaaagccatacagtttccatctgaaaagccatacagtttccatctgaaaagtcagacctgggcagggcaggtgggaaatgccttgatgcctttggagggctgaaagcctgctcctttctcctttctttagagataacttcaaagggaacagctgaagcattaacaccttgttacaattttcaacaaaatagaataatgctcttgtgtcatttttttcttctcctccgcacttcacactcccactgctgtttttgtagcaactaattactctgttctttgaatagtcattctcttctttgtcagctgggacttcaccaccagtcactgcagctgcagcgagaggcaggacaggcctccttgaggcaagctgctcctctacccctcagcctggtggttcttagggtcgccaggacccagagagggacacaagcaagggggtgcgggaggtgatgactgtatgtaatacaaacacccccaggatctaatacaaacacaaatggatttgtgtgttcacatgggagagtcattcattttgaaaatgcagcttttaaaatatatataatagttcaacaacaaaaaagtagtacttaaataacatgtaaaagcctgtaatcccaacagtttgggaggccgaggctggtgaatcatttgaggtcaggagtttgagaccagcctgagcaacatggtgaggctggtctcaaactcctgacctcaaatgattcaccagccttctctactaaaaatacaaaaaaaattaggggggcgtgctggcacatgcctgtagtctcagctacttgggggctgaggtaggagaatcacttgacccaggaggcagaggttgcaatgagctgagatcgtgccattgcactccagcctgggcgacggaggtagactccatctcaaaaaaataagaataaataaataaaataacatgtaaaacaaggctctcttccctgttcttggaaaatatgcagaccccttatgaatcgtttccaaactacaatttttttaagagaagaaaggacagggacagtatagcaaactttctgagcccctactaggtgccaggcattttccttttttttttttttttaagtatatatactttaagttctaggatacatgtgtgcaacgtgcaggtttgttacatatgtatacatgtgccatgttggtgtgctgcacccattaactcatcatttacattaggtatatctcctaatgctatccctcccccctccccccaccccatgacaggccccagtgtgtgctgttccccttcctgtgtccaagtgttctcattattcagttcccacctatgagtaagaacatgtggtgtttggtttttttgtccttgtgatagtttgctgagaatgatggtttccagcatcttctatgtccctacaaaggacattaattcatccttttttacggctgcatagtattccatggtgtacatgtgccacattttcttaatccagtctatcattggtggacatttgggttggttccaagtcttgctattgtgaatagtgccgcaataaacatatgtgtgcatgtgtctttatagcagcatgatttataatcctttgggtgtatacccagtaatgggatgtctgggaaatggtatttctagttctagatccttgaggaaccaccacactgacttccacaatggttgaactagtttacactcccaccaacagtgtaaaagtgttcctatttctccacatcctctccagcagctgttgtttcctcattttttaatgatcgccattctaactggtgtgagatggtatttcattgtggttttgatttgcatttctctgatggccagtgatgatgagcattttttcatgtgtctgttggctgcataaatgtcttcttttgcgaagtgtctgttcatatcctttgccaaattttgatggggttgtttgattttttcttgtaaatttgtttaagttctttgtagattctggatgttagccctttgtcagatgggtagattgtaaaaatgttctcccattctgtaggttgcctgttcactctgatagtagtttattttggtgtgcagaagctctttagtttaattagatcccatttgtctattttggcttttgttgccattacttttggtgttttagtcatgaagtccttgcccttgcgtatgtcctgaatggtattgcctaggttttcttctagggtttttatggttttgggtctaacatttaggtctttaatccatcttgaattaatttttgtataaggtgtaaggaagggatccagtttcagcttcctacatatggctagccagttttcccagcatcatttattaaatagggaatcctgtgcccatttctagtttttgtcaagtttgtcaaagatcagatggttgtagatgtgtggtattatttctgagggctctgttctgttctgttggtctatacctctattttggtaccagtaccatgctgttttggttactgtagccttgtagtatagtttgaagtcaaatagcgtgatgcctccagctttgttctttttgcataggattgtcttggcaatgtgggctctttttttggttccatatgaacttgtattttgtatcctgagactttgctgaagttgcttatcagcttaaggagatttggggctgagacgatggggttttctaaatatacaatcatgtcatctgcaaacagggacaatttgacttcctcttttcctaattgaataccctttatttctttctcctgcctgattgccccggccagaacttccaacgctatgttgaataagagtggtgagagagggcatccctgtcttgtgccagttttcaaagggaatgcttccagtttttgcccattcagtatgataatggctatgggtttgtcataaatagctcttattattttgagataagtcccatcaatacataatttattgagagtttttagcatgaagggctgttgaattttgtcagaggccttttctgcatctattgagataatcatgtggtttttgtctttcattctgtttatatgctggattacatttattgatttgcatatgttgaaccagccttgcatcccagggatgaagcccacttgatcatggtggataagctttttgatgtgctgctggattcggtttgccagtattttattgaggatttttgcactgatgttcatcagggatattggtctaaaattcttcttttttgttgtgtctctgcccggctttggtatcaggatgatgctggcctcataaaatgagttagggaggattccctctttttctattgattggaagtttcagaaggaatggtaccagctcctccttgtacctctggtagaattcggctgtgaatccgtctggtcctggacttttcttggtggtaggctattaattattgcctcaatttcagagcctgttattggtctattcagggattcaacttcttcctggtttagtcttgggagaagagaagtttagagaaaaaagagtaaaaaaaaatgaacaaagcctccaagaaatatgggactatgtgaaaagaccaaatctacgtctgattggtgtacctgaaagtgacggggagaatggaaccaagttggaaaacactcttcaggatattatcctggagaacttccccaacctagcaaggcaggccaacattcatattcaggaaatacagagaacgccacaaagatactcctcgagaagagcaactccaagacacataattgtcagattcaccaaagttgaaatgaaggaaaaagtgttaagggcagccagatagaaaggtcaggttacccacaaagggaagcccatcagactaacagtggctctctgcagaaactctacaagccagtagaaagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctacaagagctcctgaaggaagcactaaacatggaaaggaataattggtaccagccactgcaaaaacatgccaaattgtacagaccattgatgctaggaagaaattgcatgaactaacaagcaaaataaccagctaacatcataatgacaggatcagatttacacataacaatattaaccttaaatgtaaatgggctaaatgctccaattaaaagacacagactggcaaatttgatagagtcaagacccatcagtgtgctatattcaggagacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaatttaacaagaagagctaactatcttaaatatatatgcacccaatacaggagcacccagattcataaagcaagtccttagagacctacaaagagacttagactcccacacaataataatgggagactttatcacccgactgtcaacattagacagatcgagacagaaagttaacaaggatatccaggaattgaactctgcaccaagtgggacctaatagacatctacagaactcttcacccaaaatcaacagaatatacattcttctcagcaccaccttgcacttattccaaaattgaccacatagttggaagtaaagcactcctcagcaaatgtaaaacaacagaaattgtgacaaactgtctctcagaccacagtgcaatcaaactagaactcaggattaagaaactcactcaaaacagctcaactacatggaaactgaacatcctgctcctgaatgactactgggtttataacgaaatgaaggcagaaattaaaatgttctttgaaaccaatgagaacaaagacacaacataccagaatctctgggacacatttaaagcggtgtgtagagggaaacttatagcactaaataaatgcccacaagagaaagcaggaaagatctaaaattgacaccctaacatcacaatcagaagaactagagaagcaagagcaaacacattcaaaagctagcagaaggcaagaaataactaagatcagagaagatctgaaggagatagagacacaaaaaacccttcaaaaaatcaatgaatccaagagctggttttttgaaaagatcaacaaaatggatagatcactagcaagactaataaagaagaaaagggaagaatcaaatagatgcagtaaaaaatgataaaggggatatcaccaccgatcccacagaaacacaaactatcatcagaatactataaacacctctacgcaaataaactagaaaatctagagggcctcgggtctttatagccacaggatgggggcgtcatgggccagggttgtctttggaaatgcagcatctggacacaaaggcaggagtgcctgtcctcatcttgatccgtgggggtggagccctagccagggaccactccctcctctacccagctcttcccttccctgcttcatatcatttaaagggaacatgctattcccttcccagcacttccgtatcagcagcttcatttttattaaaacagcgatgagaatgaggctgggagaagttcagttgctgcccaaagagtgaacggaaccagctagcatgacagcctgatggacacagtcctggtagacttcactggaaaacctccctggagtgagcaggccccttatgcaggaattgcctgattctcacccccctgctgtcacccctctgcagtaggtagccagcatcaatagattagtgacctctgtgacctctgggtcttcaccgtcattcccgtgacaagatgaaaagtacctggatgaacagactaaattgtgatgttctggatggtattgcatagagtggtcaaccctttattctgttgagggccactagcctatagttcttaaagaaagcaattaagggccattcaaaatgacaagctaaaaacaaacaggttacataagaccaaattacctcttaaataagaataggtcacagcattttttcttcattttaaaaatccagtattttaaagtgctaaagcatactgctttagagtgaagagggcaattagaaatcatgtggttcagatctctcatttttcagaggaggagttttgattcaaataatttatgtgtttttttccaagccagagtcacatggcttatagggaccaagccatcctcaaacataaaacttttctgactcgtgagtccagtgttgtgatgttctgttcaatttcctagtcaaccatttctctatattccacagggtcttaaggaaaaaggagagagttatgagaaataaaagataaaagagaaagaatacaaagactgaaaaacagagtaaggagatggagtagcttttccattaatttagggtttcagcatgtcacctcttatcacgtttagcattgacattgtaattcctgctggccatagccctttaattgggttttataaaagttgttgaattttccttggagaattggaatggtttcgttaatggctaaaataagactaacttacacagtcttacctacatagtatgtattaattctgtgggtttaaatcctggctttgccacctgctggctgtgtaaacttgggcaggttaatctctctaggcctctatttcctcctctacaaagtggggataatgatagcatccacttcatagagttgctgtaaagtggctaaattcgtgcctggcccattgtaagttataggtattattagagttaccgttcatcaacacagaattttacttagaatgatataataaaaatccttttatgaaagtttatgcatagcattaaaagccagtttttaatctgtattcttcagtctgttgtatacttcttgattctacataacgttcttctgttttgcagagttaagtaagagaccaggaagccagtgatggttaccctggccacaaaaggcaatcagaaatggcgagtagctgaagtttagctctgcagaaccttctgtgcttattcattgtttatgaatgaatcttctctctgctcagactttatcatactatatttggccaatgtgggatatgaagaaagtttctagttatatgttatgagtggtggaaataaaatgtagactgtggggaagacagcgtctttggccagagaggccttctagccagttttcatactaaatgttaagcagtttaaaagactattccaaagagtgtttgaagaaacccaaagataaagtaacttgtctgtttgatattatgttattgctgttattgtgtctgttaccattatcattatttattttattatctgcctgatgcaaaatggacttaaaacagcctatgaaagtacttgtgagctgggcacagtggctcatgcctggaatcccagtactttgggagaccgaggcaggtacatcacttgagctcaggagtttgagaccaacctgtgcaacatggtgaaaccctgtctcgacaaacaatacaaaaattagctgagcgtggcagtgcacacctgtagtcccagctactcaggaggctgagatgggagaatcacttgagcccaggaggttgaggctgtggtgaaccttgatcacgtcacagcactccagcctaggcgacacagcaagaccttctctcaaaaagaaagagaaagtagttgtacagtattaaaatagaagcttagctagggaattggaggtggaagaggtagtagtgaaagcaaaacatggcctaggtgaaaatttttggaaagttggtgcccaaaatacataataataaagttctgtacatgtgctggttcctagcagccgacagaaaggggcatagatggtgatgttctttgagtttacaagttagaacaagagcattgctgaggagaagcaaagatagtccagattttgagcataagtgaaatttttccatgcattattataaattttagtcaatattcctttggtaaaatgtaatatttttgcattgtatttactgatccagaacattagatctttataatatgccttatttagtcagaaacgaaaggctgtagtcacaaatgaaagactctaaactataccacagtgtattacctctatgaacaaccaaaaaagggttgcagtggcatatttttgtcataaatatcagaatcaaagcttgaaattatatcagagcctaaagtagtattcgttaatattagagaaaaggttctattagagaaaaggttttaatgacatagcagtcattaactactaaaagtaatgtcaaatgtgccataaaacaatgttttacagactgcagaccataactctcaagtagatcatcaaatcaatttaggacattgtgcccagtgtatttttggatgaagtgtattcagaatacagcaaaatggaagacatgagaggaaggatgcacatctgtgtgtatatatggtggtgctgtgtcccagtgtgaaatgtatgtcttaggttgtcatccagaaagtgtgaaagccattgctattaaagcataaaagggatagagtggagccttgggcggagggtcagattaaggtcacccttggcttttgggacatttgggggactggtaaggaaaccccaagaagaaagtactccttggagacgtgggctatgactgagtcaagtaaggatggcagcagacgccattgctccttctgagcacatgctccaaaagtggcactttccaacaacaaaaactctactgaaggtgggggagaagatgcattatggaatacacatttgaaatgtaaggagtcaacactgagatatgtagacaaggtcatgaaagagtggcaccttccattgtccttattctcctgccagccaactatgtaaacccttccactttgccccccatctccatgtctcaccttccctccccgcgccttcagcctcatccacgtcaagaccaggcctttggccggacgccctttgggcctgcactgtccaggacaggaggcatgtggctacacagcacttgtgatgtcgctggtccaaagtgaaatggtctgtaagctgctcgtacaccctttcggagcccagtcgcaatgtgcggtggcgggaatgtgaagctgcgcatacaccctttcagagcctggtcatggtgtgcagtggtgggggtgtgaagctgctcgtacaccgtttcagagcccagtcacgatgtgcagtggcaagtgtgtgaagctgcttatacactcttttggagcccagtcaagatgtgcagtggcaggtgtgtgaaactgcttatacaccctttcagagctcagtcactgtatgcattggcgggtgtgtgaagctgcttgtatacccttttggagccccagtcatggtgtacaatggcaggtgtgtgaagctgctcgttcacccttttggagcccagtcacgatgtgcagtggcgggttgtgaagctgctcatacaccctttcagaacccagttgtggtgtgcagtggtgggtgtgtgaagccgcttgcttccattgagacttcatgctctcaggtatgcccccgtcatgctgtcctggtggcctttcctcctcaggtctcagtagtctggccacccccagggtgtccgtgggtcccattgttttttaaagactccatatctcgcactcaaaaagttgggattgagtaaaggaaaatactattataatacttccttgggttctggtttttgaaaagaaaataagtactagggcccaaagattgaaaggtggtttgaaacagagggtgaaattgtggatccatttttaagtgttaatgagaatcaatgtggttccaccagcaagaaaaagcagtatccattgtgtttctccctgtgccttgcccctaataggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggtaagtgtgccttcaaaggtttgctctatctctctctgccccaaatgtaagtaacacagacccataagcactagttttaggccttctcatattttactagaaacaaagaattaaactgaggtgcataccgtagtgactttcaaagcatggtagtgttccaaagccataaggatcaacagagattgattctagcaaagccttcagctctgcacactggtatttgtgctttgctctttaatttccgtgtgattatcaacagacgtcgttactgcatgcttagtggccctgtggattagaatttagcagactctttgaggtgacagtgactgtatatcatccttgacagtcttcatcattttgttccgaaatgatgatataagagcaacagaaggcaggtttttggttgaataactatgtttgtgtcactttattaataaaggattatgcggaaggaaaactagtataacacaaacatatttttcactactctgaaaataggaaagaatagtgaagagaagacgatacgtggagatacgttaaaacacttagtcctgagtaaagtaagccagagggagagggactgaggggtcctagaaagtaagaaaccaaaggttgttgttaaattgaaagccatagagagttccctcccaaaaggtagtgggttaactctgcctttacaaggttgccctagcacttttgtctggagttaagagtaaactgcagcactttgaactagagtccaggcctaaaattaaactagattaagtgctttcaaaatgggaatagaagttggctatacagattttaagtaattgcactataaatttggttacctcaaatcatgtacactaaagcagtttaattgaataatctgctagtggtctgctagaagtcatcaacttcttttttttctttcttttttcttttttttagacagagtctcactctgtcatccaggctggagtgcagtggtgctatctcggctcactgcaacctctgcctcccaggttcaagcgagtctcctgtctcagcctcccaagtagctgggattacagcgtgagccaccacgcctggcctagaagtcaacttctttctgtccatccactgtcctttccccatctcttcaggattgccttaatcacatctcagaatgttgttgtgaaaacccttagacctggggagaagtctgtattctgggaactgtgttggggagaagggagggtccatgtggaagccaaaacatgagcctgactcatctgagtggcaagaaccaggtctggcaggagcagggtgctgaggaaaacggttcccagatacacgtaaatcatcaccgctccagtttggaagcagagagcaggaagatttagaaaccacactatgaagtctttatcttagtctgacttttgaactgttgcataaaacattgtcacttaactattttaggttactaggataccatgtagaaataatttaataaaaacagacaaacaatttaattaaaacagacaaaccaaaaacatagtcatctttctacaacttctcatttcatcctggagatctgtttacagagccttgctatttatctcaataaaagtttcctctcccatagtggccccattaccatctggactcctctctttccttattttgaggaggaaaacatccaagagacctctgagtaaattctttttttgacacattccagacttggctgcctctgaggtgtgtgctaactggaattcatgatttggcccacattttgaaagatgaacctaggaaatcactgtatagagaaggaccttttcccccacctcagtgctgttttctttctctccagaacaatcagcaggctttcacaagtgaaattggctttgtgtaatttcctttatacaatattccatttgagaatgtattttgattccatgttgaatttaatttctgcaacagaaactaaagctccttgccagtcatactgaccttcaaaagggaaaatattttttgtagctgagtatcatatttcgatgggagcagctttcagtgctagagaatgcagaactccattttttccagatgtagatccttgagttctagaggtaatttctgtgtgtacttgtgtctgcctttcttctttactccacccagaggaaaatgcatctcagtaagtgcgccttctagaagaccattagagtagcttgtgactctctaagctgcagaggtgaaagggccataggtggggctgacgaggttttcaggaaaatttaacctctactcactgcccccttagtctctggtatatattcagtacactagactaggatttcagatcttaggatgcagggcttagatgacttgtgagatctcagtcctacagtttccaggatattaggatgatttggctcatcttcattttgaaatatatggtaattaattggatggatattcttcttttatgaaaatttaaagttcagtttcttaccccatcattcctaatttttagtaaaaaatatcttttaagttttaattttgaggcataaagagaaggtactatagattgaatatcttaatccaaaagtctgaaatctgtaatactacaaaatctaaaacgttttgagcactgacatgatgctcaaaggaaatgcccattggaggatttcagatattcggattagggatgctcaactgcaagtgtaatgcaaatatttcaaaatccaaaaacttccaaaatccaaaacatttctggtccaaagaatttaggatacgggctactcgtgtttgagaaagtttgttttgctactgtgactccaggaatatttgaggatagagcagattcatgagttttatcagaaatacttcctcagtccttcttgagtccccagatgcataaagttcaccttagaatataatttccttcatgaaatttagtaaaacataactgaaaacttaaagcatcccctttgtagtcctactgagaacaaataccttattgagatacagaagtgaggagtaccggggcacccctcatccatctgactctcccctgcataccagcgccgtcctgagtgccatttacaatttgtaccttgtactcaccaagtataatttggacctttcagaggaatcataaatcatgaaaataaatgacagggtctgccagaccttgaatcttgccttaccagtaatggtgtggcgtaatattgtgactaaagaatgctttacagttgttcattccattcattttttctcctgtaggttagggaaattgtgtttaaccatagagaaaccagctatacttaagctcaagttagcagccatctcaagtctactcctccagtgctccccaaatctgcccacttaagtaaccatggatggatccaacacagtccattttgggtgaaaacactaatttactgcttgtagaagcatagtttttctttaatttgtatgtagtatcccagacttaaaggtcattaggaacaaaaaaaataaatctgcataatatttttcctttaatatcaaggtcaggatttttatgacataaaaatgttggtgttttgagttttaataaaaattctttagttggatgatgttctttatacatagttaagagaaactgacacagtaagaattgataatccatttggcatctaaatagaataaagtctaatttctatttggtttaaatatatgagttttatgctctccaggtggctttctgattacagaattttacagtatttgtgagagtagtagttattaacaattaacattcgttcaacagaaataggtaatatgatacggtcactattttggcctcaaatttacctagagcttaagggtaggattgaaataaaaattgctggctgtggcacgctgaacttgatacattactgtgtttaaacataatgcgggatcagcaataaaaccctgatctgtgttaatatgcttataaaagttgagctatttgaggggctttggataaacaacagacatcttagcatgtaaaatgattttcttttctcctttttttaggctggtattaccagcctttatgtaaatatttgatgttagagctcactgaacacttggtacttctgagttttacctggatgtcattgttactccccttgagacccctgcacttaactcttaagaagctggatggggggccttttttgttcacgcagttatggcagctgcgtctgcagcctccctccctccttccttacagacaccagcaccatatagggtgtgaatatggtggaaacaaacttaaaagagttctcctctcagagagcataatagtcacgtgaccattcagtcttgatttttaaggaaatactttttaagtttgttatatcatacaggatctaagctaatcttccactgtgtcattttctgctttcaaacaaaacaagcaccatttaatgtttactcttcttttgtttagaatattagctgtggttagaagcctcagacttgtgctttccaaatactggccccctccatcacagcttcgtgccttgccatgaggatcctgaaatcatgggacttttgaacttcactgggaatgctccagctaggtccccattgcccattgacttccatatttcttttcatttctttaattattttttttttgtgacagggtctcactctgtcgcagtggcattgatcttagctcactgtaaactcaaactcctgggttcaagccatcctcccacctcaatctgctgagtaactagtactgcaggtgcacgccacaccacacccagcttatgttttgaaatgattttttttatagagacagtgtctcactctgttgcccagactagttgtaaactcttagcctcaagtgatcctccctcctcagcctcccaaagtgctgggatcacaggtgagagccactgcacccagctaacttctacatttctaaagcttctggatggtgttaggtccttagcttatttgataccattcactactccctccttcttcaaattacatttccttgtcttccaaaaggtattcctgattttttttgtatcgtcagctctttgcgcctatctcatcaccctgaaatttgtgttccccacttcttcctcatttttatttgaatcccacactgtgcaattcttctagaaggttcatccacttgagcaacctcaactgtcatctgtatgtgggcagttccttagctgatctgttttgccttggtctctttttcacttttcatattcctgactacctactgaacatatgcacttgaaaggcatgaaagtgtctcacattcacaagttcaagctgacttgaccttcacacctgcccctccttctgcctcttccgtctcgtgtgttacccaccttggtggatggctttgccatctacctgagtatccagagcagaagtaggattcgttatcaacttcccctcagcactatcatcccatctccacacatgttcctgccattgcctgagaagttctcatttcgcactaagtttcttttgcttacctaaactgttgccaacagcctctaggtatgattaccagcctcccactggaaggatgacctaataaaaatggatatactcctcaggctgtgccttttcattatagcccttccatagttccacacagccttcaggatcaagtccaactcaccagcaagtttgcctgtgttggctgggtgctgtggtttatgcctataatcccaccactttgggaggccaaggctggtgcatggcttgagtctaggagttcaagaccagcctgggcaacatagtgagaccccgtatctacaaaaaataaaaaaaaattagccaggtgtggtggcacatgcctgtagtctcagctacttgggaggctgagtgggaggatcacctgagcctgggcatttgaggctgcagtgagccgtgatcacgccactgcacttcagccggggtaacagagtgagaccctgtccctcccaaaaagtttgtctatgtggacttgcctttcccttttcccctatcatcgtcaccacccccatccctaggcatgggagtggctctctcctctgcaagcactatgttccccttgatgcctttttaggagctcctctacttggtgcaccttccactccttcttttgactgctgaagtcttgccatgcctgctcctctgacaagtcgcctttaatttccccaaaacactctcctcccatttctaccttaattgcctcactaggaatgttcttaccaccacatggcttcttcactcacaaaatttatgaaacttcgctttaatgttatttgtccatttctttaaacttagcctgtcttattcatctttgtattccaaataccagccacagactctggcatttaataggctcccaatgctttttttaagaagagtttcctcaacttagtgtgtctacacttcacatggtagtccagctttccacacgaagagtttcctctactttccatttgtggtaatgaccctttaataacaaaagggcttatttaagtaactggggacagaatttaatctatcttggagaaaataaaccaatttccttttataaaaattagatgataggtaaaggcaaagcacttgatagtctgataaagctatagcattaaacatagatataagtagaattatttggtttttgttgactaagtttagaatacttcattttaaaagtatattgctggtagagcttttctaaaattgactcaaagtgaaatgcaagatcttgattgactccttcaaaaggttttagttggaactgaattctggtggtgtatttgtcagccaagacaagggagaaaagcagagggccgcatttgacttaaagtgaccggactctgaaggctcctgttttccactccttgcaggaaacagcgtactctggcatccatgtcaggattagagttgatgtgatttgcaagttcacatttttagatgatactgcaacagtggttcctattcaggcattcaggaaatgggcacaatggcttcagcttggcacacctcccagttccccatcgtttacaaactccagagtggcccaggaatgggaggagaatgctccagtactgtgtccagctccagctcttcagttacttactcatcattccttgggcctcgaaagtagctattctgcactcaccctagggaaatgtttccataacggcttcctctctgcagggccacctgtgtattagtgtgacctgcctggaaattcctagaagcaccaggagggtaggctgtgctgtccaggggccatgatttgcatcctgcctacgctactgggagtgtgtggcagtgggcaaggtcctgtccttctgcactttaacatccccatgactcaagtaggtcacagccccacctcttagagtctgtgaagattaattagggtaatacaggttcagcatcccttacccaaaatgcttgaaccagaaatgtttcaaatttcaatttttttttaattttgcgcatatttgcattgatcctattggttgagcatcccaaatttgaaatccagaatgctccaatgagcatttcatttgaatgttatattggcgctcaaaaagttttggattttggggccaactgctgtggctcacactggtaatccctgcccttggggaggtcgaggcaagtggatcacctgaggtcaggagaccagcttggccaacatggcgaaagcctgtctactaaaaacacaataattagctgggtgtggtggcgggtgcctgtaatcccagctacacgggagggtgaggcagaagaatcacttgaacctgggaggaggagatcgcagtgagccgagatcacaccactgcactccagcctgggagacagagcaagactccgtctcaaaaaaaaaagaacaggattcccatgatctagtctgaacagctggtatgaattatgtggttagaaagccagcagtaactctgttcacaaagtacacaacaggaagtgatgaaaagacaggcacgagttgcttgaagttgaacacaacttgttcaaactactccggttatagcacccaaattacatcaccttgaattgttgtagagatttttcttttttcttttctttttttttttttttacataattttggaagaatcctagttgatatacatggctgaagacagaagactttaacttggtcctgttccctggttggatagcaattgctaagttgtggtaaaatgctgtgcttaattatggactcaagcatttaatttgtccatcactgctgctgtttgaagtgctctcacttgtttataccaccagctcactgtttgcacttgggttactgagggccttatgtccttgtacatatctcatgttggaataaaaagtaagaaatagaatagagatttaattaatcttacctaatcagttaggaaaatattttaccatcaacttgtcacttagaattccatagccataagttgataagttgtaatcagtcataatctggagtgatcagtttaataagaatctattaatgttggcactatatatgtcgtcctgtgagttgattcatggaataggtgtggtggaggacaggggtggttgtgttagaaatccgtgtgtgtgtgcgtgtgtgtatgtgtgtgtgtcagctctcttttttagcctggtgtgcgactgcttctggaagaatgaaggacgtatcttggaccatctcttcctaaatgtccaaccccttcaactctctgttttcactgcagtgaagtgcattgcatataaatgaaaagctggtgtttagtgttaagtgtagtcaaaagactgtggaagtaatgtctctggatggtgatgatcatgactttttcaattgcgcattcttagtacaataaaaaaaaaagccctggtgttttatttcagcagaaggaagccccagaggatgtttagtatcagttattttaaaaatgtttagttatttcttgactaaatttataaaaatatagagaagaaaatcttctgaaattaatgctaaaagatttacagaattcctctctgacagtgaccagagcattctttaaaaagaatattgcctgtattcaacagaatggaaagatctcacagcaattgaaagaggtattaatctttgtcctctaaatctgttggggcattaacatcagacgtttggggctctttaagcagaaagatctggatttatctcaaaagagaagaaaagtctcttgtgatcttgctgtaacttcactggactcagcagctcttaaaacagagtacgcttgtaaggtggggtgggatggacagagatccaggagatcagtgtgctggttttcctatgtgagccaatgtgagaggtactgctcccagttcttgaagcacctcttcaaagtggcaggatagcaatcagcccatcttccaataacgatcagcctcaggctatctcttcagaagtggactgccagtacccagacaggcggcggtggcttccactctcccactaggtctgttctcaaataatatttgtgtgatagtatcaaattcagagtatttggaaaaaatagtaagtcatcagaataagggctaattctgaatttttctttgcctaccatacatacatctagagtcataaaaacatttgggtggcattccatcagttgctctatgtgtgttctatgtgtgtgaacagtcagaaaacaaagccactattgagttatataaatgcaaaagagggatgggaatgaatgccagccttctggaaatgctattttttcgctttgggataactccagtaaccaaatagaattttctgatacatttgccaaataagaaagctgaggttgagaactagcctgcgatatcttagcttaatatacgtttggagagcagggtaagaaaagcagcctctaaatacaaatgtaaaggttacatcttgacttttcctttggaattatgttgtaacttcctcatagaagcataaacattttaacgttcaccgtaaatatacttcactggcattgcttgtttacccctaagtcaaaaaatcatcagacccctacacgttgcattaatcttcactgggttaacattccactgctgtctcctttttttctagttttctgtaacacctcctcccctttgcagtaagaaagtcaaagcagctatgaagtgaaactctatttgaagtttctctctattaggtgtgtataagagccaaacacttcaggttgaaaggaatgtggtattttgttatatttggattcacgtcattccttaagccttacttggttttcattttcataaccaattcctcctattcatacccctttcagatcaccttacaattaattactttagaataataatgagaaatttgcaatatgtctcagtggaaaagagtaaagagaaacccatgttatggtacccagataaatgtcttgatcttctcttattaaaacacattacctgaagtagaaatgagctagtatcccactagtacgtggccccgccatacctgccccacgcatacactactttgagatctggcaacctaattacagtgccagtgggtgattggcccatatttctcacagtctgtatagcaacagcaagattgatgatgataacaggaagactttagaaaccctgcttctttcttctcaccacatttcccgaacactgacatcccaagtctccctgtttaccccatttcacactagttagaacaggcattgtcctaagttctctcaccatcatatgtaagatggatgatactcacatgggtgtctgggcttaggtgtaattctatcacctgtaactccatccctttttcttgcattttagaaggcatattaactttcagtctgttacagttgcttttattaaattattcacaaattttggcacttcattattagtgaccaactgttgttcaagtgatctagccccaccatagttgagaactcctgatttggggcatctgacataactatggtacttgtcctgaatcccccttctcttcttcattttctacaccactgatagggattctccttcattcaaaacacatgttaagcactcagaaatgtaaagataaataaggctcagtcctggccccttaaagacagaatcttaattcacattaagggagacacacataaaataaccattctgtatgacttggtgtaatggtgcaaagaacagattgtcatgggatttgaggagattctaatctatgaattcaaagctatgatgttggcatcaggcctttttatgtgagtagcaaaggaagaaggcattccaggcagagagaaaaagatgaataatagtgtgaatgggcagagtctgagaactgggacaccttgactttctctagaatgtagggtgtgtggagccattaatggggatggagatgaggatggggtttggtcagatggttcaaggccttaaagagggtctcagggatttggtcctctatcctgtaggcaaagggaagctttgaataggcttttagcagtctgttgacttgatggaagagggtgggttggggctgctggaggaatggggtggagagagcctggaagttgagagacctgtcgggacacttggactgacccaggctgcaggtgagagaaatcagaagcccctcagcaggttggaaactagatatcttctttgtctttgtgttatcaggaccagcaccaggtgcctgacacacagtttgtgctcagtaaatagtagttgaacttaattaacccaattgactgtggaaagtaaagacagaggaaggaaaaaaatggcttcaccatgtttagcttgactagacacatgacttgcagtcacaagttgtcctgtgaataaagccattatgtggtaccaaaaaaaaaatgatgtttatcttgagataacaaatataggaagggcagtttgcgttattggagagtgggataaaatgtgttagtcttgaaaaggtctgatttggattgctggtgaaaggtgtccagtcaagatgtttaggagagagccggagacaaacctgggctctcaagtcagatctgcctcttgggcatggattaatttgggagttgtaccttttagtatctatccttattctttctctattagcaaagcttctcagcttcctatacctgaagccccatcctgccctactcagaagataaataggttcactgtgggacagggcctctgccagtgaagcagcttctgtctcaagacgtcaaaactttgacttgtcttaagatagctttatgtgcaaagttgtttgagcatgcaaacccattataaactgtcttattaaaaaaacaaaaaaaaaaccacagaaaacaggccttctcttaggggacagcagtagtttagcatggagtgcagtgggcttagagtctagagacctgacttgttgtgaacttgaacaatgacttagatttcacttcctaagttataaaatggaaatgacctcccctgctacaagtagtcgagtgatttgtgccagcatttgcttctgaaataaaataccatcgttactaagggttagcttaaacctagtcacaactgtcagcacagcgtcacttactcatatccctgtggttgccgtgttgcctactagagtagaggaggtagagggtaaaaaacatgtctgtcctgaccacaaagctatggtttctgccttgacagccagttggcagtgtgaaggacccataactttaaaaacagatacatgaggtgcccatgtggagcacacttctactgtgatattatatacattcagtaattctagttaaattcaacaactgcagttttagacattttttcatggaggtttttatatagtgatactactaccaaccagaattataaatactaaatagcaaaatctgaatattcattccagagtgtgaataataaaattggaaaacaaagaagcatacaaaaaatgtaccagtgttactatggtcatatactctgggaggactagtgtaagaaattggaattaattgctatgttaatgtcacttgggttcaattatcttctgctctgccatactaggaaactgcataagtaatttagccaattgaattctggcagcttttggaagcatacatgttttctagatcttttttccccattattttgtgacacccacccccaccccctccaaggcagttttccagctgttcccctagggagtcattttatggggaagtttcttttgtaggcttccagctggcttcattttcactatctccatgaagtcactgtttttgtcacatttatatgatattatccatcatgcgttgccttgggattttccctttgaattgttgacttcatgtttttgtattgcacatgcaggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtagttatgcgtttgtcccattgtacatggtccctgttggcatcatttctttcatctgtactcagacatgtaaaatgacttccattcagccagccttgatcaatttgtagacaaacaaaagagaaaacgtagttaataatccagatagaaaaatggcttcatggctggtttaaactacttcttaggaagtttatcatcctctagcctctacgaggaactaaatggcaaagaaatcaaattgcattagtttgtccattgtatatattgtttagtttcacagttcagattttgtcacttcttatttactccaaagtagaaaaaacacctgtacaagttttaggatgggaatgagaggcagttaagaagcaaaactgtttaaaagacatagggcgtgttctaccctccttggagatttatttttggaccacacactttgaggaattctgaccaggcagggcaggtccaaagagagggccccggtaaatgaggagtttggagaccatgtgggagaaagaactgaggatgtgcaagctgaggatgagaattatggaggtaaggaggccacagtagctttcttccaggactcttagattagggatcaaatttgtctgtgaggacaagtgaggccaataaatgaaagttatagagaagaagggtccagcccattttgaggaagatatttcaaagctgtcagcctgccctggaaagaactggatggcctcatgaggcagagtccttgatcactgaatgtgtttcatatgtcagccaaatgattacttaaaactccttcaaatctaactgtgactcttaaactactaaatgcttctctgaacaaagaacaattaagttcttcaaaaacagcaccaagtaaaatttagaacaagttttatcttagctcttcaggactgggtatcccttatactctggcatacaataaattggggatagggggcatacatgagaaatgaaattaaaagttcatcagatgaaaatgttttccaaagcagagtttaaggatagttttaccttattgtttatttaaaaccagagggccagaaaaatgtccagctttaagttcagaggtttaaaaggttcagaggtttaaaagtttacactgctaccaaaaaataaaagcaagtgggcactgtggtcccatatacttgataggctaaggcaggagaagatccgtggaggctgggaatttgagtccagccggacaacatagcctgtctcttaaaaaataaaaaagtaaaagcatgattagaatccatttctaactggcatctccatgccttttaaaaaagtcttaatacaaatttagaataggatcataaataggtatatttactcttatgaatgaaacaaggacccttagggaggagatggcaaaaagtgtaattgtgagtcctttttttaaatgaccactttaaccaattagaagttttcataaatcaaggtttttatttttgataagtgctacatcagtatgtgagatagctttgcttagtgagccttgtgatggggtatgtaaatgaaaagcatttgtgaaacagtaactggggggatgatataataagagttttattggctggtacggtggctgtcgcctgtaatcccagcactttgggaggccgaggcgggcggatcacgaggtcaggagatcaagatcatcctggctaacatggtgaaacctcttctctactaaaaatacaaaaaattagctgggtgtggtggcgggtgcccgcagtcccagctactcaggagtctgaggcaggagaatggtgtgaacccgggaggcggagcttgcagtgagcccgagattgcgccactgcactccagcctaggggacagagcaagactccgtctcaaaaaaaaaaaaaaaaaaaaaaaaaaaaaaaaaaaaaaaagttttattaagataagtgtttttctagccccttctactttgcagatgctttatgtagatttttctccttggcttcttataatggaattgccgttttacacataaattgaggcaaaaattcagtgactttgttcagtcatattggatgggggttggaacttggccccaggtcttcctattgtttatctcctgcctttctgtgcaccacttcctggttttacccatacatgtatcagcctatagcaagaagacaccccacaagcatcagttcatccaggcccatctcaagccatcctcccacctcagcctcctgagtagctgggactgtagtggccaccacaccaggctaatttttttttttttttttgtggagcctggggtctctgttgcccaggcaggtcttgactcttgtcttcaagtgatcctcctgtatctgcctcccaaaatgctgggattacaggcgtgagccactgctcctggcccctatttggtcttttattatatggattatgcataaagttcattagtaaccacatatatattagtaaatttccatatgaatgtttaaattctacactctggcactttttcatgggctcagtcagtatttactttgttgatattgctagtcaaggcatatgctttaattaagcatgtattattattttacaaagggaaaaataaaactggctcactaaatagctaaatgttctttccagaaataaacatttgcctttattttttgccagtttacctgcttccaaattgcccttcccaaaggcagtttaaaatttatacagtttgaacgtggtttctacatgatctaaatgatagtaatctttgtatttcagaccacaaagcaagtactcagaaaatacttgttccaagaaccactgacttaatgatttagtaaactaccaagttaagagaaacaaacctccacagtataccatttggaagatatatatggaatattaatatttagtttgtgaactttttcttttggctgtgagtaagtctgaacttggctgtacgagggcttagaaaattttggtttcttatactacataccttaggttagctcagtcctaatggcttccgccctcattgttacaagtttgtttacatagcatgcatacctttttgagcagagtggtgtatattgaccacaacatacacatttccacacccacgtaaacacgaaccagggtgtgtatacaagtacagacacataagcaaaaaccagtagtgcctgtcattaaaatttagttcattacacccaggactgccttcccctcatgggtaaggtccctgatgttgtctttgcctttgcggaaatcaccacaggtttggagtgagccgtagatccccagcctccattgacaggcagaacacccagtcagatattggtggcagcggaaaatccacgcctagctggcaaagaagtgaggatagcattgctgaccagatgggtaagtaatcaatttctacaagaagaaagttgcttttacaaggtgacttaggtcacctcttgatgatgttatcaaaacattgttataaaaggtagccctagttaataaatatgaattagaattaagtctctgttagattatgtataagtgaaaacaataaataagacctaagagaaaaggaattctaagtgaccccaaattcaaaactggaaaggcgataggaattattttgagcacctagattaaaacaccagactaccagactaagtaccttcctcccccttgtttatttgtttttgcctagaataagtgccttgagagattgcttggtatacttaatgtcaatttgaaaaacaaaactactaacaaagtggaaaagagatacaattattgtttagtcacatccgtagcttgcttagaatctctttcctccctgatgtgcttttaaaaaaaattcttctcactctgctattaagctgtcagctaaggaaatgtcttagcagtatgaaacagctgggtggaagagatttgcattggtgagcttgtgcccggatttctactgcatagccctttctttctatatatatgttgtttcacagtgacaccataacactagttgatacaataacattttgccatgaaacaagattttcaacacaggagcctcagggatttggtaccaacacagttggtgcatcattaacttgaatctagattgttagactgttggattttttcctcctttgtttaatctctagttgcatcagtgtaggataaaaaggtgtacatttcagggctgaaaaagataatcttataagacaagacccatctgttaatcttctctgcaaattcattgttttgtcctgttttaatgactttgcccaagtaagtgtactaaccatggacatagaaaggagtggagatgtgttccactaagacaggggttgaggaagagaaatggagttcctaggttctgaagatatgctttgttccagtagcttcagtgagatgtgccttgttattgaagccatctgtcattctccactcttatcctacccacccctacacagaaaacctgagcatattctgatctgcttttctactcttgacagaatgttttaaatcccatatgttttgatactgttgagatggtaacgacacatgtgaaaaggatcccttcttcagcatgactttagcggctttttttggctcctagtgcaggctttgaacaaggctgccagcaagccctttgtgaggcatgcagtgtcatgcctcccactctcgggaagtcacacggagtgagaagggatggaaagggtaattacaaggttcttcctagacccctgttcattctctcacacaaacctccctctagtctttttttccctgcatccactttactttagtggcatcccactcttaatagataagacttaaaaatgaatgtagatgaatttttaaaacctatttgctcatcttttttgtaaggtatactttttttaaaataagatacccctgaagcctgccaaagaagccttttcactacagtacaagaggtccaagtggtggcctttcaccatgggaaatccaacccttcaaataaaatattaaaataatttttaaaataatttttgatatcccagcattccagaaaaataaccaagcctttcctaactggcacatcagaaggaatcagaaggcttagctggtataagccattccagggagaagtcaagaaaaataattgttgcatttttattactcagtacccaatattgagtatataatgggctgaccattctctactcagtttataagaacagcattctctaatgacttgcactgattgagaatgtttacgaggttcttattggttaggcatcagtgtgttatcaacaggtaccctcctgacagtggagacaggagtttagcctactgacttggctcacttatctttatggctgttcacttttctgcctctgcttttggaaatggttgagagtcagagtcaaggagtattttgccctgtcctctacatgttaggaagggtgtttcagaggcccaggattcttgctattagctatagtggtgttatggaggataaattctttatctctcacttttggaaccccatcttgaacgccagcttggagtccaaaaggaagcaattgttttaagtaaactagttgctgtgtgtcttttctgttgtgctcagcttacagttatagaggacctcaggatttcaattcttttgtcctcgagcagcatgaatatacaggtaaaatatttccaaagtgtcatggtaagtaacacgtgattgcatccatgcctgtctaggtaatgtagaccaagctaggttagccacacttggcaatgaatgaatttcataaatttaattcatataatctaaatttttcccccaaaccaaaagttgattctgaactttgctgcgttgttcatggcctttggtttggtggtacttggctatgctaatgtgtatgacgtgacaagttgtcaccagctgcaagctttatccatcagccacttaagtttctgacctgctgtctatcaaatagactcttaacaagcttactgctgaaatgcagagtttgctggtcagtgaactgaaagatgcaatggcaagccatcttcatttgtcaccatgtgcttgtttctgcttagtgcctgcaccataatgtcctatgctgtattccagagccaacatgccatctcccagcagtatcaaaggtactgccagctttccgagagagccccagtgggagattaatgcggcaggatccagtggttcatttgtctccaaacaaacaagggcatgtaagttaactgtaaacttaaaaaagtattagattcctagcagtgtaccttccttgcactatgaaaatgctctgctctttcctctgcatggccaaagaggaaatcattctggcaaagagtggtcgtttgctgccatggccttgcagtttctgctgccatggcctttagattgctttgagataaattgtaactcctcattgctgtgcttctgccacccccacaggtctggtcatctgattcagtcactaacaatcctgaaatgttaggagtggaaatgtgttagaagttgattttatttgcttacacaattgcaagcatgagatgtggttggagcgtcagtcctgctccagccatgagagggctccagcaggactgatgctccaaccatatctttgattctgctgcagtaaaggaggtgtaggagacagacagcttcccctatgcctcctctaccgcttctcttgtctttcatagccatacacatttcatcctttcgctatagtaatacacaattccttctcacttacagtaaaattgggaatatgaggttatcattctccaacccccctcttatttttttccccactcttcttccctgataccgctattgggacgggacgccctccccatgcagttgatttccttggtgtgtctgttcactggaatgtgtatgtttatattcacgtcattctatagaatgaggaaatattgtatttcatgcttactagttcactatggaagatgcccagagaactttaaatgagagatgcatgtaagttttgctatagaaaaatgaatattgaagctaaaaaaaacaagcaagagttagcatgccctacgcttttctctgaagagaaaggttttctgaggaaaacctttctatgaggaaaatatttactgaggcaagttgtgacaatgtgatattgtcacaaatctacttgtaaatgatagattatcccaattgatctataaatttcccctccctcgttaataatttttatactgattacatggtaaaataatattttgggcacattgggctagataaaatatattattaaaattaatttcacatgtttcttttctactttttactagaaaatttaaaattacatatatggttcccattatgtttctgtagaaatggattatatactttacactcttgatacatctcaattcaaaccagccatgttaaaagtactcaatagccacacatgactaagggtcaccagatttcacagcacaggtctggagctaaagaagttctgtcctattaagaataaatgaaggctttattacagcacttagtaagttgttattgagaaaaactagagtaacaccaataaagtaagtgggattgattattttttcaaggggaagagatgtttcactttgaggtgaaactggtggctgggtacggtggctcacacctgtaatcctagcactttggaatgcctaggcaggtggatcgcttgaggtcaggagtttgagaccagcctagccaatatgatgaaaccgtctctactaaaaatacaagaaattagccaggtgtggtggcacacacctgtagtcccagctactctggaggctgtgagacaggagaaccgcttgaacccgggaggcagaggttgcagtgagctgagatcatgccactgcacgccagcctgggtgacagatcaagactccgtcaaaaaaaaaaaaaaaaaagaaactggcatgtcctactcctgcccctccccttagccaatgaagagcctgctccttcctctaccaaaagacacacacacgcacgcacacacacacgcacacacacacagttccttctcttctcttttaatctccagcaatcatctagacttcccgcctccctctaatttaaaatattattttattcagatatcttttaaattcttatttgggaaactctataaaatgttctttctaagcatctaagccagcatatggaaagagttctatatgttttttaaattgagatataattcacataccatagtatttacccatttaaaatatacaattgagtgagttgtagcagcattttcacagagttatccggccagcactgcttgattcctgggcattttcgtcaccaccaccgactgcttgtcatcccctgggagacctagacagtcaccagtttctctctctggatttgcctactctggacatttcatacaaatgaaattatacaatatgtggccttttgagcctggcttctctcgctgattatgttcccaagattcatccatgttgtagcatgaatcagtacttcattccctttcatagctgaataatattccattttacggatataccctattttttaatccatatattagttgatggacacttggattttttttttgttttactttttgactattatgaataatttggctgtaaacatccacgtacaatgaaacatgcctttttatttctcttgggtatatatatataccaacgtagaattgcagctgttttcccatagttaccaccccattttatatacccaacattgccaacattcattatcatctggcttttttttattatagccaaagtggcatctcgtggttttgattcgtatttccctaataactaatggtattgaatatcttttgatgtgcttgttggacatttgttttttggtgtttttttttttttgtttttttttttttttttggagaaatgtctattcaaatcatttgcccattgtttaattgggttatttgaagcacaaaagttttaaatttttatgaagtccagtttatttttttcttttgtttcatatgcttttgttgtcatagctaagaaaccattttataactggaggtcctgaagacttacacatatgttttcttgtaagagctttatagttttagcttttacatttagatctttgatcatttgtgagtttatttttctatatggtaaggatccaactttattctttctttctttttttttttttttgagacagggtatcactctgtcaccaaggctggaatgccgtgcagtggcacaatctcggctcactgtagcctcaacctcctgggctcaagcgatcctcccacctcagcctcctatataactgggactataggcaggcaccaccatgcctggctaatttttgtattttttgtagaaatggggttttgctgtgttacccagactgggcttgaactcctgagctgaagcaatccacctgccttggcctcccaaagtgctgggactataggtgtgagccactgccccagttccaactttattcttttttgcatgtgaatattcagttgtctcaccatcatttcatgataaacctaattttttccccattgaattgccttggtacctctgtataaatttcacctcaaagcatgtcttagaaggctgtctcctaaacagaggctaattggggaaggaggtctctctagacataagtcttatattcagccttctatttactctgaacaaatagggcttttagaattaacatgctttctaattataatccctttggaaatgtcatttcctttctcttttaagatactaaaacttcaatgacaatttaaatttcttcctgactaaaataatctcaatagtattgatactttagcataaatcaaataatgaaaaatagattaaaaaaaaaaaacacgtttctagtaccctttaccatggatacttctgaatggaccatagtgacataggttccctgtcttactgtgactagtcattattggaacttttaggccttcagagccctataactagaaattaatcacagtgtcatttctgttattctcttgttcaggaagcaaaactttgcactcaaataaattctgcttctcttgcagtctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaaggtaaccacccttccccgctgtctgattcccagcccagacctaagcccagttccctggcctcagcccactttactttgctcaatagtgtataaggaaaggaggtttttctgcagtgacaattatttttatatgtttaatgccctttatttgccttcaaaatactttaatcctgcaattttagtgcattattttaaactgtgagaaaattttgcagatttattctttttaaagttggatttgatttttaaaataatgttcctggctactacaatttgagaggaaatttgtaattttgtaatgttggctttcggtgagtaatagggaatgtatactgggacaagcttttgaagactatgtttttaaaatattgaccatattgttaaaagacagaggtcttttctgagtaacagagcatcgtttgcgatgccaagcacgtcctttacgtgcctctcaagccgagaacctcacttacctgatatttacattgtaactttttttcagtaattggctcctggcagcaatgggttgagagtgggggatgtccaatagaaacgtgtagctaaaattagacatacctttcagaataggaaagtacacattcccctgtatccttggagatcacacctctagataaaataaatactatttgtcgtttcctcttgattggagcctaaaatccccaatgtgacaagatccacatagggaagaagcattccatcactgtctttttaggcctgttgatctctgtgtggtttctccttttatcttcgattgttgtcagtcattgatcaatgtgtgagaccatctaaccttgctgtcttctgggtctgctatgattatgaccgcaagaaaaatagtagaggctgggcgtggtggctcacgcctgtaatcccagcactttgggaggccgaggtgggcagatcacttgaggtcaggagtttgagaccagcttggccaacatggtgaaaccccgtctctactaaaagtacagaaattagctgggcatggtggcaggcacctgtaatcccagctacttgggaggctgaggcaggagaatcgcttgaacccaggaggcagaggttgcggtgagccaagatcacacaactgcactccagcctgggcaacagagtgagattctgtctcaaaaaaaaaaaaaaaaaagaaagaaagaaagaaaaagaaaagtaatagagaggcttaatttagtttttatttttcaaatggaaatctaggcacataatctgtcagtaaaccccagataaccttaaggagagaggacatcctctacttaatttggattgctttcacttgaccagctaagtattttgttttctcatggagtctctatcgctacttatcattgagcttcccttcatttaaaatgtcaggccccatggaatgaagcctttcactagttttgtttctgtttaccactaccacattgcagatctcaaaatgatggtgataggtctggaaactccatggcttccaagcaaaaggaaattgggaaagtagtctcagtattcttgagtactatgtattccgttccacaattcagaaagtagattgtttgattcaaatggtataagagatgtgtttgccaaagtagaacaggaagtgggcatcagatgccataaccatatagacagaatcacacaagacagaatgatgacactcgctggctgttcttggcacatccccatctcagtagactgtgcattgacttagaacattttgcatatctgaatagtttctctctggtttttaagtttagtttgactcctatttctttggttttcaatttgtcattttgaaaggaggatgcctttttttaagaatgtcttccatctgaaaatatttctctggtccaatgtgatggcagaagaaagttggttatagagatcttgtctcaaatggcatcaccatggagtgagattggaaagagctgggcccctgaaaccaaagcacagaatgtgcggctgtgccattatctaacaaatcccaggggatcaacaaagctccctgaaaaaagcatctgggtttgcattatctgaatgtgctgactggagctgcctgaaggcctcaaaggattatctaaattttctgcttctaactggaagaatgcagaatcattgaaatcatcctttagaaataactctcctattgaaagtcaaacttactagagaagagaagaatgtggccattcagggagggtggcagagcttctcacccactcatttgagtcacattcatttctagactctggtaagtagggatgttttgagactttggtatgttgatcttggcagagtgagttggataatcagagctttagcagcctgccttttctggaggaaaggggacttagccaccaaatgcacattgctatagaaaaactaaaatcacagcaaattagagtgtttgtgtcctcagaagacaggaacagcaattaatgtagagatatcttgacagtgcttaaaagagcttgtacctgggactcagtgacaaagtctaaattacagtgattaagtttcactgcatctttctggctgggctccattcctaccttctctgtcctctagtctccctcttgatgatcatgcagatcttttgtagctcctcatgagagctacattaatacaggttggtaattacatagagttgctatatttgaatgtcattaaaagaagccacacatactggtaactttctataactaaaaacgtctattaattgctctaaattattgctccctagaatatatgtgtatctttatgaagcttggaaatttagggagaaaatttattttattttattttttggtaatggctgtttcactttcagatcttaaaatgaaccactgaaaaaaaaaagattagtggtaagcctaggagaggtgaagatagtagtaatttaaggacattcttaaatttaagcagcattcattttcttcttagcgttctggccttggcagtaggcagtgccagtttgtgtggcaatcaaggacctcctcagttagtccaaaatcctctagacctgctgaccaatgctgtttctggtgttggagcttaatttgagaacacacatgagaaagctaaaaaccctacctcatgcttgcacatagatatctcttctgtaactgactgacctgacttgttttggtgtccacggttgttagccagctattctccaggtctccttcctcttgcttccctaaggccccctcagacacctgtagccaattactacccacttatgcgatcacatatacctttttactgccatctagtcagtacaagaggatttttcacccaatatgttcatcctaagtatatttgcataggccgtgccaacatgagcataatagattgatactcaatacatgccaatgagcaaataggaataactagctgggcacggtgacatgggcctatagtcccagctgctcaggaggctgaggcaggaggatcatttgtacccaggagttagaggtcaatctgggcaacatagtgagacactgtctcaaaaaaatgaaagaatgacttttctttatgttttttgcctgatgactcaaaccagttcaaaagttacataaatcctcaactcctggctcttagaaaaccactaactattttgaaggttattgtacagatgcatcagtatttgcacagagctgcagtgcttataggtgtaggtatgagagcatacatagagtctttgtgtagcatgaagtcttagtaaactgtcatgtctacataaaagtttgtaaactctacgaagtatgacaaggaaaaactttagaacagctaatatacaaatatcagtcaggatctagatatatgttggtcagtgtctgacattatcactggaagaactggttaaagaccaagaaaaatgcctgcccacagttgtcaacacagctcaatttcatgaatgtgctttttctggttgatggttcatgccacaaaagctgtatgtttcttgagagctgaggaaaagaaaggcttcttatgtgtggtttacattgaacattaggactgcctcaggctactctggcacactgggctgtctgtgtgcctctgtgtatgccctgttccctgcaccctcattggcatcctatggatgtgagaaatatgccttccatctttgtttagaagttactccgttgtctttacctgtaacatttccttctctaaatcttttctgcctggaaatgtttttttttttagttactaacaattaattgcctctcttttatattttttccttaagatgagaatgttatttttctaaatattatggactaactcagaatatgaaaattcaccctctaaaataacaaaaccagaacttctcttaagagatgtggttgactctatttgccttagcctaggttgtgggtatggatcattttaattggcaatttttgctttgcatcaccgcatacaataaacattcacgattatgttctatgttgctgttacatggcagaactccaggtgatttggcctaagcgatcttgccacacctcttccagcttttgggggtggttattttatccagaaccagttacttttagtaacctcaaagactgaaaaatagaaccactgaggaagaaatttcaagtgaaccttgagaaaatgagccctctgtcaagccacagatgcttgatgcagatctcaccaacaaaacatttttttgctttgttctatgaagcaactaatccattcattcagttgatgtagcaagcccaaattcttcaagtgtcattaaatcataaggccaaaaggaattcagaaagggcagagagcccattcttcgtcatatgtaaagcattctaccaggatgagaattcatacaattgttttattggggcagtggggagggaaataatctcaagagatttcacagcttttctctctttttttttttaaagacagggtccctcattctgtcactcaggctagagttcagtggtggccctgcagctcactatagcctcaaccttctgggctcaagtgatcctcccaccttagcctcctgagtatctgggactataggcatgcaccactatgctaagctaatttttaatatttttatagagacagggtctcatcatgttgcccaggctggtctcatactcctgtgctcaggcagtcctctcaccttggcctcccatagtgcaggaattaccggcatgagccactgagcctggcccacacaacttttctaaataatttcagtatataataagtcctctcccttttcaatatttaattccattcctctagctacagctcaaatacacaattaagagagaataaatgtctttttatgagctgagtgttttctaaacatgaagatttttgacatctaagattctgagaacatgtgttggccctgcttgccttaacctagttattggatatagattattgactataacgtggtcatttgcaaaaaaagaaagaaggaaaatttggtatagctctctacccccaggcaagttgggagaggaacataaggaaaatagatttggagcctgagaccctggttcaagtctcagttctaccattggtcagctatgtggcctgtggccagttgtaccatttcacctggcttgtccctcatctgtaatctaggagatggcatattggccatggaatacaccataggattttaaggtgcacaaattaaacagatacaagcacatggtgacaaatgaagatggcttactattgcatctttcagttcactggccagcaaactgcatttcagcagtcagcttgttcagattctacacaatagacagcaggtcagaaactcagtggctaatggataaagcctgcagctggtaatgtgccatgtcatacacattagcatagcctagtaccaccaaaccaaaatcctgttccacctactaaatggctgtttttacatgtctgttgaaaataaaaaagattatcaaatgtattgcaaactgtaaatgtcattttaagaccaaaggttttttgtcatttccttttgtaagctcttcatcacctgccttaacaattttctagtgacttttcttttaacaagcaggtatctcccacagctcttataactacactttgtgtgtttcatcctataatcatattttctcttctcaagcatctggctttgttttctttatcctttttagatgcaaaacttggacatgacactcttctcagctatgcccaataaaatgataatgttcatagatatcttgttagccccttattaaatagcttagcgttacaggcttttcagcttgtggtccacggtgatccctgaggcttctactgctgcatatagctggccactcatttccctatgctgtatgtattaatatgcccttatactgttaaatttctgccttttatagatggacaatttttctttactgcagtcacttggatatcttctttgtcaacttaatcatccctacttcacttgttttcccccagtcctttggaattagtgtcttctaaattgtgttccgtacggtactctattggatagagtacagaactggctagtgctgaacacagtgggaggagtcctccttaatcattatcctccacattatctgtcacccaaaggcttgttatttgtacaagcaatcacaggaaacccgatcagctctcctctccttggtattagaccagcattcagccattgcccagattttgccacagccatttgacaggtgactaattgcttctctctgcttcctgaaaataccatctttagcaggccaagcttgtctaaaacccccttgccattcctaaatagtagatgactccaagttttcccatcagcagctttctacaacacagacagtggctggcagatgtttttcacaggatatgatgatctcagtgacgatgcaggaattcacagtggtctccccaggcctcataggttcagcactctgggccttgactgatgacattcaggcttcccaatcctgtgtggctcatcgcttggcaaagtcagcaaatagatgtaggtcctccttaaagcagcacccgctgagagtagcatcttttttgcagattggtcatctagcatcccctcctataaagcttcgccacagctgggaatgtaaaatcaccaggttgctgtacacgtgatccatggtttcatttgagcatcaggtcaagatgagaagtttggacagattcaggctgtcccagatcctcggtgacctcactacctctcttctttttgaaacagtctggctctcttgccaggctggagtgcagtagcacgatcttggctcactgcaacctctgccgcccaggttcaagtgattcccttgcctcagcctcccgagtagctgggactacaggtgcatgccttcacgcccggctaatttcttgtattttagtagagacggggttttaccttgttggccaggatggtctcaatttcctgacctcatgatccacccacctcggcctcccaaagtgctgggattacaggtgtgagccactgcgcccgacctcttttatatggggtatcatgtacttgtgtatcctctcttccttttcaaaattaatatcctgacatgaccagacagaatctaaggttgttcctttttaggaaaggagaaatgccctatagcttatagaaaaattaaagttagtagtttcttcatgtagaatttagagacaacttgagtaaatttctagtgattccaatttggccatactcagttaaactcacttcttatacattgagaaaagtaacatattgcagttattatttcctgttacatctaatgctcttttccttttgttagatattattggttcattcccttcttacgtaattcctatgacaagatttaactctctgtgagtaaaatgaaattgcagcctattaaattaacatgaaatttccaggataatgaaagagcccagccacacagctccccttaaaaattatgaagctgatagcttcatggtagttgtattgtaatttaatctacttcagagattcttaggtgaagtgtatgggtgcacatcccttgacgcagtctcaggccagtgggttggtcagctgcaaggagcccacccacagctgtgcccagagacagactcattttagagtgggaggagttgaggggctaatgcagtatttcttcaacccaaaaaaacatgagaatactttggaagtgtgttaaaatacagatttctggggctctggaagatctaacacaagcccaggattccccagttacatcagtacctacaggtggccatgttctgtggcttgagaaacactgctgccgcgacttcaccttcttcacctagacaatatggaactggattttgaccgtcataacaatgtgtgtaattcaactggatgagagtgagcagtaggcctcagttggtgtgaacacttggaggacattttacctaatcttccaggcatcattcctcctttactaaattaaatatctaggattgggacacaagaaagtatgctttagaagagctcccaggtgacgctcacaggcccactgaattagaggccctgtgtactgaagtgcacagcttcatgctgtgagttgtgtgcattaaagaagaaagccataccagtgaattgttcatttgtttctctcataacctttgtgcctaaatctaatcaattaaatggggctgtctcaattagaaccactagtgaaaagaagtgcactggcatttcacacctgggagctagtgtcagcccattgtgttcatagataaaaccaaggatcggggttgatcttatttaaccagttatccttttaagaatacatgtgaaagccaggtgtggcagtgagcacttgtagtcctggctacttggggggctaaggtggaaggatcgcttaagcccaggaggctgaggctatagtgagctatgattgcaccactgcactctagcctgagcaatggagcaagaccctgtctcaaaagcaaaaacaaaaattaagaaaataatagccttattttgtctgttttgggactttatataatataaatagaatcatactatctgcattaatttgtgccctgtgtctttaagtcaacattatgttgctaagatttatccatgtgttgcaggtaacattagcttttctccatggctatgttatagttacagtgtgagaatatagcagctcatttgtccactatactgttgatgaacatttggattgtttccaattttggatattcagaatctttgcttttttttttcctcttctttttatttttttgagatagagtctcattttgtcacccaggctggagtatagtggtgtgaacttggctcactgcagcctcaacttcctgagctcaagcaatcctcccacctcagccccccaagtagctgggtctacaggcacatgccaccacacctggctaattttttttattttttatggaaacagggttcgccatattgcccaggctggtctcaaactcctgagctcaagtaatctgcccgtctcagcctcccaaaatgctggcattacaggtgtgagccactgcacccagccaatattaagaattcctgtacatgtccttttgtacacatacatatatgtttcttttgagtttctgggaatgcaatatccatgtcaagaatatacatatgttcaacttagtagggtctctgaactagttttccgaagtggtcataacaagtagcactcccaccagcagtgtatgagagctctagtgcttcgcatccttgccagcacttgatattataagtcttttaatgtaaccattctggtaggtgtgtaatggtccttcattgtggttttaatttacattttcctagtaaccgatgatgttgagcaccagtgtttattgacctaggctcactgcaacttccacctcccaggttcaaacagttctctgggcttagcctcccaagtagctgggactacaggtgtgcaccaccacacccagctatttttgtgtttttagtagagacagggtttcatcatgttggccaggctggtctcaaattcctgacctcaggtgatctgcctgccttggcccccaaagtgctgggattacagacatgagacactgcacctggcctattgtgggactttttaatatcaaaatagcttcaaatttaccgaaaagttgcaaagatagagttcccatacacccctcaccaagtttcccgtgttggcatcatcttacattagtgtagtacatttattatagcttgagaatcaatattccttcagcactgtaaatatgttatcccccactctgtgggcctgtaaggtttccaccaggaagtttgctgccagatgtattggagctcccttttattttatttgcttcttttttcttgctactttcagatatcctttctttatccttgacctttgagagtttgattaatatatgccttgaagtagtcttatttgggtgggatctttttggagttctgtgaccttcttgtacctggatatttatatctttctccaggtttggaaatgttcattattcttttgaataaactttgtgccccgatctccttctctcgctacatcctctttagggccaataattcttagatttacccttttgacaggacaggcatggtggctcatgcctgtaatcctagcactttgggaggccaaggctggcagatcacttgaggtcaggagtttgagaccatcctggccaacatcgtgaaattctgtctctactaaaaatacaaaaattagctgggcatggtggcgggtgcctgtaatcacagctacttaggaggctgaagtagaaaacctgggagcagaggttgcagtgagccaagatagtgccactgcactccaacctgggtggagactgtctaaaaaaaaaagaaaaacaaatttacccttttgaggctattttctagctcttgtaggcatgtttcattcttattcttttttcttttttctactgtgactgtgtattttcatgtagcctgtcttgagctcactagttcttccttctgcttgatcaattccgctgttgagaaactgatacatttttcactttgtcaattgaatttttcaactccagaaattctgcttgatttttaaattactatttcaatctctttgatctctttgttaaatttttgatagaattcagaattccttctatgtgatatcttgaagtttattgaacttgctcgaggacaggtattttgaattctctgtctgaattctgtgtcactctgggattggtcactgatgccttatttggttcatttgatgaggttatgtcttcctggatgttcttgatgcctgtgtacattcatcagtgtctgagcattgaagagttaggtatttattccaatcttggcagcctgggcttgtttgtacccgtccttctggaaaaggctttccgtgtattcaaatgggactgttgtgatcttagtttgtggtcactgtagatgtatcagcactagggggcaccctaagtccaggaacgctttgactcaccaactccaagaagcactgctttgatgggcttggacaggataagggagaattctctgggttgctaggcaatgtctctctctctctcttccctctcaggagtctctctctgtgctgggttgcctagagttggggaaggtgattcaagcactcccatggccaccacagctggcactgcacagggtcagacctgaagatagcacggtacggggtcccacccaaggcccgtggtgactgctgtctggctaccaccaatgattactcaaggcccaggggctggttagtcagcaggtggtgaatcctgctgggtctgggcttttcgcttcagggcagcagactctcttctggccctgggtgggtctggaacgccactcaggagcaaagttctggaatcgagggcttcaggattccacctgctttattttcctgtggatgagctgctactcaggttgtaagacaaagccctctgtagtctttcctttcctttccctaagtggaaggagcctctccccaaacttccctgcctggagttggaggactggtggtgtaggcattcccttggccaccatggctggtgtcacatggggtcatgtgcaccccaagtccacttcttcttaaaccagtgcagctctggggcttgttcaaggactgcagtccctgtggcctgactgccactcatatgtattcagggccccaggccaccttggtcagctggtggcagaaccagctgggactcagcttcctcccactctggctgagaattcccctctggcccagagctggtctaaatgctctgtccgtgggtgccagcagaattctgctcagtgttgtgctctgctgtaacaggccagcagtgagttccaatgcaaagtcccacaccctctccctctctgacgtgcacagattctctctccaagctgctgtgccaggggtgggggagggagcataggcgatgcaggaccatctttcccaccctcttcagtggttctttccccttgatatgatgtgacaagcaggtattgtgatcactcacctgattttggattcttatgaaggtgcttttttgtgtggatagttgttcaatttggtgttcctgtggaggcacagttgttagagggttctattcagttatcttcctccccaagtcaatattgatacagtattattaactagagtctgtactttatttaggtcaggacgattcatttttgacaaatgaaagtgccatcgaggaacgctttgggaccacatactgttaattaaacctcaagtaaaaataactgaaagtctgttgtagcaagagtcagccatctttggtctcaccccatgctggagaactcagaaaggctcaaatagtgtggtcctgtgagaccactgggcaggaagtatgaaaatcctacagttaaaggccttccacttttaacatgagttttagtcaactaaaactctcatcccttattttgaaaatcttgcctttttctgctctggaactcttgaaaccccagagttttggactctttagtcatgcagactttagttgtataatcttttttatttttgagatggagtctcactctgtcacctaggctggagtgcagtggcgtgatcttggctcaccacaacttctgcctcccgggttcaagcgattctcttgcctcagcctcccaagtagttgggattacaggcacacaccaccatgcccagctaattcttgtatttttagtagagacagggtttcgccatgttggtcaggctggtttcgaactcatgacctcagatgatccaccagcctcagcctcccaaagtgctgggattacaggcgtaagccaccccgcccagccctagttttgtaatctttaaccaatgttgccctagttttgtaatctttaaccgatgtttgaaatacatcgaccagcagcttccagagccaataggaatgccagctgccatggggaaggagcactcactgtgccccttggccttggatgtgagtctgaagagccatagccctgcttgagtctcctctcccctcctcagcttggtcccagagagcatcaccacaatccctagttgtgaggaaagcaagacagaggcatggagacggtagaccttttacttctctttcttctgtctcttgccactgccagacttccgtgacaaacgtcagtggtgccaatgtgaaaaaagtgaaaaaagttgaaagtgtccctgacagtcttaagtatttttactttttaaagtgcagactaagccctagtggtcatctgtcactttgagagcagacatttaaattatgatgagaaagccaggaaggccagccaggcatcgctgttaatagttcatgaaaaattcactgttgttcaacccagccatcacccgtaccccggacagcacttttatagctgacataatgatcctgagatacacatgtctttgccctgcttctcctcagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagtaagagttactttccttcccttgctggtggcttgcttttaacaggacagagaatagaaaagcttggcgtgatctcttacaacaaaagaggccgggctagggggttggcaggagttggtctgttggtgggattatgattttttttcctaagtaatattttcttaaattatttctctgcctcattccttaaataagatttattgcaaaatgttaggatttgagaatcttagatcttgaaaagagtgtgtttgaaggatacacttcagaataattgcccctctggtgctaagaccatactagtccctttgattatattaatcacagccttcctgtgtaattcttaactaggccagtaggcaccagagggaatattacaaagtgagtgagtacccctgaaaataaaggactttttgacaaggtagtacatcaaaaaattaaatgattcattcaattattttgttttcgtttgtgcaaaggttgcattttggatgtataccctgtggtcgtttagtaaatctgttgctaattttggcttagtaaaactaatagctttatttaaaagagtgacttattcatcagattttattttgtgtttcaaattggttttgtttcttcagtaagcgtttatatgagtagattcgcatataaacagaagtaattatctgtttctccacataatatttctctattgacttatattgacttacatcctttagagcccatcatgcccttgagccagccttgttgagttggtatctatcatctcttcccttttttgtccaggcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaaggtacaagacagagctcagggtagatggcaattagaaacaagccagacatgatggggctattaaccatagtcacactttccagaaagtgttggttactggctgctcttcactaagtctcacttcctgctatcatcccatttccctgataactggtccacagtgtttgacagtgctctgtccctgcagccacatctcattagtcatggtttctattacctggtcctacccctacagctgtttattcttctgctgtgtcctgctcagagtgcatgattccctgaacatcacttaggtgatatgacttcttggaaactgtgcagagacacctgtggctcctatggaaagctagaacgttttccataagggttttactgtcttctgtccagagggtcctcgtcttctcagaaatggccccatttgctcctgaccctgtctggcaaacctactggccatatatggtattctcttcactcagagaaactgcctgatagacagtcgctctcattgccacacccccaaaagtaaatgtacagctgctgcttcaatccagcaatctaagtctacccacacaccttcagaactttccaaactctcttgacttcataaagccttctattttatgctcagaattccagactgtaaatgtcttctctaaaacccagtctctctgcaccaagtcctgaatacctgtccagtgtgtacgtttttgtgttgtccagacctttatgtgaccacatggaaaggtttgtgtactcgtctcagcttgtaagacctttggaaactcacttaaggctctctcctttcttgttctataaagtgtggagtctcacgcccccggggattggaatgggtgtttattgagctgggcctgaagttacgtcactctgagtataggtatttctgtctgaggtcttctgggtctcctaggagaagggagtgcacccccagaaaggtcatggctgcaaactttgaagtcttctgttctctaggttcttaggtggatgatttgtagtctatttgaagagactagaaagctttaagaagaaccttgagaattgaattgattgaaatggaagctagaatatttcctaaaccacacaccagcttcagactgtgatcagagtgcaagaggcatggcgggtggagcagctgtgtggggctgccgccctcaggcttccctagcaccatgctagcgtgtgtgtgcgtgtgcatgcatctccccagataggccagataaaccccctaaacctaaaaaatcaacattcataggaactgaatgtacccccaaggaccactttagagttttgtcgagaaataaatgatttgttaacatgatttatgttaataaatcattgtacagatgtagccattcttgatttctgtaatttccgtctcataagccagcacttaacagttctgactcatcattcagggcacaaatggtttccttagcaaccttgcgaaagacagtgcttgaaacttctttctttatccatcaaaacccaaagaggtatattaaaatgttcaagtaccagttcaaaataaaaattatttcagatttttcctttgaggttaaagggaaataaaacctgccctgaagggagtttttcttccaactcctagtttaacatttttggcaagaggcaagctcagagccttcattcttttgatttacttatgcagtagaaataattgaaggcaaatgtctgattttgtccttattccaggtcttggcttttatttccaaaatgaattactttagcattcctatttgaaacaggagtgtgctttctttatgttgtgactgtattactgtgagactccgcgaagaaagtgcttctgctggctaaaccatcacagtgagaaggctgtaagcaggaactgggaataggcccaggttttctctctccagtttcatcttatttgagcaggtttagtttcagatgagttcagcttagtagctccctttgtcttctgagagtcgtcatctgaatgatggaggctctgctgtgtcagtaaggctggcatgcccttgagaggtcttccaggccactcctggctcaaggctctgagtcactgcctcaggcttcaggatactaggtgtcatggccagctttgggctgtgacactccaaagccactcatgtgccacattgattttcctggatagccagtgctacctatgagtttttgttaatattgagtggcagggtcactcccaggctcatttgtcagcagagcaaggacctcaagaacagtggcagagctacagcactctaagaaacctcactggcaagcagagataggataacgttattttccccaagggtggcatacagtctgacaagtgaacagacagtagtgccagtgctctcaggtatataccaaaggaggtggcttcgtgtggctccagtatttaggaagagtttcttgtgagtgcaggtgacacatgtcactaatagccaggggcactgaaaagaatgagagaacaggagactggcatgaaacaaaacgccacctctccaggccccattcctcaactgtgagatagaggaccagaggagatcagtggtgcccaaccagtcttaaagctcaggaagccttttttttttttttttaaatcacacatggaaccccattatatagaattcagacagtagagtttctcttatgggagggatgggatggtctggactcctgggtcccacttgaacctctccgtagcagtggtgctataaggaacccttagggcctccttggagcacaagttagaaccagcccccttctcgaatgtcctctgaaatcccttccaggtgtgatcccacttccagtgccatcccactccactgcgattctttcccaagggctggcagcaccaggcagcgctcctgggcaatcccaggtacaacctgcaaggcaggcaggggctgctcttgggaagcagttagttctgcacacctttaagactggagttaaagaggatggggcaaggggccatctcaacattcttggacaaggctgggttctcctaccttttaatgagcagaacgccttcggggtaggttgcttcctctgcttcctgccctgcctcccttcactgcagggtgttttaacttttcatagggcaccctgcttaaagaagctcttcaaggtagctgttcatggccttgaagcatattaacatttcccaaagaggctgaaactagaattggcggagggtttcacacctgtaaaaccatcaggctggggatactggaaaaggaaatccctttactaaaaccaggggtgctgaaaactatttagcagcagttttttcatacagaaatctgagatctgacctggcaggcaggagccttatgtgatagtcctagaaccttgcaggtggagatgttttatttggttttattttttaatctggttttattttttaagaaaattacagttagcaagccatataatggctctaatgctcactcttctccacaaaaagagaagggaaattatcactttcattccaagttctctctctcaaagcatttatcacagcaatttagtttctagacaagtacatacgtaccttggatttaattcatcaggaatttttttaaagtgagaataatttttacccagttggtcacatcttgggtgtattcacaatgtgtttgattcataatcttttggtatttatgcagcagctgtgcataccacattgagggtagcctggacctgattcacccctggcttgttgagcggaagcatgctaggccctgtgtatccactgtatttctgggtctgtaatcagcccactaaatggagcatttgctaaatcattctctctctgccccttcagagtgtcatgggaagtcccagggtggctttcaaccagcagtgacaccctcctcacatcttcacctgttctccacatcattttccctatcgaggcagacagtggcctaagagcaaatgaataaggataactttattgttcacgggtcaaatgctctgttgcctttcaggttgctatttttaaggtatctgctgttctcagtgaagagatactcagaagcttgctatttgcagaaaaaatctcaagtaaaatcaaatttggtcacagaggcaaaagataagagatacatctggaactatttgtcatgtatatttaaatatataattatttgtcatttagaaagctgacttccctattctttctttattttttgagacagagtctcactctcttgcccaggctggagtgcagtggtgcagtcatggctcacagcaacctctgcctcccaggttcaagcgattctcctgtctcagcctcctgagtagctgggattacaggcgtgcaccaccacggctgggtaatttttgtatttttagtagagacggggtttcaccatgttggccaggctggtctcaaactcctgacctcaagtgatctgcccacctcggcctcccaaagtgctgggattacaggcatgagccaccgcgcccagcctaccctattcttatttcatgaatagaaatgcatcttcaaaaaatgaattttctccaaaactcatgaaatttatctacctcgataggttcagttggtgtaagttagtagttaatcaagagctacctgctatgtgagttaaaatattttgatgatcaaatacccttgttgcccagcaagcatgttatcatccgacaagcttgtcaggataccctcttggcactgtggctctctcttcccccaggggccataacaccatttcatcatgccactgacacctgccattgtgctcagtccagcgttttgtttaatccctgtggtaatcctgagaggttttgtgctcccgttgtacaaatgaggaattagactcagagagattgtatgatttggtcagagacacaggattcaaataaaacccacatttgtctgatcctaaagtcttgtttttaaccacacacgatcttgataggtccacttaatcacatacctgaatcacatagggagcactgatagactgcaggcagcatgccaggctaaggaataatgaccaggaattcttgggttagctccttgaggttgtagaaatagacaatgagccctgaagcttccttgctaggggtgtgtctggagcagtaacttggttatcccaccctcccccaaccttggtctcagggatctgaaccagaaaattgactttcttttgtcttgatcctgtttttcagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggtaagtggtctttcagctgcagcctggatggccctgttgatgatggtcagtgtccccagacgtggctgccactcatgtgctcagagaggggtcctgtatccatgctcagatggtctcagctcacccgccccttcctcatttgccctctctctcctgtaatcccagaccaccatagtcacctgggttgcttgctagaaataacagattcccacactggacccaagacctcctgagtttgaatctccaaaagaatagtctgggaattggtattcttagcaaccatgccagctgctgttatgattgagcaaatttggctagcactagattagttagttcttagagagtggtatccactgcttcctgtagctaccataagaacccagacttgccattgctgtcattctttcccaggctgtaaggaaattgcctgtggtgtcaaccactcatttgttgactcattgatttcttcgtgcagtgagcaggcaagcattatgtaaggaaaaggtttgtggatgatgggtacctccatgttcttgcacctggtccacatatgccttgtttgctttgtgacccaactagatcccagttttattaagggccactttctggcactcgggatttaaatttggtttttccctttttcctgtctctgtcccaccccattccagggctctacacctcccctcatagctgtggcccagcacagcagatgcctgtcacggaaccagtgttcttgatcatttgctggatgcactgctgtcacccttcctcccttctgtcctttttcctttggtgaactctgctgcagcttttatatctccagtgtccattcatacccatgtttcttttccttctgctgcttctctggaacagtaatttctttacatctcttgcttttgctcccttatttttgagctctcagcccacgctcatgaatgttcctccatgtctctgtcctactcactgttcagcagcgcagtcccacccaccctgctcgccccaaggatcatgccagcttcccctgctccttaaatctccttaaataaagctgctccatccacctgcagctaaaatctgggttgtctttgcgccaggaagtcacctccgatgaaccaaggttggcacatgaaatgaccactttttgtcaccagactccagaacaagccttctggtagtgacctcctgcccctaacctttttctcttcttctctccctacatcggggtcagtcttccgtgaattccattattcctgccttactttgattgctctcttatttctctgtacttttaatttgcctttgcagtgtaaaggtaacccctttgtgaagtcttctctgcatgtgtcatatcagagtaggccctgagtagtagaagcctacattccgaaagaacagcccagaaatctgtgtcccacacgtggtcattgtccagacgaggagtcctgggactagaggccccatgtgagtccacaatggaaaggcagggacaggcagccctctctgagccccttcccttcactttttcttgttttcctgaataagatagcagctgcagtgatttcaccccctaaccaggcagtcctcattgggctgatccctcagccctgccttgcttggtgacttccactgaaatgtgtttgggggatgaggaagggtgacttcttttatcccccacatggaaattcgggccccagagataaaagggcagaagggttgtgagttacacacagaattatctcccctcctacttacccttggtaggagcacatttaagtagaactgaacatttaatatcttgcagtgtttgttaacttccatttactcatgattttgctaattttgagcacagtaataaccagcagctgtacttcagagaagttcttttcgtaatttgaaagggaaaacaaagcatttaatacactggcttaccgggctgtcataatacatgaaaatctttaactcctggtaaacaggtctttctggagtcacttaaatattctagctgagcatttagctttagctgtgtgtttgcatggacctgagtgtcgcagtcaccttccaagggtgctccttctcgtggagtggtgtgctctgccctggcttccacccagcttctgcctactgagggcatttctatgtcatgagcgtcgtttcccctggaccccagcagcccgcccttcctgttatctgcctgcatgaacctgagcaataggagctgccttcagtgttcagggtggctcactctgcccagtcctccctgccaagcagatcttagttgttaatatgtcagtttgttgttacaatggtttaatatttgtattcaacaaaatgtccccttaggaagagcttgggatgttagactgctgcaacccaaaattggtccaaagaatagctcgtgtgatgactgcatcctagagaagaataatgccagttccacccctaaaatcaccttcctgtcttagctctgtctgagtaacccagcacactcacatcccttgatgtgcccctcacacccccttggacacctttgaccatggaacccagtgggctgcccctcaacagcagagagggcaggcatgggccttctgtcccttaccactcccgggccagataaaaataaaccctattaaactgggcgtggtggctcacgcctgtaatcctagcactttgggaggctgaggcaggcggattacgaggtcaggagttcaagaccagcctggccaacatagtgaaaccccgtctctactaaaaatacaaaaattagccgggcatggtggcacatacctttagtcctagctacttgggaggctgaagcaggagaattgcttgaaccctggaggcagaggttgcaatgagccgagatcatgccactgcactccagcctgggctacagagtgagaatatgtctcaaaaaataaaaaaataagccctattgtcccctctagtaggaagaaacatccctggtctggctccaaaatccagctccctgttgaagtaggcctcttcttcctggcccaaatcccttgactctgtgcaggaaagtagatgctagtgctgcctaggccctgctgtggacagacagctctcacaaaagcagacttagtgcctccatgcaaaactaactttgccatgactcactgctggaagggagatgatgggaggttgtgaaaaaatgaaggcagactagaggaagccgattcctatttcaagtcagctttagaatagccactaacagcctgctaacctggacattgataacagtcacaaatggcttacaatctattgtggtaacaggaaagaggtaagttttgagtggctcttccacaggcacaagaagcatctcattcctcctcccttcccgcaggagagttctcagcctcggacagctccctcactgacatccaggagacccgcaggcagcctatgcccgaccctggcctgatgcccctgcctgacactgctgcagacttggattggtccaacctggtagatgctgccaaagcctatgagggtgagtccactgaatccacacaagacagcccaggatcctgcagcggagtgagcagtctccatccactctacttctctggacacactcaaaacatatgtgcctcaccagatgagctatcagttactgagcattcagtagggaccagaccctaagctggacacctaggcacatgttttatgtaatcagatgccacctggtgtttcctccacaggattcataacatgaatgcctcgcctcctccgtatatgggaagggcaatgggtagaggaatcccagctgtcccttgactaaaaagaacatgtatccagagaggatctttcatcacgtcgcaagacattgttgctaaatgtcacagtgcctgccctgcttggccacgcgcctatcctcacaaatgtggggcgccccctttgccgttctccctcatctccgtgcgcggtagcgcgttgtctgtctgcattgtctccttgccagcctgctggccgtgtgctcgctttaggctggcggttcttaaatgcaggtcctcagactggtgctgatcttgcctgctgtaatgaaaacacaaaaagtagtgcagtatgtgtgtgttgacataagattgtcagctggggtttttgttttttgaatgaagactgacttttttctaagtttaaagatctttctaaaatttttattattctttacaaacttatagcaggtgatttttttttctgtttttgttgttgttgttgctcttaattaggagaattgaaaattgctatttagtcaagttttaattttggggagaaatgtactaggccacagaatctgtacgtcgggcaaccatggaatggtcagcagtgaatccttttaccttcatgctgtttatttagcagatggaaattcccagttctaacttgatttttcagtgtgttggttaatctccttcatatacaaatggtagaagttttggtttctaatgggagattattttaaatttgatttagttttcttggcttaaattttaacttggtatgttttggaatacaggtggtatggatttatgttaaagccaaccagagtgtccaggaatcttgtggtggaaaacatacttcaagaagttttaagcataatgctagctctcgaacgcatttatttcattgctgagtggaaagccttggtctggaaatttggcacaaggactgtttccagagaaacatttcatagaatgctacagtgatgagcagggaagaggggggactagaaattgactcacaaatgtttcttaaagggaaattacatggctacaatcctcttatagctaaaacagtcatatttttccctgtgagggttgggaaataagatttccagtgcatcctgcactggaaatactagacatgactgccaactagaccacttgttgactttgatagatagggccagggatgtggttccaaaatactaaatggtttcttctctcctttccagtccagagagcctcattttttgctgctagtgatgaaaaccatcgccccttgagtgctgcatccaacagtgatcagctggaggaccaggctctggcccagatgaagccttacagcaggttggtcccagtgcaagggcagtactctgcaccttgtgtcacatctgccactgactgcatctgtggggagaagagatggaagccacacggagtagctgagtgaagctgatcactgcagggctagacactttacattttagtcagaacgctttgtaactgaatactgtagacataattaaactattcttgatgacttatacggccataatgatgaatattcattattatttaatgtcataatacatttatgccctcagggccagttggggcaggtaggagagaccatttgctctaagtattcctgtgctctgtgctgtgtagtcctgcagtctgggttttcagtctctttcgcagtgttgctgatggtcatgcttatacatgcgcttgctgagtcctagtggctcccagtgtgctgcttcacgtctgtgtgttggaaagctaaatcaccaggatggttaagatggtatgaaggtgaaaagtaggcaataactgaggtcctaagggcttctcagtcaggagcagggactttacaacttctatttatgcagagaccgacttttctgttttccccttagtttcaaaatggtgaggttgctagatttatgtgtgctaatttctgtatgttaaagcatcccatcagtcaggtatggaacatttagtaagcacttcttgttgcagaataatttcattcatttgaaatctcttcccttaaaaccctttgaggctgggattggtggctcatgcctgtaatttcagcacttcgggaggccaaggcgggcagattgcctgagctcaggagtttgaaaccagcctgggcaacatgctgaaaccctgtctctactaaaaatacaaaaaattatctgggcatggtggtgcacacctgtagtcctagctactcgggaagccaatgcatgagaatcacttgaacccaggaggcggaggttgcagtgagccaagatcgcaccactgtactccagcctgggtgacacagcgaaactctgtcttaagaaaaaggaaaaaacctttcaagggtgattaaaactccaggtatctgtaaaacttggtcagaaacggacaataacaggaaagccaattgaagtaaatggcacagataaactggggcttgccattgaggacttctctgaacaagtctgcaaggaagtgctctcaacgagaaggcacaagaataggggatcatttgttatgagtataggagagaggccgcacttacctctggcactgctggggtgaggagagcagcaatcaggctgactgctgagaactttaaaaatgcatatcccagaagcaagccccaaatgtgcctcgttaggaaggagcctccaacagagagaagtgtgagtgagccaagactgttttcctgtgaaaggattattaaaaaatcagcagatgagggtgatgacaggctcttttcttgggtcagcatggactgaacaaatggaaatggaggtgaatagacagaatgctcctgagcgttgctgcagtcctgatgagctgcagtggctttgcgaaggataccactgctgcccggccccagcctcgttgtgtctgtccagcaccgccccttttctaccacatccgtggccttcagcccacccaaaatcggaccagcctgccgtaccatactatgcggttatggactgcagctgaccatgtcccttctcaaacccattcattgtcagcttttcattggccttcctgccttagagattggaggtcatggtcactccatcagcccacagccttgccacactgtacaccacggtgggttttgcctcctggggcctcttgtagacttaggattagcagaagacatcaacacagttcatctgaggtcaggaattgtaacttgaatctttatttttaaagtaaagaataccttttactccgtgacctagaaaattcggagtcacttagctctttcccattggcgctgggaagaggctctgcatgttttcccgatggaagactttgggttctctgtggtgtgcccctgaggatgtatagcttggctaggaatcaggaaaatttggcagcttgaactcaggtagaggagagtgtggcaagaaaagttgtcagttcctcagccataggaccctcggggtgagagcgtgcccagccatgccgtctgtctagctcgctggctggcctgccgtaccccagctcacacttctttcggtactccactagcacggcatgattagcgtgccataaacaaaagaaaacatgagaaaatgagaagaaaatggttttttgatcagactgggacagaatttaagacattaagcctaggctaacaagatacttagaccagtggtttaagatgtaggcatgataccttagctgcaattgcatgagtagctaagaccacacacttgggaccagagacgacctgcctatcacatcagctccccagcttccttcccacacacaggggagtaactcctctgtcaaagcccactagagagatcccagagcctccctgggaatcattttactgtttgacaattatatctgccagaaagtacctcttgtgctgccaaagagaccattttcactattgtgcttcattctttagtcgtgaggatgcagcatctttaacaaaggaagctattgattggctgcagttcaagcttttattacctttttttaagactaccattttcttttttaaagtaaaaatactcattgggtcgccatactgagtaatttgacattgaaaaccattttataaatacagcctcctcagagtaaaaaaaaaaaaaaaaaaaaaaaaacaaacccagccatggaggcccctgccaacatggtcttttgtttcttgttcccagcagtaaagactcctctcccactctggcttctaaagtggaccagctggaaggtatgctgaagatgcttcgggaagatttgaagaaggtaaacatgtattctcaaagcaaattgtccagtctgtacaaactacccttgaaccatgagagccctttctaagtagcatggtaaaataagacgtgggtgtcttcccggtgcctgcatgtgtttggggatgcagggatttcagttgccactggaacacacagcatgaggaggcgttcggtgtccggtgtacagaaaaactgttcaataatttgtgaaaggctgtgaacctcagccagcaccatctgggtcctctcccggcctccccactccttgtgtaatgtgtcagtagcccagacccccatgtagtcggtgttattggggcttttgcaccaaaagaactgaatgttttgttttttgggtggccttgactatatatcaagacatcagccaccaacacaattgtctaaaatttaagacaatcctgactaacaaggatgttaaaatacacattaatgtacttacattccaggattacttagagctaatcctgcagggttgaatctctctagaagccctgctccctgagcttagagtgtcttagcacctgataccagtccgtttagacaggtgtttggaggaacgaagaatagaaatggacaaaagatcaaaacgggtccatagctattactcagaagagctgggcaaggtggggccaacacctcttagcttttctacttcactctgcctcccaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgct

SEQ ID NO: 36125 - DNA, 13707 bp, Homo sapiens
ctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggcaagatccgggcctgggaaaagggaggggaggaggcaaagaggagccctgaagggagaaaccccggacaaagaagaagagggcggggaatagagaggagctctgggagctgatactcgagttgggtgggtgaatcggagccggggggcgaggcgggggaacggatagtgtggagtcctagaagggagagctctggatggggtcaaaggggcctgagacggagaagctctccggaggcactccagagaacagagaacggcagaaacctaccgtatacttgcgtggttgcatctttcactgtacttctgacgtccagcatacacgaggcacacacatagtagtagacagttgctcgatgtatactcgttggcccactgctggattattcacctgagacatggaaaggaaccgctccaaaagtagaggagcttagcccacttctttttcagctttcaggtctcagtgtaaatgttttctcaggaagataacccttccttgactatcctaacaagtgtccccatttatttcttccacagaacatatttcaatttgcaattagatttggtttgcttacttgcttatgcttttctattgcattgtaaactgtataaagttagagatggtctgttttgttcaacattatgtgtgaggtgtccggactgggctgccacttgctaaatttttattagttgaatctacccgtttattaaatgtgttgagtacccagagcatgccatcggtaataggttgttttaggctctagggaaacagaatattaaaaacagtgctctgtccttacatactccatgccccagtggggtaactgcctgggttaacagttaaaatactgtgtgataggccgagcacagtggctttggccgggcacagtggctcacgcctgtaatcccagcactttggaaggccgaggcgggtggatcacaaggtcaggaaatcgagaccatcctggccaacatggtaaaaccccctgtctctattaaaatacaaaaattagccaagcgtggtggtgtgcgcctatagtcccagctactcaggaggctgaggcagagaatcgcttgaacctgggaggaggaggttgcagtgagccgagatcgtaccactgcactccagcctgggcgacagagcaggactccgtctcaaaaacaaacaaaaaatgtgtgataaggactaaaacaaggtgtaagagtgttaaggtaatacatctgaaccaaagttgttgatcaggataggcatccctggagggatgatgtttaagctgaggacagtttgaaaagtagaccttagcttgatgaaaagcaggagaaggagaaaggttagtccacagagcaggatgggctgagtatgtaaagacattgagatcctggtctaggacctgcaagtctactttcattctccagagcatgaaggagactaaagattgataagcctgcagggagtaggcatgggccagatcctttagggccttgtgagctatgttaaggaattttgctcttcatccagaggactgagaagagtcatcagaattccacgatgaaatttgtactttaggaaggttacttactctgtaatgagaatggcttgaagggggcatggcagtagagaaacagaaagattcaagagaaattaaggaatagaacccacaggacttaggggctgggtgtggtggctcacgcctgtaattccagcactttgggaggctgaggcgggtggatcacgaggtcaggagttcgagaccagcctgaccaacatggtgaaaccctgtcactactaaaaatgcaaaaaattagctggttgtggtggcgtgtgcctgtaattccagctacttaggaggctgaggcaggagaatcacttgaacccaggaggcagaggttgcagtggattgcgccactgccctccagcctgggcgacagagtgagactctgtctcaaaaaaaaaaaaaacccacatcactgacagagtcattactgacacagccctaaccaactagtttaaaatagaactttctcatccctcctctaaggccattttcctatttctgtcattttacgacttgttatttaatatgtacccttcatgcttccaaaaaggatttaaggaggcttacaatataaacaaaaagtaggaacagtaaaaatagagacagatcagaagtaattgtaccaggaacctctgctaaaatggtaatagcaattgatattaaatttagttgtgagcttcctggtagccaaaccttgtatttctttttttagtaagaaagaagcatacaagttcttcaagagacacaaactttttcagccttaaatcctagggagcatttatcattatatccttatattataaaaagtaatggttttcatagatgatatacaaacattctcttttctagtgatgtctcttaatgactctcaataaaagccgaaggaatggtagtaaatccttaatttagtgcaagtatgttgattgggcactaagctaatgtgtggttgatctactaccctctggtgatatggcttaataccagattaaagctgaggggattaatgtgttcccaggctgtcttttacaaacatcagttaggaggaaatgatggtcatcagtgcaaaattgaactctggctggcttggagtgtcagccatctgtgttatttgcttgctttggcatcatgtgtaccaagattagcccattagtctgcatcactgattgaagagagaaccacatatgtgaggtgtcagccagcccagttgactccctctccctcaagtggcttttttcccttttctttataatatggctgccattctagccctaaccagttcacctgaggtctaggctgtacttcacgttctctactccaggccatctaactgcccccagagctttctgaaatacccattgtacataccattacccctcccctaaatcttcagtggccctccattatccatagtagcagtactcagctgtttttctgtcccaacacgcctgaggaatgacacatatttctctcagtaactttagtttacctcaacaatgattatcaatggtagggaaaataaggagatggaggggattgagaatcactggcctgcaggttaaaagcgtgtttattagtgtgacatttaagtttctccataaatggaatgcaaccttcttttcaaatcatacagtcctacagtgcaatcagtgttggaaggaggcagtgctggagccaaatgcagttggctaacaaggtttcttgacagagaaaagttttacttagatctaaatccttattccataaacatgctatacacattaccatttctgtgcctttgtttctgctatttcatctgcccatgattccttcctccctcttggctgtctaaatactaacagtgttttcaatcatagtttaagtcctcttcatccttttttttttttttctttttgagactgtgtctcgccctgtcgcccaggctggagtgcagtggcactatctcagctcactgcaacctatgcctcctgggttcaagcagttctcctgcctcaacctcccaagtagctgggactacaggtgtgcgtcaccatgcccagctaatttttgtatttttagtagagacagagtttcaccatgttggccaggctggtctcgaactcctggcctcaagtgatctgcccacctcggcctcccaaagtgctgggattacaggcgtgagccaccaagcctgttcgagatccacatctcaaaaaaaaaaaagtaagattatgtcctcccctttactgtaagcccctgaaggtagagaccaaaccatatccttttgttccccagtacttaacagtgtgttgcaggtaaagggctatcaattaatgttggaaggaggtggtactggagccaaaggccattagctagaaagttttcttgcctgaggaaaatgaagggctggattaggaaggagagtagggcagcccttatcaagaaagtcgagagattctgttcctcctgaaggggcattaaggcttccattgccagccaacccttatctccctgtgtccttaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggtacagggggagtcctagttgtcttggatttcctcaattcctattctctctttcatcaggtcccagtactccctatgccacttccatttctggcaatgctagttttctctcattgagatcctcatatttctcctgacttcttctgttccccagtatctgattccaatctgtcctcaggaacctctcaagagcttaaggcctcgaaaggtcaacaccccggctggtagctctcagaaggcgcgagaagagaaggcactactgccattagaactacaagatgacggctctgacagtgagtagggatgttagggtcaattggcaaaattggaatataataataaagtatcatatcagtgttaaatttactgatgttgctgggtgcggtggctcactcctagaatcccagcactttgggaggcctaggcgggtagatcacctgaggtcaggagttcgataccagcctggccaacatggtgaaattccgtctctactaaaaatacaaaaattaaccaggtgtggtggtgggcccctgtaatcccagctacttgggaggctgaggcaggagaattgcttgaacctgggaggtggaggttacaccattgcactccagcctgggcaacaagagcaaaactctgtcaccagaaaaaagtaataaaaagaagaaaaaatttactgatgttgataacttactatgggtaggaaaatcctcattcttaggaaatacacactgaaatatttagggataaaggccatgatgtgtacaactttagttacctaatttagatcattcagaaaaaaaccacacataacaaaatgcaaaagggccaaaatattaccaataggtgatggggtaaaagatacatgagtattccttgtactattcttgcaacttcgtaggtttgaaattatttcaggccaggcacggttgctcatgcctgtaatcccagcattttgggaggccgaggcaggcagatcacgaggtcagtagttcaagaccatcctggctaacatgatgaaaccccatctctactaaaaatacaaaaaattagctggatgtggtggcatgcacctgtactcccagctactcgggagtctgaggcaggagaattgtttgaacccaggaagcagaggttggagtgagccgagatcgtgccactgtactccagcctgggcgacagagcgagattccatctcaaaaaaaaaaaaagaaaaaaaaattatttccaagtacaacatttcaaaataaataaataaaatatgtggacatgaattcaaagatttcttcttatctcactctcttccaggtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactgggtaagtctgtggtttcagaaaaagtgagtagaggggctgaggggcatgagaaaaaccatgagacctggaggaccaaagaactggagagatggaaatttgggatgatggaatcagaaggaagaaatggcggagagtaggtaattaggtgcaagagtctaggcagttatgagcactctgaagaacaagctaaggtactttggtgtaaaataagagttgtatagaactgaggtcaaatcctcgttctgctattcatttgctttaagtctgtaggtaaattacttattcacattttgcttttcttgtttataaaatggggtatatacctaatgactcaggaaatttaggcaggaggatcacttgaggccaggagttcataaccagcctggacaacatagtgaaaccccatctcttaaaaaaaaaaaaagcagggggtgataatgttgactttaatgataatcatgagaacgtgaagtcagcagattagtccttcatgagataaattgctttaaaaatctcttcattttatggtattgctttaaaaatctcttcagtttgggccaagcgcagtggctcatacctgtaatcccggcactttgggaggccaaggtgggtggatcacttgcagttgggagttccagaccagcctggccaacatggtgaaaccctgtctctaccaaaaatacaaaaattagctgggcatggtggcgcatgtctgtaatcccaggtacttgggaggctgaggcaagagaatcatttgaacctgggaggtggaagttgcaatgagccgagatcacaccactgcactccagccagggctacagagcgattggtttggaccactgtaaggagagtgactcccaggttttcctttctttttttttttttttttttttttgagacagagtcttactctgtcgcccaggctggagtgcagtggtatgatctcggctcactgcaagctccgcctcctgagctggagattctcttgcctcagcctcccaagtagctgggattacaggtgcccgccaccatgcccagctaatttttttgtatttttagttgagatggggtttcaccatgttggccaggctggtcttgaactcctgacctcaggtgatccacccgcctcaccctcccaaagtgctgggattacaggcttgggccaccccgcggcaattcccaggttttcaacatcagtaactggcttaggagaccctgaaggaggagcaagttcagtggggaaaaaacaaatttatttttgaacatgttgaatttaaggagtttgtgagcaattcatgcagtgatgagaggtcagttaaatatgcaaatctggtgttccaataagagatctgggctgaaaatacaaatttggaagtctttagaatatgggtggtaattgacaatattggagtgcatctgagcatgtagggagaaagctcagagtgagaaaacagaggcctgatagagtcctgcagacactaaaatgtgatagtttcatacaagaggaggagctttgaaaagagcctggaagtgaccaacgagttggagaaacccaggagagtttgtgttaaaaatgccaggaaagagaatgtctcaagagagtaattgctgctgagacgatgattagtagaactgagaagtgcccattggttttggtgagatagaggtcagacattaccttagcactttttggggaccaagtcgaatcaaagtatattggggagcaaaacttttcaagcttggccatgaagggtagaagagggaatggaagctacagaggggtgtgagattaaggtaaagttgtttttattttattcgaagatattagaaattatgtctttcatgagaaagaactgagtttaaagaaagagaagaaaaaacggttattaatagtgtaggtttttggagatgggaggcaaggctgggaaccagagcagcatggtggaggaattggcttcagatgggggaagggagaaagaaagtgtggtggccgggcgccgtggctcacacctgtaatcccagcactttggaaggctgcggcgggtggatcatctgaggtcaggagttcgagaccagcctgaccaacatggagaaaccctgtctctactaaaaatacaaaatattagctgagtgtggtggcacatgcctgtaatcccagctacttgggaggctgaggcaggagaatcacttgaacccgggaggcgggggttgcggtgagccgagatcgtgccattgcactccagcctgggtaacaagagtgaaactctgtctcaaaaaaaaagaaagaaagtgtggcttagctgagtgcagtggctcatgcctgtaatcccagcactttgggaggccaaggaaggaggatcgcttgagcccaggagttcaagaccagcctgggcaacatagtgagaccctgtctctgtttaaaaatgtggcttacagttgtaggtttgtaatccagagggagggcatggcggaggttctcacctgatgtctttttcattatgcagcaccatctgtcaaacattaaggatacagctggaagcttgaggagactgaggagcatttaaatagttattgatgtgggatattgagcagtattgagggacctgctgaaggctaggaccatgaatttatggtggttccagtctgtgctgttatttttctccagtagcactcagcagtccagatcagggcaagggaattattgacaggagagtgactgaagtgattgaaatgatacagtgagcaacctaagcatgatttaaaaaggaaaatgtgactgggcgcggtggctcacatctgtaatcccagcactttgggaggccgaggcaggcggatcacaaggtaaggagttcgagaccagcctggccaacatggtgaaaccccgtctctactaaacatacaaaaaattagccaggcatggtggtgcgtgcctgtagtcctggctactcggggggctgagaatcactgaggagaatcacttgaacccgggaggcggaggttgcagtgagtggagatcgtgtcgctacactccagcctgggcaacagagtgagactcaaaaaaaaaaaaaaagtaaagtgacatggaaaagaaggttgttagagatgaggtgataaactgtggccatgcagtgttgaaggggctacccatgtgcacttcgaagtcaccagggtgaccctaagatgatgggaattggggtagagacgaagagtggaaaccactgccaaagtcttcagtgaatgaaggagtgaccatgactaggaaggagagaagttaatctagactcttggcacaggtctcaaaagagaagggagtttgctggtaggcagaaaagcagtgctctgaaagctacagggtggggcccagtaggacataggtatatcctgtagggatgtaagagaatgagcaacctccaccagaggtctgcagagaggagtggtggcctcagtgaatgaccaggtttctgttaaggcaagtcatggaaggaatgctgagtgaggagcttgaggatatagatgagttggcagattacagagcacgagttccagagggtgtaggcaagtgtttgaaagtagaggggttgggccaggcgtggtggctcacgcctgtaatcccagcactttgggaggctgaggtgggcggatcacgaggtcaggagttccagaccatcctggtcaacatggtgaaaccccgtctctactaaaaatacaaatattagctgggcatggtggcacgtgcctatagtccctgctactcaggaggctgaggcaggagaattgcttgaacctgggagggggaggttgcagggagccgagattgtgccactgtactccaacctggcgacagagcaagactctgtctcaaaaaagaaaaagaaagtaaaggggttgaggcgttggaagactggctcaaaggagagaaagcagtattatcaaacagttcaagtgcaagagaggttcaatcattggaagggtttccagagtactctttttttttttttgagacggagtcttgctctgtcacccaggctggagtgcgatggcacaatctcagctcactgcaacctccgcctcccaggttcaagtgattgtcctgcctcagcctcccgagtagctgagattacaggtgcaagccaccacgcccagctaatttttgtattattagtagagacagggtctcaccatgttgaccaggtctgtctcaaactcctgacctcaggtgatccacccgcctaggcctcccaaagtgctgtaattacaggcatgagccaccgcacctggcctccagagtactcttttatggtcagactttagggaattgtgttcatcataaccatatttaaggacacagaaatctggagttcattcagaggaaggggacgaggaatattttgattcattttttttcgtatgtttgttttgtctttggagatggagtttcactcttgtttcccaggctacagtgcgatggtatgatcttggcgcaccgcaacctccgcctcccaggttcaagcaattctcctgcctcagcctcccggtagctgggattataggcatacaccaccacatctggctcatttggtatttttagtagagacggggtttctccaagttggtcaggctggtctcaaactcccgacctcaggtgctctgcccacctcagcctcccaaagtgctgggattacaggcgtgagccaccgtgcatggtgattcttttttttgagacggagtctcactcttttgcccaggctggagtgcagtggcgcgatctcagctcactgcaagctctgcctcctgggttcacgccattctcctgccccagcctcccgagtagctgggactacaggtgctcaccaccacgtccagctaattttttgtatttttagtagagacagggtttctctatgttggccaagatggtcttgatctcctgacctcatgatccgcacaccttggcctcccaaagtgctggggttacaggtgtgagccaccaaaaaaagcccagcccttttttttaaatttttaaaattatttatttttttgagacagagtttcgctcttattgcccgcgttggagtgcaataatgcaatctcacttcaacctctgcctcccaggttcaagcaattcttctgtctcagcctcccaagtagctgggattatagtcatgtgctaccacgcccggatagtttttgtatttttagtagagacggggtttcaccatgttggtcaggctggtcttgaactcctttccttaggtgatccacccacctcggcctcccaaagtgctgggattacaggcatgagccactgtgcccagccttgattcatttattcattaacaaatatttaatgagtgcctgtaatgtggaaaatgctgtatcaccctgataatatttaggcaatatgagttatagtcactgcccttaaggaggagacatatataccaatagtgcatcgccatggagcagtatcacggagaccaggcaggtaacatgaagtgtgcagccagccagagggatggtggtgaactggagaggagtgcctgaaaggaggaacagttactcagctcagctaattgttcccctgtaagaatgcagacccagggttgcgagattttcttgttgtttaagagcgaccagaaatctctatatttaaatataatttcctaccttactaattttttttttggagatatgatctcactctgctgcctaggctggagtgcaatgtggtgccatctcagctcactgcaacctccacctccctggctcaagcgatccttccacctcagcttcccaagtagctgggattacaggcgtgtgccagcacacccagctgtaggagtgaattgacagggcatttgtagaggagattttggtatctgggaaagcaaataagctcctcatcaaagggtaccttccaactctgaggtactatagagggcccaggtgtacttgagaaatgagcagagaggatgtcaagaaaaaacttataagcagaaaacttacaaaatgggaggtgccagacggccttaggggacttccatagttgtctctggtagttggcagtgactagatagccaggaagataattgagagatcgtgggacagtactgggatatgggaaaaagggacattctgatcatcccctcatttcttcctttgaccctaaagagacatatgagcggctcgaggctgataaaaagaagcaggttcataagaagcggaagtgccccgggcccataatcacctatcattcagtgacagtgccacttgttggggagccaggccccaaggaagagaacgttgacatagaagggtgagtgaatctcaagaggaaaagagattgtgtgttcagctcatgttctcttggccccattttgcttgcttttctcacacagctctccttaacacttggagatttctttcagattcctaactcccttcagctcaatttctttttctttttttttttttgagacatgatgctgctctgtcacctaggctggaatgcagtggtgcagtctcggctcactgcaacctccacctcctgtgctcaggcgatcctcccaccttagcctcccaagtagctgggagtacagccacacatgctaatttttgtattttttgtagagacggtttcgctgtgttgcccagactcctgggttaaagtaatcgtcccgcttcatcttcctaaaatactgggattacaggtgtgagccaccgcgcccagcccagcttatttctttcttattcctttttcttttagcttctctgttcttctctttcctgtttttccttctagcctagctttcttttcccatcagtcacttagtacgttcctcagaatgttcccaacaccctgcctcctttttctctttcctcatctctctgatttccttctttctttcttttcttttttttttttttttgagatggagtctcgctgctctgtcacccaggctggagtgtaatggcacgatcttggttccatgcaacctccgcctcctggcttcaagtgattctcctgcctcaacctcctgagtagctgtgattacaggcatccgccaccacgcccggctaatttttgtatttttagtagagacagggtttcaccttgttagtcaggctggtctcgaactcctgacctcgtcatctgcctgcctcagcctcccaaagtgctggaattacaggtgtgagccactgcacccagcctgatttccttctttctgtatctgttgtcttctctcctcagctctttgtgtttttccttgtcttttgtcctcagacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatccctttt

SEQ ID NO: 36126 - DNA, 3222 bp, Homo sapiens
ccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggaggtgagtcttgcgtggggggccctgaaccgtgtgggggccggagtttgggggtgccgggcccatgcctgcaccagacagagagtatggggagccggtatttgggcgcggagctaggcggggtggactttgggacatagacggggaaccgggtcctggagccgggagtagtgccagcgccccggaaccacgccccctgttaccccgcccctcgcatttcgttttagacctctcccagtccttcgggactcggtctggtttatactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcgcgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtgagcgccgtggcgcgggtgtggtatggggaaaggcagaaggaactggatgtcggggctttggggaagaattgaggatgggggtgtcacagctccgtgccctcttctcctatcctaaggtcgatggagtccgcaaagccctgcaagacctggggctccgaattgtggaaataggagacgagaacgcgacgctggatggcactgacgttctcttcaccggtgaggctggggggaggcataggtcttggcacagggaagtagagtttgggagactcggccgtctggagccttgtttctaactcactcccgccctcaaacctccgcggcctcccggactcaggccgggagtttttcgtaggcctctccaaatggaccaatcaccgaggagctgagatcgtggcggacacgttccgggtgcggagcgggaccagcctagggagggagggggtgcaggtgggggtcggaagggcctgggcgcccgctgaggaaatgagaggcagagagcagcctatgtttgaagataccccatcacccctcccgcgcccctgaatacctcccttcgctctccctaggacttcgccgtctccactgtgccagtctcgggtccctcccacctgcgcggtctctgcggcatggggggacctcgcactgttgtggcaggcagcagcgacgctgcccaaaaggctgtccgggtgaggagggggcggggccaacgaaagtgggcgcagttctgggcccgggaggccgggagctgggaggcttaggaaattagccctaacccctgccctcaatgggctgtccatcttacatgaaagaacacaggagaaaataagaagttacaacagcaggactgggaacaggggtgattaatttgctcttccggagtttcaggaaaccccaaaggtggcacctaaactgtgactctaaggatgggtaggacagataggaggggctggggaaggtagggggttgaaaataactgcatgtgattccaaggtggaaattagcaaaggtaactaaagtacttagtgtctgacatatcgtaagctctatgtgcttgctgtcattattttccacaaatgtcagtccgtccccagcccttagtggtggttgagcaggcagacacagctgtggagaggttctgagactcgaacacttcctctttcctctaggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggtgagagagggcaggaactccaacaccaagcaccatcagagaaaagagtttcaggctttcctagtgggaggaaggaagggtaccttctctagaagcctgggtggggccactctgagctggctggaagagtggcctggctcagcctgaggtctcactcccctctccccactccatgtcttccctgtgcaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttt

SEQ ID NO: 36127 - DNA, 16919 bp, Homo sapiens
cgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaagtacgctttcgctgtcctcgcttccggctccattacctaggtcggtggagcgcacaaacctcatcccttgtgcctttgtttttcagagggctctgaactcctacttcgagcctccggtggaggagagcgccttggaacgccgacctgaaaccatctctgagcccaagacctagtaagtgatgaggggagcgggagccagtccgcacggaggcagtttgataccaggtagccctgcgcgtcctgggacctgccgtggagctgggcggacgatgctgaggcagatctccaagctgcgtagccagaggagcagggcttgcgttgctgctgctgcgcggagttgcgccccagcagcggatctaacactgcaccagactgtcgcttcgaacgtgatttggggtccagggaggaaaagatggaaatgtaatgtttaactcaaatgaaaggaaataagtaagcgagaggtttgaaacaaatgaacgaaggctaaaccttctatcgaaaaatggcaacttggaagtctccttgcttcctgtattgtttatttattctaggccctaggctgaccggccagaataacaggtttgttgttgttgttatttttttttaatgcacacctactcctgttatttcagtgcccctctccagttcctgcacttaaaaagtgtagctgccttacaaggccctctactatttggctccataacttagaacctgcctttccaggttccaggcctatcaaacttttacttttttccaacgggtcattttctcctgtctttgaaacttcgtaaagatctttattacctgtgcctggaatttttttcttttcccttccttgctaatatttgtcttaaagccccaagctgagacatgatttatctctaggaagcttttcctgatgtcctaagtctgggtaagagtccccttttaggtactcttatagcatcctgcatgacccctgttacaataccttagtccgtattataattgctgttcattattttatgtctcctactagactgcacatctagtaaggagtatctgttttgtacattgttaatttcccaaagtctgacacaacatttgacacataataagctcccaataaatatttactgaatgtataaaattctcccagctatatgtacaacctgtaaaattgactgttcatagtggagactttattttccctttggtcttttcagctacactggcttacagatgtgataagatattttctttaggttcctttctctgtcttgcctcttgttggggaattgtttactcacccacagtgatttgtctctggctcccgttttactaaccagagcaagttggactaggaggtgtttgcctagctcaaactggccagtcagatcctctccttggtttcagaattaggaccaagagagtcaagtctgagtcttcctatggagctggaactgtaacatgttaacttagcacctgtgaggattcatacatatctttttttgtgtacagagaagctgagaacagaggtctgcagagagacaatgaagcagagggaagttgaagtgtaggattgagagaaagcccttaactgcccttccttaaacatggctgtatttctgtaccaggctctgtgacatgtttgtttccttataaattctcctgttttggtcaaaccaacctgagttaatgtctgttggttgcaacagactatattgtaaccaataaatagtaacaaaataagtggatttcctgtaataggccctcagaaaagatgcggatcaagctgatcaatggtgtcatggctattaggattctcttaccccggaatggtaaattggcaaaaacaagcaaaggtgttgattaggctgtggtctcttgtctctcagaactcaggtcaagtatgaatgagagtgaggttttaaagtttagtttgctcaagagagaaaaatggggaaggggcaaacttcagcgtgtttctaaggcctgtgacctgattagatttttgatgttggctttagcaaaaatgaaagggaaaaaaaaattgattggaagattttatgaccagaaaaactcaaccctgctgagcaagggcattggctgtcttaaatgaatggcgcaggaatctcaattctggagtgaattcctgggatatcaacaaaaattgaaattgaacactaaagtgatttagtcccctacattagaatctatcttcagtgtctctgatgagagacaagggaaatcctcttaaaacagctatgctgaatcttagctgcatattggaattatctggggaatttaaaaaaaaaaccagagattctaatttcattagtcttgagtggggcccattattccttattggcttttttttttttttttattagctgtgcaggtaattctaatgcagagccagcattgaaagcccgtgtcccagagccttgttatttagagtgtggactctggaccagcagcgtgccactgctactcgggaatttgttagacatgcagaatcttaggtctcacccagacctactgaatcagaatctgtattttgacaagatctccaggtgatttaaaattgaggagcactggcctaacacataaaacctaagacaccagatatactgacaaaagcacttcctcctctgcttaggaatgaagtcaacaaatcatgcccctaaagtttgccagtccctttctgttcccttagtatttctgtacagcaacgttttagagtttatttcccttttcatttttccaaaaggaaatttttaatacagttgcctggtttttcttgctgcattaaatattaaatattgtgggtgttgcataaattgcagagatatttgtattaggttcttgtgttgctataaatacctgagactgggtaatttataaagaaaagagatttaattggctaacagttctgcaggctctactggaagcatggccccagcctctgctgggcctcaggaagatttcaatcatggcagaagggaaaggggagcccaggtatcacatggagagcgcaggagcaagggggtggggtggtgccacatacttttaaacaaccagatcttgcaagaagaactcagtatcgtgaagatagcaccaagacattaatgagggatctgcctccatgacccaaacacctcccactggaccccactaccaacattacggattatatctcaacatgagatttggaggggacaaacatccaaactatatcaatatggaattggattacaatgaaacagaggaggaaaggatggcatagtgaataagagcatggactctggagccaaaatgcaaaggttataagtccacctgtgctatttagtaactgtgtaacttctctctgcctcaatttctttgtgcagtggggatagtaatatggttctgagtctacctgtgctatttagtaactgtgtaacctctctctgcctcagtttctttatctgtgcaaccccttcctcatggggttgttgtaaggattaagtgagctaatagatgtaaaacacttggaattgtgcctggcatatagagctcagtaagtataagctatgattaatgacaccatcatgctctccccatacatcacccatgacagtccacctgttgaggaaagtaggggttgtgtttacagttttatgaggtagattgagttatagttggatatctttaaacttggaaaaaaaggtgtgtgtgccggataggtaaggggcctgatgtgatgagcaaacacctttgtctatgatagtatatatatttttaaattcagctatgaaacagaagatttgacagaaataaagagctaataatttctcctttctggttttaatgcttttcataaaaaggaaataacatctttgatcaggcatggaatcacttggctttttctctctggtggtaagatgaagggggccagcccctccacacctgtgggtatttctcttcaggtgggacgagagactgagaaaataaataagacggagagacaaagtatagaggaagaaaagtgggcccaggggaccggcgcttagcatacggaggatctgcatgggcactggtctctgagttccctcagtatttattgatcactatccccatctcggtgagggggatgcgacaggactagagggtaatggtggagtcagcaggaaaacgtgagcaaaggactctgtgtcataaataagtttaaggaaaggtgctatgtctggatatgcacgtaggccaggtttatgtttgactttacacaaacatctcagtgcaataaagagtagtattgccgccagcatgtctcacctccagctataaggcggttttctcccatccaagtaaatagaatgtacgatcgggttttataccgagacattccattcccagggacgagcaggagacagatgccttcctcttttctcaactgcaaagaggccttctttcactaatcctcctcaacacagaccctttttgggtgtcgggctgggggacggtcagatctttctcttctcatgaggccattatctcaggctgtctcagtggggggaatccttggacaatacccaggctttcttgggcagaggtccatgtggccttccgcagtgcattgtgtccctgggtactcgagactggagaatggcgatgacttttaccaagcatactgcttgcaaacacaattttaacaaagcacatcctgcacagccctaaatccattaaaccttgagtcaatacagcacatgtttctgcgagcacagggttgaggctagagttacagattaacagcacctcaaggcagaagaatttttcttagtacagatcaaaatggagtttcttatgtcttcctctttctacatagacacagtaacagtctgatctctctttcccccacagtaagacgttgaaaaaaagtctaatagctcattgttgaataagagaacttttgggtaggatgaaattcacaaaagaaagttttgcactttttttttatgctcttgaaggttatttttatgtaaaagggagacaattcaaaatattttatgctacaaaattgacattaagttcatctagcacccagatcatggcctttaaatacaattcttcactgaaaggaacaagggcttttcagaaatgactgatttcatagaatgaaaggggcttaatgtaaaaattaaaaaagaagttaaaaagaaatgactgattccagagcaggggcaaaaaaagtacaagatgagccaatggtatctgtggtgttagaaagtaaggaggtgcccagaaaatgttggggacatgccagaagggcacaagacctagcttaaaagctgcctaccctttccccgtgaaatctggtataacccaagcaacaggatgcttggtaggaatagattacaatccataaaaaaagaacccatactgatataaataccattgtccaagagagaagggaacatttttccttacagtagaactccatctattaaatgtggaagacatgaggaattagaaaaaaatcttcatttgggaactgccgtattgataattatttcaggtagatatcaacagatactaaaactagtaggaaagttcagtgaacaacagcatatttacataatcacaaagtactttcccacaaaatacttactatgatggggaaaattataacttcgtactagagaaatctggttaacaacactttaaccaagtgatcaaagctaacatcaccaggaatgggaaagctccatatcagatgcttgatatggtgcattgcggaggacatactatcacttctgtgacattcctgccaaaaaatgcataatctgaatcaaataataggaaaacataagcccaatctgaaggacattctgtaagataaatggcctgtactcttcaaaaatgtcagagtcatgagagacaaagactgaaaaacttttctggattgaagaaaattaaaagagacatgccatctaaatataacatgtgatcctagattaggacactagtagcacaattggcaagattggtctaggtctttagatattaaatctagccataggaggcaataagaaaaagaaaaacttatatcaatgataatcttctgacttgttgatcatactagagtatactgttatgcaccacataaccacatctctattgacaacaaactgcataaatgaagatgatcccataagattatattactgtatttttgctataccttttctatattaggtatttttagaacacaagtaagtgccattgtgttacagttgcctacagtatccagtatagtagcatgctgtacaggtttgtagcctaggagcagtaggctagaccatatagcctaggtgtgtaggaggctgttgtaccatctaggtttgtgtaaattctctctatgatgtttgcataatgatgaaatcacctaatgacacgcttctccaaatgtggtgcataactgtatatgtaagcatgtcttcgtgtttaggaaataatacaaaaatatttaaacaaatggttcagaataaaaagaataaagcaagtaaatgttaagtaaaatgttaatatttgaggaacctgggtgaatggtgtataggagaaaagttaaaatgttggcattaaaattataaattcagacacctatttttaaaattcatgaatagtttataaatgcttaggagttaaccttttaataaagtttgtccctccactcatatgtctggggtattggttgggggagcagatggtggagtcaagactatggactggaacacatacatatgtcctttccagcatggcagtctcagggtggttggactttttacatggcagttccagggttcctggagggagtgttccaaaagccttgaatggaagtggcagattatcttaaggccaaacctcaaaagtcccagaatattctttccctgtagtaagcaagctactaaggtctggattcaaaggggaggggcattaggtttcatcattcaaaggggagtagcaaagaatttgcagttcctatttatctgccacaatgagatcttatttaacatatgattttaaaaaattccaaaaagatttagaaatcctacgtttctgagtctaatttgggatcatagtttatacaattattctagtgacacatgtcattgaaggatattaagttgtttataactgcctaagtgagcaaacatttggacagtacagtaagaatctatctacgaacccaaaagtatctgagtcaggtctaaatcaatttagaaggtttattttgccaaggttaaggacgcacccatgacacaccctcaggaagtcctgactaccttgtggacatgtgccctaggttgttgaggtacagcttgcaagtcaataccctgagacaccaaaggttgcagcagaaaaaaaattttaattgtaaggccgccaaaccaggggactggaggaaacttcagattctccttgagaagtttggagcttgagacttaaagaggtttggagtggaccaaggtgtgaggattgttgattggtcagagtgcaatgatgaagtcatgggatctagagatgaagaaactgcattctcatgctgattcggttcctgtcggggtgtcttcaaactggttggtgtcagctttctgctggaattcagcgtctgaaaaacatcttaagcaatgcttaaacaaaagccttatgattctgatgtcagagatcctacccataggagcaatggggatgcaagtcatcagtatatagggctatgggatgactttccgtacaaagaagtgggccaaagtgcagcgtgattaatgctcaattatatttctgtctagaacctggcatgcaattcttgttaaccctgtaaggacagtgtcacttttagggctcttttaaaatttgtctgtaaaatgagggctacaaatacaaaataattcttaatcaatttatagattatttgcaaagccatgttttattctgatcttgccagtgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtaagtattatcacttctatttaatagtaatgtgtcttatgtatatacaaagtaacagttcaaggttgtgggctttagaattaaacctaagttcaatgtccagctctgagaagaaacatctgaagaattaagatgattgcctctgagagcaggattgcaggctgcagcaaagagggaacactaattttcgttagaagccttttagtactgttttcttcttcaactttgtttatcgtaactacgtgaaattaaaactaccaaaaagatctatttgtgccccatgctggctctgtgaccttggccaaatcacttaagttctctggacagttttcttcattgtggttaataactgcttcaagaggattgaaagaaacattgaaagcatctcttagtgtgtaggaccattgaagtctctcaatatggcggtttctattgtcagtttttctagttctttttgatatatttgttacagtactacattaataaatagcacacatctttctcattttatagttatcaaagatcagcataaacactcaatattaggtgccctagagggttttttgtttttggtatgttgtgggatttccttcatttaggtagctgaaaatgaaatggtatacttggtatttgtcataaattgatgtttttcattaggtacagcccagatgtgatatttctacaggaagttattcccccatattatagctacctaaagaagagatcaagtaattatgagattattacaggtaacaatttttgttattcaacttgtcttttctttgaaaaacagatcagtgaaagagataaatcaaagttggtctattgggacatagagaggaaaaagcacaaataaataagtttgagaaaaataagcaagacacagaatactacaagaattataggagaatattttatacaacttaatattaatagtgtgaaaaggaaatggatgatttttcaggaaaatataaattactaaaatttgagaaacaacacctttttggtgaaattcagttgttaaaagttttaactgaaataatcacattgtggttattatgctttttcaaaaagtctttattttataattccttatttattttgttgttctttttgtactttttttgccctgagtaatttagtttttaaattttccatctaatttgtttttgctaaatatatttaaaatactactttggccacatctcgtgattttcatatacagtctttccttggtattctcagaggattggttctagggttcctcaatggataccaaaattcgcacatactcagtttcctcagtgtgctctgcagaacccatctatatgtgcgcactccatttctgcaggtttcatgtcctgggaagactgtattttcaacctgcatttggttgtggatgcagatacagaggaccaaccgtatttactgaaaaaatatctgtataagtggaccttgaagttcacttgtgttgttcaagtgtcaactgtatagtgctttctttgactttcatttttatatagtatgtgatttttagtttcaatcgactccttaatcgagaatttctaaggagagggttctctctcagtctgtgtgtgtctctctttatggaactattttgtattctcttggggattcttttaggatttctgattcccatgcttccttcttggtttacttccttattttattggagcaccttctctaattaatttctaggaaatagtgcatggatagtgaagtttttgaatcccagcatatttgaaaatgtctgtgtcgtagctttgtagttcttgatagtttggctgaagataggtatctgggtaaatagatgttttccttcagaattctgaaggcattcttcaatgtcttctagtttccattattgatgatgggtgataaggctgatgccattctaatttttattcttttctttttccctactctctggaagctttgagggtcttctttttaaccctcgtgttctttgggtctttttaaaatctattgtactgaatgcttggtgggaacttttattctgtggaattttaatatgtggaaaaccttagttggaaaatccttttccctctccctccctcccaccattcccctcgcctctcctttcattatctttgttatttctctttccttttctccctgtctcttctttcctcccttaagtttttttactctcccatttttctgaattccctctgttaaacggtggatctcctgggttgatccttgaattttcttaactttctcttattctcctatctctattgactgttctactttcttggcaactatcttgacttttagatagcattattttaatttcctaggcctcctattcactgaatatcttttttatggcacacttttcttggtttatggatacagtatcttttttgttagttttttgtttgttttaggttttaatctctttccctgcattgtttttatttccttctttttgtttattttgattatgttatgtcagtatccatcatgtcatgttagacctgttccttaaatatgtagggatccttggcttttggttcacatttaaacaccaaacactaaaatgttgattacagtttagtatgcctgagcaaggctaagtagtttaccttactggacaggggtgagggattgattgtagagcaaactgcttattcatttgagggagacccacaattgtcagtgtgttggtatatacaggcctttaatctgagaccattttgtttctccaaaaaagagttatttagctttctgccttctgggtgttgggactggggtggtgtgcttgttttgcctaccttctggaagcaggtgaggggaagggagctgagtaggcacactttacttaatcagtgttcaacctattcacctatcagccgtgggctaacatgcatgcccctccctgtggctggtgactctggagcctctaaaatttagttctatgtaaaactgtagtctcctgttaatagagggacagtcacttagctctaaggagttgaggaaacctgggggttgtttaaccccatatccagaccttgaactggccctcctcttcttagctcagcaccttaccttttgtggtacctttatgttcaagcactaagtgtttccagattttggtggaacaaatctgcttgcttcctgtctatggttctctgctacagtcactcaagtggtttccttctcttctgataaaccggttaccacttctccatctgttttctgttttctgaaaaactgttggaagctttcattcatggcctctactcctattttctgttcttgcaggtttatatctttctagatttttattcatttactataatttttctgaaacttctagtatgagaagtagtaagtggctatcagctggccacagttcatctcatctactctgtgtctttcagaaatttctcaaattttctcatctgatattggcagcattattttttggcacttgtttacattttttttcatttttatttattcatttattttgagacggaatttcactattgttgcctaagctagagtgcgatggcacgatctcagctcaccgcaacctctgcctcccaggttcaagtgatttgcctaattcagcctcccgagtagctgggattacaggcatgtgccaccacgcccgactaattttgtgttttgtagaggcagggtttctccattttggtcaggttggtctcaaactcctgacctcaggtgatccgcccacctcgacctcccaaagtgctgggattacaggcatgagccactgtgcctggtctttttttattttattttatttcttctaagcttctagctaaaatttgggagggaggaggtagacttgtttggccatgatgaactattttgaaataatagtttaaagatttagatccatgtaaatatctgttacctgtttgctataaaattcttcaataggcaaacttgtggtaaactgaaaataactctcaccttctcagcctaaattcttttccacaaacatttgtaggtcatgaagaaggatatttcacagctataatgttgaagaaatcaagagtgaaattaaaaagccaagagattattccttttccaagtaccaaaatgatgagaaaccttttatgtgtgcatgtgagtaatttttaaaaattgagtgttttataaaaaaaagattttttcatagttttgtgttattattctttttaaaaccattgcctttagagaaaaatttgcttcacacatgtagattcttttagatagtctttaacactctctaaaattaattttttacataaattttaaatgcagatagaattctcagtctattgttttcttaagaatatttgagtttgctgacattccacatttgcttcctaaagtaatgtttttactttctactctatacatgctgctatattttactctatgagacttacaaaaatgaaaaatagatcttgctctgatatagtatatagattagtaagggagagtgtgtatatagtaactaaaacataagaaaggcataagtgccacaggagaggtataaatgatgtgtggaagtttagagaaaggagagatgacttttagccagattgtttagtgagagttttatagaggagatggtatttgaaatgaaccctgaaaaatatgtaagacatacatattaaaaagagtccaagtagagaaaccaccatgagcaaacttttgcaagttgcaagaggtgtacatgtatgagtatgaatgagcattctattcagttgagtgtaggggccatggagaggcaaatgtgacaggttgagaagtaggtaggctcctgattatagaagagcatgaatgaccaatatgaaagaattagacttgattctgcagacacttagtataatgatagattgtacattgttggtgtcttaattgcaaatggtaaatgattctcattcattcagttaactgacttttttggaatacctgtatgccaggcccttaataatacagcaataaataagaatcatctctgctttgcaaatgacttatggctttgtaggagggaaataattgtccttttaatttagcctagggggctttgaaacagtctgttcagcatgcctttggtgtattgaggagggagccgctgatggcctggggacactggggaaaggttcacagtggaggtgacatctgggggtaggtcgtgcttgctaaaccgtcgtctttggggacagggttactgctttaatacttcttttgatccggagggataggcatagtgctgattttacagtttcagtttagtaaatatataccatttgacagaacaatctgctgattttattattaaagttcagtattaatagtcagtggacagttttaatgactgtttgtcctgctgcaggtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggtgagtgacaaagtcagtttgatgtttgaggacagattattgctatggagactaatttaggttcctttgaccaaagctgttaaaactaggacctttagtcactcaaaatgtcttaagtgaccttgcaattcagcgaatatttgtttagcctatgctgtatgcctaggggaagaaggggctctttttggaggaaaataaaaatgtgcatgagaaatagacaacactaaactatatgtgtgtgtgtatatatatatatataggattagaaagaaaggtagagaaaatgattgtagaagagtttagaaaaggttgtttctttgcagtattcctaggtgcaatatgagaacaatggaaagattggaccgtgataattgttcctgactctctttttttctgaggtttccttttcttttttcttttttggcttttattagccttttttacccacttttcctgccaccaccatgtccagatctccaggtctgaaacaaagtctctttctccctgcctatagctcagttgagacacagtgggatttttcaggaccttaaaaaattaaacatggaattactaatgtgatgcatcaattacacttctaggtgtaaatacccaaaagaagtgaaagcagggatttgaatgtattttgtctacccatggatgttcacagctgtgttattcacagtagctaaaaggtggaagcagcccaaatatcactgacagatgaataaacaaaatgtgctatatgtatacagtggaatattattcacccttaaaatgaagaaactttgacacatgctacaatatgggcgaatcttaaagacattatgctgagtgaatgaagccaatccaaaaaggaaaagatactatatgattcctcttatgaatttcctaaactggtcaaattcatagagacagaaagtagaatggtgtttgccagggactgggggtataagggaatggtgaattggtgtttaatgggtacagagtttcagttggggaagattaaaaggttctggagatggatggtagtcatggttgcacaactatgtgaatatacttaatgctacatcactgtacacttaaaaattgttaaaatggctgggcacagtggctcatgcctgtaatcccagcactttgggaggccgaggtgggcagatcacttgaggccaggagttcgagaccagcctggccggcacggtgaaaccccatctctactaaaaatacagaaattagccgggcattgtggcacatgcctgtgatcccagctatgcagaaggctgaggcactagaattgcttgaacctgggaggtggaagttgcagtgaaccgagattgcaccactccatcctgggcaacagagtgagactcccacctcaaaaaaaaaaaaaattgttaaaatgataaatcttgtattgtgtatattttaccgcaaacaatttttttaaatcctggagtgtgaatgagcaaacagaattaatattattaataaacttcaaataaaactgaaggcagttgaaatttttggatcatatgaatgctatacttctgaagttgtagactaaagtagagtggcagttctgccttcttttcacttgagttcagtttttgaaaacagataacagcagtaacaggccatgtatattcagccttctaagttttatctgaaacccaaagttaggaacctatttatggcagaagagaaggggcaaattccaaacccctctggctgtcttgatatttttatattacataccactatgcagcatagtactttttataatgtatctcattgttttgcatttctgcattaataatttcttgcacggtaatagcaaaaacacctttttttttttttttttaagttagtgggcaaaaggctatgtgtatcttagagagtattcttcttcttttcaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttta

SEQ ID NO: 36128 - DNA, 12887 bp, Homo sapiens
acagaagtgctagaagccagtgctcgtgaactaaggagaaaaagaacaggtaagaacttttactacttctcatcaagcagctttctctctagctccaaaggatctcagctcagtgatatggaacctataaggttgtggcagggatgggaaggaatttataaaggtcagttcattttcttaaacatcatcagaaccaaattaggctgcagatgagcctgaagtgggacgcaggtcagatgaaatcctggtgttatcagggacagcatggccttaagtgccactacagtgcttgtgttgaattaggcaccagtagacaggggctaaactgagcatttgaaatgtactaggatagtctttctctttgttgacattatctatgttgactagggatatgattacatttccatcgtcagtgatggactgaatcctgcttctatgcagctaagaaatggaagagttacaaacgggttcttttcatggaaggaaagaacagcaaatgagaagcagagtaagcagcccactgacacggttaaagacaaagaaaaaactgaaactcagcctgaaagatgaagattcatgaaaacagtatactttttattacacttgtgaactttgtttcagaatggattactttctttagaaatagtccagactcactaatttcctagtgcccactgatccctgtcccttagaagtgaaattcaaccccactgcttcactgaagtgcttccaattttgtcttcttttagtagagagcagggccaaaagtgtttcctctttaattctcctgtaatgcatctctacagaaaatatctttgcttactttaacctctccatgcactcagactactttgatcctgccttctgcaaagtcttcccctgaatgccttgtcaagacactagcctcattcatcacctctggtctgacagctcctctctctctctctctctctctctctctctctctcacacacacacacacacacacacacacacacacacacacacattcccagccccttatcctcctctccactcctactattcctcctctttctatttctctttctcctaccctaccaaatggaaaacagaacaaaacagaaatcctaaagctgtatcgctggaaatatattttatttgaacaacttcctaggtagctctctttatctgcctcttgatcttttaatccttattatctggaggaaacattcagtatttgcaattttgcattcataccctcagtgacttagaagctatcttatcgtgactctaatgaagcttaagtttcagggcccttctcttggacatgacccttaggagcccttggaaggttccctagccatgtgtttcacatggttgtatagttttataaaatttgcaaaagtatgttacattgttaccacttccagaatggcaatgtgagaagctttgtcaatcctcattgcagtgaaataagcataatcatttgaagatggaggaaggaacacatttaaaaatctttggaaatttttctaagggtaaacatcaaactatgaatactgattcactgtgttggatgtttattcactgtgagaattaataagtgaatcaatattgaattccttacatacagccaggatgcaaataaatcctctaaatcctattctatcttccattaattgactagtgaaaatatctaataagaatccaaaaagaaagttttccacaataaactaaatgaaatatttgggtcgtgagagtagttgagtgttgataagtcactgtcatgctaacatttttcataatgagctactttgacaatacttccataactttctcaaatgatacagattttgcctcatctcttttgctgtcacacacaaaacttttggccatactggggaatcttatgattctcccttataattgcaaaacactagaaattctcatgtatttcacctcttctcttgcagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggtgagtggcatgagcaaagctctgccaagtcccttctgtccatctacacagtcagcctccattatgaagatgtgaggagagaaagagatgaggatgaatactgaaagctaactttccattcacagtcgggctccttatcttcacgctgttctaggggataagaatcaattcattaattattcccatgataccttagtttccatttcaaaagcacaaattatgcctctcctaaaaggagtaagacagtaataaaaataattaatgtacataataataactataataaactatacaatgtttattacaatttttatgcaataacagagttcacagtgatctttaaggttgaaaaaatgtttcaatctgtagtggatattattttttgttgttgtaaaaaaaataaaatttaacctcgtaaccatttttaagtgtacagctctgtagcattaatgaaattcacattgttatacagctgtcacctccatccatatccagaaatctttcatcttgcctaacagaaactgtattaactaaacaaaagctccacataaacccattgcctgccatcattctacattctatctctatgaatttgactactacagaaaccttatataagtggaatcattcaatatttgtccttttatgactggcttatttcaattcatatgtcttcaaggttcatcagtgtgttagcatgtgtcaaaactcttcctttttaaggcttagtaattgtacgtgtatactaatttgtttatctcttcatctgtcaatggacacttggatttcttccaccttttgtctattataaataatgctaataggaacatgggtgtctgaatatctgttcaagtccctgctttcacttcttttgggaatatacccagaaggggaattgctggctcatgcagtcattgcatgttaactttttttaagaaatcactataccattttccacagtgactgtaccgttttacattctcaacagaaatgcacaagggttctaatttctctacatcctcaccaacattttttattttcagtggttttttttttttatagtggccatacgaatggaagttaagtagtatctcgttgtggttttgattttgatttccgtaatgactagtgatgttgagcatcttttcacgtgcttattggccacttgtatatcttctttgggagaatgtctattcaagtccattgttcatttattaatctggttgtttatttctgttgctttgtaaatttttttatattttctagatatcaatcccttatcatatacatgtttagaaaccattttcttacattccgtgtgttgccttttttaactctgttgatagtgtccgttaatacacaaaagttttaaattttgctgaagtcccactaatctattttttcttttattgtctatagttttggtttcttattcaaaaaataatttccaaatccaatattataaaacttttaccctttattttcttctacaacttttatagtttcaactctaatgtttggttctttgatccattttgagttcatatttgtaagttataaggtaatagcccaactttttaaggagatatatcatttcctcaacatcatttgttaaagagactctcctttcttcattaaatgatcttgacacccatactggaaatcatttgaccatatatatcagagtttattcatgggctgtcttttctattctattggtttatatgtcagtctttataccagtaccacacatggttttgtaatacgtttcacaactcagaaactgtgagactccaactttgctcttcctttttatttttataattaggggatctctggaaatttcatatgaaatttatggtggatttttctatttatacaaagtaattggaatgttggtagggattatatcaaacctgtacatcactttgggtagtagtgacatcttaagaatattaagtcttccaatccataaacacaggatgtctttctaataacttatgtcatctataatttctttaaagggtgtttgaagttttcactctacaagtcttccacctgcttggttaagctgattcctaagtagtttattcttttgatgctgttaaattggattgtttccaaaatttccttttctattttttacactagcaactgatttctccatattgactttgcatgctgcaactttgatgaattgttttaatagttctaatagttttttgtgggatagttaatgttttctacaaattagatactatcatcagcagacagagataattttactttttcattaccaattaggatgcctcctttatgcttctcttgtctaattactctggataggacttgcagtgttctgtggaatgcaattgacaaaagtaggcatccttttcttgttcatgatgttataggaaaagctatgacgtttcatcattaaatgtgaagttagctgtgggtttttaatacatggcatttattatgttgaggtgctgtctttctatttctactttgttgattatttttatcatgaaagcctcctgaatgtttccatgcattggatattcaaatttcctatttctttgattgtaagtacgtaaggtgaatactgattgttgtttcagttctctctcttaaccttaaatatactactttttccttcaattgccagaactgcctgttactaaatccccatcgctggtctcctctctcccttgcaggcttctctctgggctccacggtgcagtctcacactaaaggaatctggatgtggtgtgtgccccaccccaagaagccaggccacatcctagttctgctggacaccgagggtctgggagatgtagagaaggtgagactcaaggatccagttgtggagtaagcccctcctctctgaatattttatgcagcggttaattgtttattaactattaactacaggctgtaatatgtgtgggttaacacagatgcataaagggagcacaaataatcccagtgtcataagtcttatcctgcacagaactttagttaagaatttgggtgctaaagccatgtgactttgtatttaaatttaaattctgtcactaattcagtagcctgagaaaattgacttattttcgcctcagcattctaatctttaaaatgtatggaaaagacctatgttggccatatagtattattttgaatatttaataagataatacattacaggtgtatattaattattcaataaaatagcaactaatagtaccaatcttatatgtgaattctgttattgaaaaaaagaagagaaaattttaaatttacattgtactcaggccttaaaatgcccaccaaccttgaattttaattttacaattatctgttgatgatcattagaagacctagtaagaatcatggtaacccaaaaacactcgtcgaaaaactacccaaaagccacatcctactgagaataatttttgtatttgtcttcctttaataggtcattagtgttaaaaaaaaaaaaaaaaaagaaaagaaaaaaaaaccctctaacatatgaacatagttttactactgttactctgaaaagtgctgcgatgatgaaacttgctcctgactccagtgtgtcttgacttccagggtgacaaccagaatgactcctggatcttcgccctggccgtcctcctgagcagcaccttcgtgtacaatagcataggaaccatcaaccagcaggctatggaccaactgtagtatccttttgtgacccagaacagcaccaaggtcagaggggacacctgtattcatacaccagctgcctgactgtgaatcctgatgaatcaagctcaaaaggagaaaacaaaaaataatgcaagtacagaggagagatcccatgtatccactttagaactgacactgacacttaggttaggagcaaaggaaaatggaaggtttgggtatgtgttgaactaacatgggatgaggtccctgttcattttgtcacatttccttagttagctactcagctatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaacagagagcttcaactgataaatgaggatgagaaaacacaagaaattatcatttttcagtttactattgctagttttccagcatttgcagttttctatgtcttcagctggctattcctagaaattaatacttgctgaatatccaaattaatagatgttattttaaattacatttgtcattgttctagaacaagtttcttgttctttcacctttgtgtatgctgtgattaggttaattttatctccctgcctagggtttgtgatcttctacttagccatagagtatggagtacaatggatatttatttaaagaacatagactaaaacatgaaccgtgtgctagtccaagcattggcaaactacagcccaagacaaatcatggcaaatcctgcctgccagctgtctttgtaaataaggtttttttggaataatgctatgcccattcatttacatattgtctaaagctgttgtcatgcttcaataacagagttgaatacttggaaaagagaccatccagcctgaagagcctaaaatatttactatttggccctttacagaaacacttatattaggcaattttataattttttaaatgtttttctaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtaagtccccttcctagtacttctgctcattgtttaagactagaggagcatagaataacttccacctagtttcagcattgaaaaatcccaatctactgctatatttgtgttaaattctagatggcaccaatgtttctaacatatattgttagtcacatttccagtctaggaaaaggccaaaggaaaaaagttctattgcttgaaattgccctagtgaactggacctgcactatgcaatagagtagcccctagacaagtgtgtctatgtaaacataaatgtaaataatttaaatagggaaaatttaaaagtcaattcacatgcctgtatttcaaggactaatatttacacgtacttagtgactagcacactgaaaagcacatatacaacattcccagcattacagaaagcgcttttgaacaatactgcaataaaataaactaaatggatgactcttttttattggaatagtgtcatttgtttcatacatattgatcaaatgcttactatgaatagactgaagatacagatataaatgaaatagatatggttcctgtcctaatgttggttggggttaaaatggatgcaaacattcaattaacacaagtctatgtaatctagtacaagaactctcaaatgttggtatgcatacatatcttctgaggatcttaccaaacacaaaagtctaattcaatagatctcggacagggtctgagagtctatttccagcaagcttccaagtgatgctgaggacattgatgctgtgaggaaaataggtggtatttgacatgctcagaattacatggaatagagactttctttaccaccagaaacattatcatttgttcttcatatgcaggtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggtaatttttgtctcaaatgtatacggtttagggtcatagaagctaaagtaccacaaggaaagaaaactattatttattttgacggaagtaattcctcctagcttccataatggtgaaaacaacagatttgtgatcacatcagtcagaaggaccaactgtattattacagacccaaagttctaaaacattttttcctgaataattttccctttacttatgcatacaactgacaaccagagcttctaataaaattacctgcccactcttctcagactgatttgatattctagccaaacacaaagaaaattttcatcctacttatcttgagcaggcttccgttcagccacatttattccatatgaaatcattagtccaatatgcaaaaacagagttttcctctaacagttgacataaagctatcaatctcagccctgaacctcacctccaaaaagaaagcgacttcagcagaaagtggggtcagaaggaagagtgtggtcctggtgaggaggctgtcagtttctccagcatcattgacttctattttcagaaatcgttcccaaaattctgaggtcaagctaacatcctttccctgttactctttttacttcctatttttacattaaaggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggtaaccaagatttatctgtcaattatggaaagctgctgacctgcctcctacaaacaccaaggtgaccaagcttcactgcatacagatgtgcttttttgtttgcataacattcatgcttttattcaataacatatgcaaacaggctgttataccagatatgtcctaggtgctcatcaaagagagtgcagtcaattaactattaagttataaattcaattagcagatgaagcacaaagttattattgtcatcattacagctgggcttttcctgttgcaagagacaggaacccaatgatggctgcttaaacaaaaatgtaattcattgatttaggctgcaaactggctttacaggtcaggtgggtctaaggtttcaagtaacatcatgaactggctctctgtccagtgttcccccatccccacagttttctccctcccaccatccctctatctgagtcactctgatatttgctttctcaatgatggcttcattccccagcaggctcagcccatatgggaccacagcattaacagttccaaacttagagcccttaatctaaacaggacagagactctccttttcccagtatctatattagcctactaaaaatgactgctaagtaggatgttctgatcggcttgccaggagcatgtgtctgtcgctccgacagggaatttgaccaccaaggacaatagggccaagagaaagaattcccagaggagaaaggatggcaggaagacaaacaggaacacctgcttacagccatttcctacttctcactctgtgttctctgggtcctaaggctgaagagattctgcagacatacttgaaatccaaggagtctatgactgatgcaattctccagacagaccagactctcacagaaaaagaaaaggagattgaaggtgaggagtgagttaagagattagatggcctcaaaagctccaaaaattgaaataacttgactggataaacatgggaccctttaactagagcaagatccacaaaggtgtgtcttacttgccgaggtcatctctgagtagggcatatgcagtcagcaacaacgacaggtaagtgtataaggaagaatgaggcaacaagataaccccacacaaatttttcttctgccttttcctcctcagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggtatctaattgcatcaccttgaggtttctgtttttctgttttctctccattctccctgatcgcaaacttagtgtggcagagagaacatgaagcccagggtaaggaccctgcttgcttacttgtacttttcaattcctgtctgtccagcctgactggctactgccaagtctggtcactgaaagttttttatttgcagttgtgtaacattcagtcctttatcaatatatccttcatttcaaggaagctattatctgctaggcatcattaaaatatctgtatctcggtggggcattgtggctcacgcctgtaatcccagcactctgggaggccaaggcgggcggatcacgaggtcaggagattgaggccatcctggctaacacggtgaaatcccgtcactactaaaaatacaaaaaatttagctagatgtggtggcgggcacctgtagtcccagctactcaggaagctgaggcaggagaatggagtgaacccaggaggcagagcttgcagtgagctgagatcgcaccactgcactccagcctgggcaacagagcgagactccaaaaaaaaaaatctgtatctcttgcttaataacatatgtagcaagaactatatccttattacttagaagaagaaacaaaggttccaaaaagaataaataattaagttcacacagctagtaaatatatcagagctgtcttcatcacttagcggaatccacaatgattatttgtttctgtgacacctactatgaaattagatttaagaaacctttatgagcagaaaggctcctaaccctcacacctgtgtgatactctgctaattctgattatttttaatgtcctgctcccagtttgttttgagttgtgagctatgtgcagaaactcagtatggtcagtctggcactcagatttcttacctgtcttctgctacccctgacaccaaggtgtggcagcttagaccaaatttcctaatccatgattcatacaccttatgagattttgaggatactttgcttatttcggtgttatgtcatatacataatagggtaaggaacatggctgtgctttggtcaatgataggccaaagtatgacatttacgtcttgcgtgactcagagaaaattaaataacaaatcatttaatgtggaaaccagatagaatgtttcaatttgcctgatgctacactttactcagccttcgtttgtccctttttaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccgttagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaactcttaacactcatacttgaaaactttctgagtttccccagaagagaatatgggattttttttgacatttttgactcatttaataatgctcttgtgtttacctagtatatgtagactttgtcttatgtgtgaaaagtcctaggaaagtggttgatgtttcttatagcaattaaaaattatttttgaactga

SEQ ID NO: 36129 - DNA, 45434 bp, Homo sapiens
aaggaatcaagcccccaagatggcggcagcggcggaggagcggatggcagaggaaggaggcggcggccaaggcgacggcggttcctctttggcctccggctctacccagcgacagcctccaccgcccgcgccacagcacccgcagccggggtcccaggcgctcccagcccccgcgctggctccggaccagctgcctcaaaacaacacgcttgtggcgctgcccatcgtagccatcgagaacatcctcagctttatgtcctacgacgaaattagccagctccgcctggtgaggcccccgcagaactcctgcctccctctccccccggccgaggtctgggagatgagaagggagcgcgttccccgggaagggagccccccgcgagccccagccggctacagatctgggagggagccgctcccgtcccgaactctcccttggcgtcagtcagcaggagtgggctggttcccgattgcgtcctagctgcggagctggggttacttcctgaggggacttcgccttgggggctccttgccccccgcccggaagcgggccctctacgggaggggtagcggagttggtcttcccaccttccgcctggcccgagagtagacccggagaggtcatgtcgcctgccttttgtatgccgcttccagcccccggcctgggtttggggagaaaactcagaagtaggcagatgatcccagccaggtttggtttatcttgcaagaataacgaattgttccccaccccaaccacccaagttttcttgttcgagaagattgagtagactaaggtggctcagtgaccccaaacccaggtagaggttccgaagaattcgaacgtgtttacttagcgttagccccagcgccctaattgaccactaaagtagagccttgggaaatgaccattcctgctttgcctcatcctaacgcttcccaccgtagagaagcaacttaccccttgacgggttttttctcttttgcaatttatttttaactagtgatttacgcccacccacctgctttaggagaggtttctttataccttaaaatcacaataggtcagtccatgatttttaaaaataatgaatttgccattggggttttacttcactccagaggtttgaagatgtggtgattgttagttcagttagatattttgctgcctttcaatgaaattatctttaagtggtaaagaaattgaaggaggtggacattttgaagtgattgcaaaccgattccatggagaagctaaatctgtgctgggaattgtttttaagaggacaaagatatttctgaatgtgctgtgtataacatcttcttattactcaatatgctatattgtaggcatacacctccactttcaagtggattataattacatttttaaaggaaatcataacatttttaaaagagaacttataaatattaattcaaactgatggccaattttttttctagtcaacacagcagttcaaccatgccagtctgcaggatggaaaatttcttcagctgaaaatagatatttcacaattgattgcctctgaatttccaaaacgttttcattctagaatttcatgtagaatcttaaatattccttcagatttttacaaacagtggcgtttaatcaaaattcgcgctgtacatatacagtgtttggaaaattgggcatataacatttgattgaattgaaccattcaaccagacaatggctttgtaaatcttggaatattcacagttctgttttgtaagtgttgagaaaaactgagttttatttgtttgttgatcattttactattttaaaaaaatgtagtggggaggggggaaccagcctgtcctaactagagttaaaacacatcccacaacttatgaataaatgacatctctgtcaggtgagatattcagctgcattcttaatttttaagcagttttctggccttttaaggttataaatttataatttcaaactcagatttttcataaggagtcccttcagtacaactgcccacccccaggaaaagattctgccccgttttacatgtgcaaatatgatttttgagtaatggggaactattttttttacttaaggctaatggataattcttgaatagattaaatggataatcctttgtggggagttggaagtgtctttgcttggaaggtacaattcaagtaacgttagaaaagaaagatgttcttttttgccactaggtgtcagcattaatttaattatgatcttttctgaaattggcagtcaagagagtacctaggtgagctgtacatgccttcttaagtagccatttatacctaaagaatcgtttgcaaaaaatcaagggactttagtgtatgctgctatctgacatataagttacgtagttctcttcattgtaagcatatttttgagtggaattaaggctggatatgctttgaagggggtaatattaagaacagaattagttttcataaagctaaatgtcagttgttaggtaggagttagtttatgtattgttcagggactttttttcttccttctcagtttgcttgtcttattggaacctcagttacaactttgcttagcatctaatgtagacaataaataggtacacaatccatgtacttactactctgcattttctttaaaagatttgctctaggttgaaattgctacaataacatttttcagttatttgtactgtttagttgataatagtctttgcttcctcttaccatgaataactgatttccaagggactgtgtgaatgccttattaaattggatttttggctgggcgcagtggcttacacctgtaatgccaccactttgggacgccgaggtgggcagatcacctgaggtcaggagttcaagaccagctggccaacatggtgaaaccccatctttataaaaatacaaaaattagccaggcataatggtgggtgcctgtaatcccagctacttgggagactgaggtgggagaattgcttgaacctgggaggcaggggttgcacaacgtgagccgagatcgccgtctcaaaaataaaaataaaaataaattggatttttttttttttttttttgagacggagtctcgctctgtcacccaggctggagtgcagtggtgccatcttggctcactgcagcctccacctcctggggttcaagcgattctcctgtctcagcttcctgagtagctggaactacaggcgcacgccaccatgcccggctaatttttcgtattttagtagagacggggtttcaccatgttgcccaggctggtctcgaactcctgagctcaggcaatccacccacctaggcctgaatttatttattttattttattttattttattttttggccattgactattgatcaaaagatgtatcctgagtctggtggtttcacagaaattactccttaaatatttaactcctccaatgtaaaattatttggctgaacacaacctttgaaatgacaaaacatgtactttgagttgtttttccagtaaaacagagaaatttgtgctgatgcagcattagtatgtcacccaggcccccttggcaggtgggtgagagactctgaaacaagtggcaaaggttaagaagtgagatcctggctcacttacagtgcggtggctcacgcctgtaatcccagcactttgggaggccagggtgggcggatcacttgaggtcaggagttcgataccagcctggccaacatggtgaaaccccatctctaccaaaaatataaaaaattagccaggcgtggtggcacacgcctgtaatcccagctacttgggaggctgaggctttgaacctatgtaactttggcttatgagcattatattcttacctactgaaaaacaagtatagggagctttttaattaattaattaatttatttatttatttatttatttatttatttttaatttttgagacagggtctccctctgtcgcccaggctggaatgcagcggcgtgatcacagctcactgaagccttgatttcctgtattttttgtggagatgtgatttctccatgttgcccaggctggtcttaagtttaaactcctaggctcaagtggtccgcccacctcagccttccaaagtgctgggattacagacgtgagccactgcacagtataaaaagggtaaaaaattttttttctatttatttaaagtacaatataaaaagggaaaaaaaattatcctgtttcaaacactgcattatataattttacctgccctacaggaggcttttaaaagatgttttagagagatactatcaatttttttcctctgcgattcaactggagctcttatcattttaattggaatcatattagtggttcagaacatgaatttgactaaaggttaagttgagaattcttgcctattttctggaatgaaattttccagtcagcaacaaaatacataaatacgtgcttttgtctcaagatatttctctagagcactttagctaattaaatctattacctatttatagttcctttcacatcttttcttcaaatatgttagaaaattttagttatagagtgggttggttggtaggaaatatgaaggaaaatgaagaaccattacttctttttttgtttttgtttttaagtaggcaagctgtcttgtatctctcactctgcacaagagttctcagtttttttggtctgaagacacctttacacttttaaaagttattgaagacccatagaacttaccttggaaaattctagaaaacacaagaatacacataacatattccattagctgtcagaacaataatgtcagcacatgtcatattgcttctggaaaattccactggatactcgtgagagaatgagtggaaaaggcaaataacttcttggtactctgagaatagtttggccttgcaaacctcctgaaagggtctccaggaccctggggatctcccactgcccagaccacactttgaggaccactgctctgtattgctctattccagagaatacactcttgctgattttttcttttttttcttttttttttttttttttgacggaatctcgctctgtcgcccaggctggagtgcagtggcgcgatctcggctcactgcaaactctgcctcccaggttcatgccattttcctgcctcagcctcccaagtagctgggactacaggcacctgccaccacgcccggctaattttttttttttatttttagtagagacggggtttcaccgtgttagccaggatggtctcgatctcccgacctcatgatctgcctgcttcggcctaccaaagtgctgggattacaggcatgagccaccgtgcccggccccactgattttttcttgtatttttctcccaccatctcttcaggctattgattttattaatgagtgcataagtacaggtaagaaattataatctcttgggggcagttcgttcttccagttctcacaaagtaaagaggttcagtcagtaactctgtccactgtgtcgtcatcaagagaaaatatacataccttccttgagcacacttacacagcatcaggataacaaatgcaaagatggtaaatatgagtgttgaggttgattaggacttaatcaggaaagacctcctcaagataataagtttttatccagttaataaaggtagaagagcattcccagcagaaaaaaaacgatgtgtaaattattgaagtgattggagaagaatgacttagagggattcagataaacttgaatttggatatgtgaaattgttaatgttctagattagtggtcacctgtcctcctgtctccccagcttttttatttcacagaccagtcagatttaagaaactgtttttgagaacctccagggctgacatcttttggtgggtggagcaaataagggcattttaaaaaacaaaacaacttccgtctcgtatcatcatcatttcttaaaagacaccagatatatctgcataccttgataaactgagtagtatgaattcttacaaaattgaagaagatactatgttaaaaggatgacctgtgcatataaatccaatttcataatttttgagactgggagcaaaagataacctttaacagaggtttcccttaaacacctacttctagcatcttgtacttaagattgattgaaacaaacatcaagctcttcagtttcccaaatatcttgggcctctgcaaacacatgctttttcctgtttcgctctcctagaaaatatttgtacctttggcatatacctcattctataattcttctctgaactttatgtaggtaatatttctaagtttccattgcatcattattgcacttactacattggaattatctttggaggagcctgttttccaattaccttagtctgtgatgcaatataagtactcagtaattattgaataaatgaagtagctcttaaaaaccatttcactgctctgaataaacaatagaaaatatatgtcattgtagggctgggcgtggtggctcacgcctgtaatcccagcactttgggaggctgaggcaggtgaattacctgaggtcaggagttcgagaccagccttaccaacatggtgaaaccccgtctataccgaaaatacaaaaattagctgggcatggtggcgggcacttgtaatcccagctactcaggaggctgaggcaggagaatcactcggacccgggagccaaaggttgcagtgagccgagatcatgccattgcacgccagcctgggcaacaagagcgaaactccatctcaaaaaaaaaaaaaaaagaaagaaagaaaagaaaatgtatgtcattgtaagataaatgttttctgtataaactataatagtgttacaaaatcagttgcttaatatttacttccaagagaggagattagaactttttttttttacatttttcattcaccctagaatgtctttaacattttacaagaccattttaagaaaatgagtgactaaagaaaactcttaggagttattaaaattgattgatacactgatctgaagccagtatgtaattaacaagatagccatttgcaatagtgcatcagggttcctttgttttagtcaacatttaattgatttattaatgagaaaaataatggtacagataatcaaaaactgagaacaatccaaaaggcttttttatgtggtggttaggatgcattataggaatcctaagaagaaattcttcctaattgttatacttagactgaaattaaaatgaatttatattttctttccaagtgaatatctagggtatatacgcagagaatctaaaatttgttgtaattctaccagcagataattgagaatttcatatacatatatatgtgtagtatattcacaacacacacaatatagtaatacaagtggtgtgatcttaggcagtaggtagaagagagttgctctgtcacccatgctggagtgcagtcgtgagatcacagctcactgcagcctcaaactcttggcctcaagcagtcctcctgccttggcctctctaggtgttgggattgcagacgtgagccaccacacttgggcaaatagaactttttttttttctttgagacagtctcaaggctggagtgcagtggtgcgatcttggctcactgcatcctccacctcccaggttcaagtgattctcctgcctcagctccaaatagaattttttttttttagactgagtctcgctcgctctgtcgcccaggctggagtgcagtggcacgatctcggcccattgccacctctgcctcctgggttcaagtgattctccagccccagcctcccgagtagctgggattacaggcctgcaccaccacgcctggctaatgtttgtatttttggtagagacagggtttcaccatcttggccaggctggtcttgaactcctgacctcgtgatccacctgccttggcctcgcaaagtgctgggattacaggcgtgagccactgcctggccccaaatagaattttttttaaagattaaagtattcttttggaagaggtgggaagttgtatccatatttaggtgagggaaattaagatgagttcactgaaaacacaaacaggacaagagaagagccagaatggttgtgattcgttcattattcattttttaaatgattttttcgtccatcattaactttttgccacatttgctttatctgtttcacttttgtgctcattttctctctcctgaatgtgtgtatgtgtgcatctatcccaggaacattcttattttaccaaaccatttgaaagtaagatgaaaatactgatattttgccccaagtactttttataatgtgatcacaatatcctcatttccaggggatttaacattacagtttgtattcagatttctcagttgtccccaaaatgttctttatagctctttgaggcgggtttattcagtctaattaaggattgttctctaatctagaacattgtccccacttttttcattctttcatgccattgacttttttttttttacagccccccccaagccccgccaacacacacaatgaatgccattgactttttgaagactaggccagatggcttgtaatggttctgtaattcacatttgtctaattttttccttgtgattgacttcaggattttgaactttggaaggattataggaaggtcttgcgctagctccatctgtctaacctttagcagtgtggtgagaatgcctgttaatgtccttaaaaatcccttattacctcaagaagtcctaccttttagagtagtgccagcagttctataacagcagagtatcagttgggactctaatcaatttgaaataaataggataattatttcaggttatatagctgtgggtcaccaagtttaaaatggcacaaattagaagacctggattcttagtttcccttttgctgctgaatagctggatgaccttggacaaatcacataatttcttaaggcctcagctttctcactttaaaaaaaaaggataggttctgatgtctttaagttcctttcagttctggagtcttaacaagcagcctaatcagcttgtgatcatttaagaactgtagagtgccaaactaatacattttatttatttattttggttctctgtttatcttacacaataatgaatacattttaaaactgggttccagctgggcgcagtggttcatgcctgtaatcctaacactttgggagaccgaggtgggtggatcacttgagcccaggaggctgaggtgggaggattgcctgagccccagggaggtggaagcctcagtaagccgtgatcgtgccactccactccagcctgggcaacagagggagaccctgtctcaaaaaaaaaaaaaaaaaaaaaaaattgggttccaatacaatatttccatgattctaagatataagggtctcatatttaacatttttgaaatcagtgcatcttgatcaatttgtatgtatattatcgtggtggtgccttttttttcccagaaaagtttttattaagttggtagcatgtctcaaagtctctacagcatcttaaaatcgaaggagttgagcataccatatttcaaggcatctaagaaaaaaatgccgccaattataatgctaagacattatatatcgtaggtctattccactgtcaaatgtttaaaaatgtgcatcttagaatcagttaagacttaaataaataaaaatttttgtaaaacaatcagttaagacttgaggccaggcatgatggcccatgcctgtaatcccagcactttgggagactgaggcgagtggatcacctgaggtcaagagtttgagaccagcctgatcaacatggtgaaaccctgtctctactaaaaacacaaaaaattagccgggcgtggtgggaggtgcctataatgccaactacttgggagattgaggcaggagaatcacttgaacccgggaggcaaaggttgcagtgagtggagattgcaccactgcattccagcctgggcaacgagagcaaaactccatctcaaacaaaaaaagacttgatattaaagattaaacaggaaaatcacatttcacaaatgtatagcctatgtgtcttgcattattaagaaggaccatggtagcacaacaaatctaaaaacaaagaaaatttttcattactgaccacaactaagaaaactacatttattctcttacagtagaacagtgagtaacaggagcccaagctatatctttgttcttcagtgatttattctattcattcccttttgtttttatagtatatacttttcctaatctttcagtgccctgatagtttttgacatggtcatcatctttaggctccatatattaggcttcaggattttattttactgtcttgggtaaattgccaaattgttaggatttttgtttggttgtagttactagggaaataaaatttcttccctttagctttgggaaattattaaaatactcctaaatttagagctacactttaaatgagaaaatttgagttacaagttagcatacattatcagcagctatcattaaactgcttgtcctggggaaatttagtatatttcttttttccagatgtgacttctttctgaatcctaaacaaaagttatatggtctcttttgttgtattgtttcgtttttgagatggagtctcgctctgtcacccaggctggatggagtgcagtggcgtgatcttggctcactgcaaccttcacctcaggttcaagcgaccctcctgcctcagcctcccaagtagctgggattacaggcgccggctaccatgcctggcaaatttttgtatttttagtagagatggggtttcaccctgttgaccaggtggtcttgaactcctaacctcagctgatgcgcccagccgaaagatgtatgatctcttgtgtttttgtgctgttggttagtcagtgcttcttgaacatttgaacatacaggaaaactaccacattaaatactgttctttccttacaatattgcctaatgtttaaaataatttttctttttttttttttcttttgagaggaggtcttgctatgttgcccaggctggagtagtgcaggtgtgatcatcatacactgcagcctcaaactcctgggcccaagtgatcctcccacctcagcttcccaagtagctgggaagctggaactacaggctcatgcctctgtacctggctatgcttaaaatctttttgatgttggcttgtgtagtgtcattctaatttgtccatctttgtgacctcctattctctaatctttttatcagcttttaattataaatgtcagttgaggctccatttataggcctttttctcttatctttcacttcatttggggttcatgtacatttatttcactatctccagtgaaatttccagaaccacgtctttagtcctggtatgatagcgcttgcagaaaatgaccagccagctctcccaataccagatctttcaaaagatgggtggtcttttccttttcttttcttcttttttgtttattaagtccaacttctgcagaaggatactcattctctttttttttttttttctgacacggagtctcgttctgtcatccaggctggagtgcattggtgccgtctcggaccactgtaacctccaccttccgggtttaagcgattctcctgctttaggttcccaagtagctggaattacaggcgcctgccaccacacccagctaatttttatttgggggttcaccacgttggccaggctggtctcaaactcctgacctcaagtgatctgcccacctcagcctcccaaagtgctgggattacaggcgtgagccactgctcccggccattcattctctttttaaagttatttatctgatttctcgactcaaaacatgggaaattttattcctctcagcttggcccacacatctcatctgtcttcggaagtagtttgcttgctaatggtttgttcattccagactttgtgcctttgcatacaccattacatctaacttagcaatctttgccctctcctccttcaaagcctaattcaaatcttttgtcatgtgagatcttcttaattgggcctatctggttattcttattctcatcacccagccagtacttaaatactacactagccagcactcatattcgagtttatagattattgaaagatatctaaaccctagaagttagctagattcagtgcagcaaaactagtaaaataattttgactgaaccttgaaaattgttacagcagtaattgaccttaatttttgtctttgtaaatatattgctgctaaaaattatttcttctcagaaattatcaacaaggttgtagagtctacagagacaagaagtgtttttctacaaggttgtgttagagggtacctcagtttatttttaagtccactatctactcatctgataacttaacatatcaaataggctgggtgcagtgctcaacgcctgtgaacctagcactttgggagaccaaggcaggagatcacttgaggtcaggagttccagaccagcctaaccaacatagtgaagccccatctctattacgaaaaattagccaggtgtggtggcaggcgcctgtaatcccagctacttgggaggctgaggcaggagaatcgcttgaacccaggagatggaggtggcagtgagccgagatcacgccactgcaccccagcctgggcaacagagcaagactccctctaaaaataaataaataagtaaaataaaatatcaaatagttttaataacaaaacatagtttttatagtccccagtttttattccccagaggcaccactttcaagtcttccggctgattttcttctatttgatattatctgttaacttcctaataagttgagaagttagccctgttgccctcattcctttctttccttcaataacataaaagttttttttttccccacatgaagttcagtactggtgtttgtggtcatgtgattattcaggactggggcactggttctcaaagtgtggtccagaaaccccagagaggtttccaggatcctgtcacagggtccataagatgtaaagtatttgtgtgtgtgtgtgtgtgtatgtgtgtgtgtgtgtgtgtgtgtgtttatgtttggcacgcttattttttccacaagtatacatggagttttccagtagccacatgacgtttgatgacatgatggcatcacactgttagctaatgaaacgtgcacttgtgtgttcttgtgttttccagaattttctgaggtaagaatacctcagtcgattgaatgcagagacaggtatgaaaattgacctgtgttctgttaaaccacatatcaaaaagccttgcagaaatgtaaaataaggccaatcactaaatgttttgttttggaaaaaagttacttttcgttaaaagcagttacatatattgatatgtattgtgtttatgtctttgtttttttcagtagacactgaacaaatactgataactggtttagtttagttagaaatagattctaccatattttaacatattattggccaagcagggtggctcacctgtaatccctgcactttggggggccaagacaggcaaatcacctgaggccaggagttcaagaccagcctggccaacatggtgaaaccccatctctacttagaatgcaaaaattagctgggcgtggtggcacgcaactgtaatcccagctactcgggaggctgaggcaggagaatggcttgaacctggtagagggaggttgcagtgaaccaagatcacgccactgcacttcaacctgggtgacagcgaaactctgtctgaaaacaaacaaacaaacattatttattagaaattacttcgtacttaaagtttattgtgctttaattttgaaattgaaaagaacagttttccttaatacccttttaggaagttatctggtttttaatattagaatattaaagccttcttgagcttcaacccagtttgccaggatttttgtcaggcctgtgttctcaggagaaaacaaacttacatcaagagtttcatcagcatttcgtttcaacaaatatttgttgatcgtttgtgcttgggtgctatgagagatggaaagaagcataagacagatcctaactgtccatgtctttttttattattattattatttttttttattttatttttttaactgtccatgtcttgtactgcaacgtctaccccatatggtgagaattaaccttcaggttgatgactcagttgctgcagaattcttagagatcaaatcacaaaggaattctgtatactagatctaattaagataagaaagatgctaggatatctcagaaatataacaaatgaaacaaagttttcaaattagtactaagataaacaaagtttatttaacaattttatatagcactttagagtttaccaagtgatttagtgtgtgtttcgtttaatcctaatgatatcctatgggttaggtattatccatgtcttacaggtagctgactcaggttttcaaatgtaagatgacttggacaagaatgcatataagttgtactcaaatttagctgttctgacttctgatcctgtgcttttactgtataaaaacaccatatctggctgggcatggtggctcatgcctataaccatagcactttggcaggccaaagcagaggattgcttgagcccaggaatttaagaccagcctgggcaacatagacccccatctctacaaaattttttttaaaaattagctgcgcggggtggtgcatacctgttgtctcagctacttgggaggctgagacaggaggattgcttgtgcccagggataggatgctgcagtgagctgtgatcgtggcactgcacttcagcctagacaacagagcaagaccctgtcaaaaaaaaaaaaaaaaaaaactatattaaggattcaaagtagttgatgttctactacacatgctaagatattttgggccgagtgcagtggctcacacttgtaatcccaaccctttgggaggccaaggcggatggattacttgaggtcaggagttcgagaccagtctgaccaacatggtgaaaccctgtctctactaaaaatacaaaattagctgggcgtggtggcacatgcctgtaatcctagctactcaggaggctgaggcaggagaatcacttgaacctgggaggcacaggttgcagtgagctgagatcacaccattgcactatagcctgggtgacaagagtgaaactccatctcaaaaagatattttggaggatatacagtgtctaatataaaggccttggccatcataagctctccatagttaagccagatcactagaagaaataagtaataattctcattctggttatagatcatataaactttgtaagaggttagactcaaatggatacatttctgactaaaaaagaattttttttgtttcaaactattaaaaaacctttaaatgtattgttttactgatcttcaggactatagtctgtgaccataataatgggaatacattcagaatgtccaacaaacacctaaagtaaatgatacttttttgcctgcacatagtattaatttcttaatgagatatttcagaaattacatggtgtgaggctgggcacggtggctcacacctgtaatcccagcactttgggaggccgaggcaggcggatcacaaggtcaggagatcgagaccatcctggctaacacagtgaaaccccgtctctactaaaaatacaaaaaaattagccgggcgtggtggcgggcacctgtagtgccagctactcaggaggctgaggcaggagaatggcgtgaacccaggaggtggagcttgcagtgagctaagatcgcgccactgcgctccagcctgtgcgacagggtgagactccatctcaaaaaaaaaaaagaaattacatggtgtgagagattcacccacagatactgaatcagagttacatacagcaggccagctgtggtggctcactcctgtaatcccaatattctgggaggccaaggtgggcagatcacttgaggtcagaagtttgagaccagcctggccagcatggtgaaactctgtctttactaaaaatacaaaaattagccaggcatgatggcacacacctgtatttccagctactggggaggctgaggcaggagaatcgcttgaacctgggaggcggaggttgtgctgagctgagattgcaccactgcactccagcctgggcgacagagtgagacttcgtctcaaaaaaaaagatatatacagcaaactgaggaataatagtgggatacagagagctttaagccatcagttatgagtctcagttgtctcttattaatttggttattgatttttgttcttttttctccttgaaggtttgtaaaagaatggacttggtctgccagagaatgttgaatcagggatttctgaaagtggagaggtaccataatctatgtcagaaacaagttaaagcacaactcccaaggtatgttgtgggtggcaatgacaatgatgtacagttggttttgtttgttgcttgacttctttttttcagtctcatggtttacatattgcttcccaagtttttatagcaaagggcacaaagatcacaatgtgatttctgcagtggtttgtccattctcaccgtttgtgatcaacattttactggaggttctagccagagaaattaggcaagaaaatgaaatacaaggcatccaaatgggaaaagaagaaatagaactctctgttcacagatgatatgatcttgtggataaggagtgcactaattgattattaaagctagtaaaccagttcagcaaggatatgggatataagaataatatacagaaaccaattatatttatatacactagcaatgaacaatccaaaaacgaaattcaaaacattttatcatagtttcaaaaagaatagaatacttagtaatacatataacaaaagcacaagacttgtatactaaaaactacaaaacaccattgaaagaaattaaagaagacttaaataagtggaaaggcattctgtgttcatggatttgaagacttcatattgttaagatgacggtactccccagatgaatctacacattcagtgtgataggggttgacaataaggtacaatatgttttgtttgtttcttgacttttttttttgtaacccctgtcaaaaattcagctgtctttttttttttccccaaaacttgatacactgatcctaaaattcctgtggaaatacaagagtctgacaataaccaaagcaattttgaaaaaggagagcagtattggaagactcacacttcccactttcaaaacttagtacagagctatagtaatcaaaacagtatggcactggcataaggatagacctgtagatcaaagaagcaaaagcaaaagtctggataataaaccttatatttttaatcagttgattttaacaaggatgtcaagataattcaatgcagtaagaatagtattttcaacaaatgatgctgggacaactagttatcttgaaaatgaatgaagttggacctcttcctcatactgtatataaaagttaactcaaaagggatcatagacctaagtgtaaatgtcagcactatactatataacccttagaagaaaacatagtagtaagtcttcatgaacttggattaggcagtgacaccaaaagcacaagtagcaaaagaaaaaattaagcaaattggacttaaaatgtaaaacttttgtggctcaaaagacaccgttaagaaaatgaaaagacaccccacaaaatgggagaaaacctgcgtaaatcatgtatccagattatatgaggaactcttacaactcaacaataaaacctattttaaaagtgggtagaggggccaggtgcagtggctcacacctgtaatcccagcatgttgggggactgaggtgggtggatcacctgaggtcaggagttcaagaccagcctgggcagcatagtaaaaccctgtctctactaaaaatacaaaaactacctgggcatggtggcgggtgcctgtaatcccaactactcaggaggcttaggcaggagaataacttgaacccgttggcggaagtttcagtgagccaagatcgcgccacagcactccaatctgggtgacagagcaagactctgtctccaaaaaaaaggacaaaggatttgaatagacacttctccaaagaagataagtaatagccaacaagcacatgaaaggtgctcaacatcattagtcgtcaggggaatgcaaatcaaaaccactacgagatttatatccactagcgctttatatccactaggatggctacaatggaaaaatgttggggaggatgtggacaaattggaaccttcatatatcaatgttgggaatgtaaaatggtgcagtcactttagaaaacagtttggctgttctcaggccggatgtgatggctcacgcctgtaatgccagcagtttgggaggccaaggcaggtggatcacctgaggtcaggagttcaagaccagcctaggcaacatggtgaaacccagtctctactaaaataggaaaattagccaggcatgatgtcgggtgcctataatcccagcttcttaggaggctgaggcaggagaattgcttgaacctgggagacggaggttgcagtgagccaagatcgtgccattgtgctgcagcctgggcgacagagtgagcccgtctcaaaaaaaaaaaaaagaaaaaacaatttggctgttctcaaaaagttaaacagagagttattgtctgagccaccaatttcattcctagataagtacccaaaagaaatgaaaacataatgtttgcacaaaaacttgtacacaaacgtttttagcagcattattcataatagccaaaaagtggagacaatccaaatgtccatcagctgatgagcaaacaaagtatgatatatctgcatgatggaatattattgggcaataaaaaggtacatgctacaacaagaatgaacctggaaaactatgctaaatgaaagaagccagaaacataaggctactgtatgattccatttatctggaatgttcagaataggtggatccagagaaacagaaagtagattagtattgccaggggctgggagaatgggagtggctgataatggttacaggagttaattttgtggtaatgaaaatattctgaaattagatagtggtgatagttgtacaatcctgtgagtatactaaacaccactaaatttagtcctctttaagataattttattatgtctgagttatttcttaaattgctaaaaagtttaaaggagttaaattttatcatcaaaagcatatcatctcctgcctatatttccatgtgtaatccattcatttatctaatttctttggttctaatagccactagatttgatagccaaaaaacctttacttttatttttatttttgagatggagtcttgctctatcacccaggctggagtgcaagtggtgcagtcttggttcactgcaacctccgacgcccgggttcaagcgagtctcctgcctcagcctccctagtagctgggactataggcatgcaccatcacgcctggctaattttttagtagagacggggtttcaccatgttgcccagcctggtctcaaactcctgacctcaggtgatccacccgcctcagcctcctaaagtgctgggattacaggcgtgagcctccaagcccggccccaaaaaacctaattaaaatatatatatatatatataatttgttttgtttgttttcaaatattttgtcaatgagtaccagtctttggtaacgatttctaggcatagtgattcattcatcattacagttaaattatgacccaactgtagatttctaaattaacatgtaaaagactgtttcattaagccatcttgattgcttaatattttagtccacaatactgctttaatggttgccttgcttttattattattattattataggagagagtcagaaaggagaaaccattcattagctcgtcatgcagacattcttgctgctgttgaaacaaggctgtcactattaaatatgactttcatgaaatatgtggattccaatctctgttgcttcatcccaggaaaggtaaaatagaattgcttgcctagaacagctggactgccctacataaacttattatacagttatgaatttctgattttagaaatgttagaattgtttctacttctctgagtttctactaatgaatttgtttgctttctgtacagttataaatatgtatcatttgtatgatctttatatttaaaattctaattatgaaatagtcgaaaccctaatattctttagagaagttttttaagagttcatactcaagaataaaatttgaggttttactggtggttatgatgccagagatacagcaatgaacaacatacatattgtccctgccttcaagactattataattttggggaggtagaaaaggagggacaagctggtttttgttttgtttgagaaatgtttcataacgacaactttataaactttctgatttgacaagaataaacaattgctatttaccaatattcccagaactaaataacagtcctttttaacacagaaataactatattgtggcatatttaccattactaagttaataaaaactccaacattcaacatactacttataccttcagtagtaccctactccttgaattaagtgtaaattgacatatgtctgtatctttttatatggaagtggtagagatataattaaaggtcattttgctacttggttgatgctggcaaaagtttcccttaacatggttggaaataattaatatctagtaaaatctgaatgttcgctttttgttatttccaaagataatttacattggcaatatttaatacgtactttgtccatttttagttttctttgacatttatttttggggggaatcccatttcttatgattgtatttgaaatattttggtatatctcactttctttgcattatatacattttctttaaaagatcttgttgcataccaacacattacctgctaatgctttttgtagggtgctataagaggatgaccagttagaaacttcagagtgattcttatgccagatttttctgaatctgacttaaaggccttaacttttaagtgttcctgagttctttgaacttagcttgtttcatatagcatcatagtttttattgaatatctcattgttagaaacatgaatatctaagaaacatctcacagttatcataacttcaaagagattcagtcagttgttaagtaacagagttgaatagtttgtgacagagttcatgtggcctacaaagattaaaatatttatgatccaggccggctgtagtggctcgcacctctaatcccagatacttgcaaggctgaggcagaagaatcgcttgaacccgggaggcggaggttgcactgagccaagatcacaccactgcactccagcctgggcaacagagcaagactctgtctcaaaaaaaaaaaaaaaaaaaaaaaagaaaaagaaaaagaaaaatttagtatctggcctgtacagaagaagtcaccaatttctgtgctagttgatcaggctcacgtgtttggaatggtgatgttgacagtctaaacaaataatgttgccaggtgccgtggctcacacctgtaatccccacactttgggaggccgagacgggcagatcacaaggtcaggagatcaagaccagcctggcgaacatggggaaaccctgtctctactaaaaatacgaaaattagctgggcatggtggcatgtgcctgtaatcccagctactcgggagtctcaggcaggagagtcacttgaaccaggcagtcagaggttgcagtgagccgagatcatgccactgcactccagcctggcgacaaagcaagactctatctcaaaaacaaacaaataatgttaaatccactggagtcctgtcatttttggaaaccatttgttgacttcagttttttttttttttttttttgagatggtgtcgtgctgtgtcacccaggctggagtgcagtggggcaatctcagctaacagcaacctctgcctcccggtacaggtgcattatttggattgttttatgagtgttcccttttttgtacttctcatgcttaaacttttcacatcctgtctgcaaaatataaggatgcggcatttaatttccacatgctgaagtaagaacattatacaaaataattttcagtctaacatataatcttcatttaatatatggtgtttatgataagttgttcttgttttccctgagatcttgcttctgggatgtacttaaaagtttaggccgggcgcggtagctcacacctgtaatcccagcactttaggaggccaaggtgggcggatcacaaggtcaggaggtccagaccatccttgctaacatggtgaaaccccatctctactaaaaatacaaaaaaaaaaactagctgggcatggtggcgggcgcctatagtcccagctactcgggaggctgaggcaggagaatggcatgaacctgggaggcagagcttgcagtgagccaagatcgtgccactgcactccagcctgggcgacagagcaagactttgtctccagaaaaaaaaaaagttcagaagtctttttgtttttgtttttgagatggggtctcgttctgtcgcccaggctggagtccattggtgcaatcttggctcaccgcaacctctgccacccaggtttaggcgattctcatgcctcagcctcccaagtagctgagactacaggtgcacaccaccacagccaggtaatttttgtatttttagtagagacgaggtttcaccatgttggccaggctggcctcaaactcctgatctcaagtgatccgcctgccttggcctcccaaagtgctgggattacaggtgtgaaccactgtgcctagccacagaagcttttatactttgttaagaaaactaacttttgtggttttatatagactacattcattttgtcaaacttaaggtctacagtaagcattttattcacttaagtgaatctgagtagtagcaacattatagttcaaattagatagccaaatatgtaccaaaattttggacctttaaagtaatagttgggactgggcacggtggctcacgcctgtaatcgcagcactttgggaggccaagacgggtagatcacaaggtcaagagatcgagaccatcctggccaacatggtgaaaccccatctctactaaaaatacaaaaattagctgggcgtggtggtgtgcacctgtagtcccagttactcaggagactgaggcaggagaatcgcttgaacctgggaggcagaggttgcagtgagccaagatcatgccactgcactccagcctggcaacagagcgagactctgtctcagcaaaaaaaaagaaaaaagaaaaaggaagacagaaatccacaagaatggtgagattaggggagaagacagtagcaataaaattttgaaagctataaagtagagaaacaaatggtaactgatttagcagaactgagaaagttaaatcctacactgacagtggggaaagccaagaggaactccttgcacaaaagaaagctctagagttaaaagctccagccagacacctgtgagagtgggactgataacaggaaggttggttgagaatctgtagttaagaatgattcaaacctacaggttacctctccaattgcaggcaagctagatcattgcccttctactcagtgaaaaccaaaggcttattcactagaggggttaaaatggagtccattgacagggggactatattgatagggcattaaaagctgtgtaaagaattcagacaacctgtaatcccagcactttgggaggctgaggcgggcaaatcacttgagatcaggagttcaagaccagcctggccaacatggtgaaaccctgtctatactaaaaatacaaaaattaggtgggtgtggtggcaggcacctatagtcccagctactcaggagactgaggcaggagaatcacttgaacctgggaggcagaggttgcagtgagccgagatcacactggtgcactccagcctgggctacagagtgagaccctgccacaaaaaaaaagaatttagacaggttacaagtttgctattatctaggacaggaatcagcaaactttttttggtaaaaggccagtttataaatatttttggccctgtgaaccttgtgctcgctgtgacagctatgcaattctgagaaacagccgtgtgcaatgtgtggtaaatgaatgcttgtgcctgcgttccagtaaaactttatttacaaaaccaggcataggctaaataggggtatagttggccaaccctaagtaccacattgatattctctttatcttctctcagaactaagatgttatagaatgttggcttactcctgtatacatttctcaaatcttctatctaacacatggaagttacactttttacagtaagctcatattagtatcagcagttcacatatactgacacacaaccgtatgtgagcattgagcaaccagccattcatagagatgataatgaaaaaacaaaacatgtggatagtctctgctcttcttttttatttttttgttttttctttttttttatatttttagagacggggtctcaccatgttggccaggctgtcttgaacgcctagactcaagcaatccacccacctcagcctccagctggagtctcggcttactgcaacctccgcctcctgggttcaagcgattctcctgcctcagcctcctgagtagctgggactacaggcacatgccaccatgcccagctaagtttttttgtatttttaatagagacggggtttgaccgtgttagccaggatggcctcaatctcctgaccttgtgatgcgcccaccttagcctcccaaagtgctgggattacagatgtgagccactgcgcccagcccagtctctgctcttaactgtcactagtagccctggtaaaccttttgttcttattgaaacacaatggtccccaaaaattagggtttttacagtataattgactacataaggccatgaagctatatttccctgaacagacgtaaaaatctatatattaggcattattggcttgtatttatttttctgggaaagaaaattggtggtggtaaatttttttattcttttttttgtgtgtgtaaatttttattctcttgtaatttcaagtttacacaaaaattacaagactagtacaaggagctcccatatagcttatttgcaaatctagcagttatttacctttcatcctgtttgcttttattttctctttataaatacattttggccgagcacagtggctcacacctgtaatcccagcactttgggaggccaaggcgggcagatcacaagatcgagagatcgagaccagcctggccaacatggtgaaaccccgtctctactaaaaatacaaaaattagctgggctggtggcacacgcctgtagtcccagccacttgggaggctgaggcaggagaatcacttgaacccaggaggcggaggctgcagtgagccgagattgcgccactgtattccagcctggtgacagagtgagacttcgtctgaaataaatacatacatgcatgcatgcatacatacatacatacatacatacatacatacatacattttggccaggcgtggtggctcatgcctgtaatcctaatactttgggaggctgagacgggcagatggcttgaagccgccaggagttcgagaccaacctgggctgcaaagtaagacccccgtctctaaaaaaaaaattaattagctgggtgtggtggcatgcacctgtagccccagctccttgggcggctgaggtgggacgattgcttgagcctgggcagtcaaggctgcaatgagctatgatcattccactgcactccagcctgggtgacagagcaagatcttgtctcaagaaaataaaatataaatacttttttttcctgaaccacttgaaaataagttggagacactgtgctccttagttcctaaatatttcattgtatttcctaaaagctaggatactcttacttaaccacagtacagagagcaaaatcagaaatttgtaacactgatgtaatactgttctgtagttgacagttcatattcaagtttcatcacatattccaataatactcttcctagcaattttttttgttaatacagaatgtaatcgagaaccatgcatggactgtaatcttatatctggaacagttccctaggctctctttgtgtcacttgatcatcacatttttgaagaacgtaggtcagttattttgagggatatgcttccatttaagtttaatgcttacagaatgttgtttttgtttcttttaaagttgattttaatgtggcgatactcttaaaaatcaagattagttgggaacatttctccttttactatgcttgtcccaaaataaatatatacagccatgagcctttaaaaaaaataaaagtctgttttcatattaaagagaatatagcaggccgggcaggattgctcacacctgtaatcccagcattttgggaggctgaggtgggcggatcacctgaggtcaagagttctagaccagcctagccaacatggtgaaaccccatctctactaaaaatacaaaaaattagccgagcatggtggcacgtgcctgtaattccagctactcagaaggctgaggcaggagaatcgcttgaacctgggaggtggaggttgcagtgagccgagatcgtaccactgcactccagcctgggcaacagagtgagattctgtctcaaaaaaaaaaaattattctgagaaataagaaaagatatgccagcctggccaacatggtgaaaccctttctctactaaaaatgcaaaattagccaagtgtagtggcaaacacctgttgtcccagctactcatgaggctgagataggagaatcgcttgaacctgggaggcggaggctgcagtgagccgagatcaaaccactgcactccagcctgggcaagacatagtggggaaaaaaagatacaatcggccgggcatggtggctcacgcctgtaatcccagcactttgggaggccgaggtgggcggatcacgaggtcaggagatggagaccatcctggctaacaggtgaaaccctgtctctaattaaaatacaaaaaattagccaggcatggtggcgggtgcctgtagtcccagctacttgggaggctgaggcaggagaatggtgtgaacccgggaggcggagcttgcagtgagccaagattgcaccactgcactccagcctgggcgacagagcaagactgtgtctcaaaaaaaaaaaaaaaagatgcaatcatgcgtcatttagcaaagaggatccatcccaagagatgcattgttaggtcactttgtcatgtgaacatacatcatagagtgtatttacacaaacctagatggttcttacacacataggctatatggtatagtctattgctcctgaactacaaacctgtacagcatgttaccgtactgactattgtaggtgattataacacaatcatatttgtatatctaaacatagaaaaggtacagtaaaagtagggtataaaaaaatggtacacctgtatagggcatttatcatgaatgaaactcagtttctctgggtaagtcagtgagtgagtggtgagtgaatgtgaaagcctaggacattactgtacactttgtaaacactgcatactgaggctacattaatttttttttttttttgatactgggtcttgctgaatcacctaggctagagtgcagtggcatgaccacagttcattgtagtcgtgacctcctagactcaagacaatcctcccacctcgacctcccaagtacctgggactctacaggcacattaaattttttttttttttttaatttttggggccaggcatggtggctcacgcctgtaatcccagcactttgggaggccgaggcaggcggatcacctgaggtcaggagttagagaccagcctagccaacatggcaaaacccagtctctgctaaaaatgcaaaaattagccaggcgtggtggcgtgcacctgtagtcccagctactcgggaggctgaggcaggagaatcgcttgaacccaggaggtagaggttgcagtgagctgagattatgccattgcattccagcttgggcgacagagcaagactctgcctcaaaaaaaaaaaatggggggacaggcatggtggctcatgcctgtaatcaatcccaacacctaggccaaggtaggcggatcatttgagctcaggagttctttaagttttaacttcttgacttttttgtaataacacttagcttaaatgtcgtttcgttataatattgatgagaaaaaaaaatcaggctgggctcagtggctcacgcctgtgatcccagcactttgggaggctgaggtgggtggatcacctgaggtcaggagttcaagaccagcctggccaacatggtgaagccctgtctctactaaaaataaaaaaattgccaggcacagtggctcccacctgtaatcctagcacttcgggaggccaaggcaggtggattgcctgtgcttaagagtttgaaccggcctgggcaacatggtgaaaccctgtctctactaaaagtacaaaaagccaggcatggtggtgcgtgcctgtaatcccagccactcgggaggctgaggcacgagaatcgcttcaacccaggaggcagaggttgcagtgagccgagatcttgccactgaactccagcctgggggacagaaagacactctgtcataaataaataatcgtgccactgaactccagcctgggggacagaaagagactctgaaataaataaataagtaagtaagtaaataacagaatgagactctgtcttaaataaataagcaaccaagcaagcgtgcggtggtgcgggcctgtagtcccagctaaataaatacatatattagccgggtgcagtggtgcggaacccaggagatggaggttgcagtgagccaacatcgtgccactgcactccagcctgggtgacagagtgagactctgtctcaaaaaaaaaaaaaaaaagagaaggagaaaaaaaaatcagttcccggccagggccactgtctgtttagtttgtgcattctccatatatctgcatgagttttctctgggcactctgacttcctccgacatctcagagctgtgcctgttaggttcattgacatgtcttagtggtcccagtctgagtgagtgtgggtgtgagggtgccctgcagtgagatggcatcctggccagggtggataacgacctggtgccctgagctgctaggatgggctccagccacctgcaaccctgaactagaataagcagattgaaaaatgaatgaataggacgggtgtggtggctcacgcctgtaatcccaacactttgggaggccgaggcgggcagatcacgaggtcaggtgatcgagaccatcctagctaacacggtaaaaccccatttctactaaaaatacaaaaaataaataaataaattagccaggcgtgatggcgggcacctgtagtcccagctacttgggaggctgaggcaggagaatagcatgaacccgggaggcggagcttgcagtgggctgagatcacgccactgcactccagcctggacgacagagcaagactccatctcaaaaaaaaaaaaaagaaaaatgaatgaatagccaggcatggtggctcacaccgtaatcccagcactttgggaggctgaggcgggtggatcacttgaggtaaggagtttgagaccagcctggccagtagagatagtgaaaccccatcctctactaaaaatacaaaatttagccaggcatggtggcatgcacctgtaatcccagctactcgggaggttgaagcacaagaaccacttggacccagagagagatggaggttgcagtgagctgaggttgcgccactgtactccagcctgggaaacagaatgaaactatgtctcaaaaaaaaaaaaaaggaatgaatgaatgggccaggtgtggtggttcatgcttgtaatcccagcactttgggaggccaagataggaggatcacttgagaccaggaattcaagaccagcctgagcaacatagggagacctcgtctctacagaaaaaaaaaattgccaggcatggtggcacacacctatggtcacagctacacaggagactgaagtgagaggatcgctttagcccaggaggtcagggctgcagcgagatgtggtcatgccactgcactccagcctgggcaacagggcgaagaccctgtctcaaaaaaaaacaaaaaaggctaggtgcagtgactcacacctatgatttcagcactttgggaggcggaggtgtgtggatcacgaggtcaagagatcgggaccatcctggccaacatggtgaaaccccatctctactaaaaataccaaaattagctgggcgtgggtgtgtgtgcctgtagtcccagctacttgggaggctgaggcaggagactcacttgatctgggaggtgggggttgcagtgagccgagatcgtgccaccactgcactccagcctggtgacagagcaagactccatctcaaaaaacaaaaaacaagccctcctatttgttattgtttctgaactacatgttggtaggaggtgctccttaaaatttttgctttacaaacatgtattccctgaagtaacccaccaccatgatgactgccatagctcactgattgaccaaaaattggatacattatcttgtttttattaatctttcttaaatgtgtgtatagttcacatttatttcagtgtttgatattagaagtgttttaggggccgggcgcggtggctcacacctataatcctagcactttgggaggctgagtcgagtggatcgcttgaggtcaggcgttcaagaccagcctggccaacatggtgaaaccccatctctactaaaaaatagataaataaatactaaaattagccgggcgtgatggcgggcatctgtagttccagctactcggaggctgaggcaggagaatcgcttgaaccagggaggcagaggtttcagtgagctgagatcgcgccactgcactccagcctgggcaacagagcaagactacatctcaaaaaaaaaaaaaaaaaaaaaggaagtgttttaggtctttatttagaggtttggtggttttcatgaccagaactatgccttaggaacttaacacttgtttatattaattagcctatgataaaattggtttcattacatgtcatttcacttaaagtcgggattttcaagaacctatcaacattaaaatgaggacttctgtataatatagtaaatactaggcgatgggaattttccaactccattataatcttacaggatgaccctcatatatggtttgtcattgaccataacatcatgatgcagcacataaccgtattcaaacaaacatgccatataaagaatattgaggccaggcctggtagctcatgcctgtaatcccagcactttggaaggctgatgcgggcagatcacctgaggtcatgagttcgagaccagcctggccaacatggtgaaactccacctctactaaaagtacaaaaattatccgggcatgggccaggcgcagtgactcacacctgtaatcccagcacttggaaggccaaggcaggtggatcaccagaggtcgggagtttgagaccagcctgaccaacatggagaaacccatcgctactaaaaatacaaaattgtccaggtgtggtggtgcaagcgtgtaatcccagctactcaggaggctgaggcaggagaactgcttgtatccgggaggtggaggttgcggtgagctgagattgtggcattgccctccagcctgggcaacaatagcgaaactccttctcaaaaaaaaaaaaaaaaaattatccgggcgtggtggcacacgcctgtattcccagctactcaggaggctgaggtaggaggatcacttgaacctgggaagcggaggttgcagtgagccgggatcacaccatcacactccagcctgggcgatagagtgagactgtcttcaaaaaaaaaaaaattaaaaataatatttagaaaattttagatgcacttaggttttttaaatatggaggaaatttttttaaaaaataaaaggggtagaagggaaagttaaggaaatctcaagtacaacaaaaagacagatgaaaaatgagaaaaaaatgagcatttatgaggttcagtattctagcaggagctttgtttgctaaacagtagattaaaaaattatttctcacccacagtctaaaggcctaaatgatattcatcgtatataatttgttactgtaccattttagacataagcgtggtacttctactgtgtgttagaaatgtgatggtgtactttttaatttttgtagagactgtttctagctatgttgctcttgaactcctgcctcccttggcctctcaaagtgctgagattacaggcataagccaccagccacagcctgtactgtacttttataaaactaaaatttttttttttttttttttttgggagactgagtcttgctgtgtcgcccaggctggagtgcagtggcacgatctgggtttgctgcaacctctgcctcccaggttcaagcgattcttctgcctcagcctcccgagtagctgggactataggcacgtgccaccatgcatggctaatttttgtatttttagtagagacagggtttcaccatattggccaggctggtctcgaactcctgacctcgtaatccgccctccttggcctcccaaagtgctgggattacaggcgtgagccaccgtgcctggccaaaaatattttttataacctgtagtcagctctgtattcgtgggttccacattcatggattcaaccaaccgtggatagaaaatatttagtgagactctgtcaaaaaatatatatgtatatttagagaagaaaaacaattgccggatgcggtggctcacgcctataatcccagcactttggcaggccgaggcaggcggatcacaaggtcaagagttcaagaccagcctgaccaatatggtgaacccgcatctctactaaaaatacaaaaattagctgggcgtggtggcaagcgcctgtagtcccagctactcgggaggctgaggcaggagaatcacttgaaccccggaggcagaggttgcagtgagccgagatcatgccactgcactccagcctgggcaacagagcgagactgtgtcaaaaaaaaaaaaaagagaagaaaaacaatttttaaaaccacagctgtttttaaaatatgaattttaaaatagtacaatgtaactactatttacaaagctttgacatggtattaggtagtgtaggtaatctagaggtgatctaggttatatgcaaatactatgccattttatataaaggacttgagcacacacacattttgacaatgtggtcctggacccaaacccctgaggatgcggagggactgactattttacttcttacagcctgggtaaggttcaacatgtggtatatcatttgaaaggtgtagaaacagccattaagagtttaagtgaccttcctaaggcctgtggtctttccactagacctcaaaactcataccattacattctcgttaatgtaatttgcaaaaaaaaaaaaaaaaaaagattaaatctactcagaaaatgaactgttttgaaaatttgttaaataccttgctttcttaatatatacctctaaagccatggcagccacttaaaactctgaatggtagaagcagtatggttctcacacacatactttccttcaccttatcctctgcttaaagcttttggacaaagaaaagaaactattttgaattttattgaaaacatagattatcccatttgactaaaataatctctatacagtaagatttttaaatgttcttttttaatggaagactggggcaaatggaaagagtgaacttgcttttacactacatttagaagactacagtaaagataatatttcacaaattgtagatgtattttcacattacttttaatggcaaaaccacagttactttggaaccgatctaataatttactgtcagttagcaatccctgtaggatattttgataatgaaagttattctgaagaataagtatcatggaaaaagactaattgtataatatatgttaagaaacggccaggcacggtggctcacgcctgcaatcccagctctttgggaggccgaggcaggcggatcatgaggtcaggagatcaagaccatcctgcctaacacggtgaaaccctgtctctactaaaaatacaaaaaaaagagaaaaaaattcgccaggtgtggtggcgggtgcctgtagtcccagctactcgggaggctgaggcaggagaatgtcgtgaacctgggaggcagagcttgcagtgagccaagatcgcaccaccgcactccagcctgggcgacagagcaagactccgtctcaaaaaaagaaaaaaaaaaagaaaagaaacaccctagaataaatgcttggtacatgatagtactgcataactactgtataaatgttgaattgctatcctatcacctatccatccacatcatccctgtgctcaactccacactgtttagccaggtgtaccttcctcctgctctaacttcccttacctgttgaaatttacttactaatgtccttcattagacctacccagttctctcaactggatcttaatctctactctgttttcacacagcactttgcttatacattgaacttattacagtctgagttttgctttgctgtttatgggtctttcatggagtcatgtttcactggataggatctgtgtcttatgcctataccattacaacagtcctattctagcccaaatacactataaatattcttctgtctaccagtatttataaacatataatatctagaggtatattaataaggctgtgggtattttattaaacatataagtactattttaagtattctatatttttacaagtccgtctcaatagagatcttgtttacaatgacctttgtgttcaaaacataatcatctgacttctgaaaaaccatataatctttttttttttttttttgagacagtcttgccccatcacctggactgatcacagctcatgggactataggcatgcgcacagctaattttttaattttttgtagagacagagctcacagtgttgcccaggctggtctcaaactcctgtccctagacagtcttcccacctcggcctcccaaagtgctggcaccgtaggtatgagccaccacgcccagccaaaaaacaaattcttgtgttgaattaaccctttcatttgcccttaaacagttttgtttagatgtatcaattaatgttaaacaattaatatacttaaccatctttaccccttatttactgagtatctgccatgtgccagatgctgctaggctctggggatctgacagtgaaacatggtatgatctcttctgtcatagagtttactacattatatggaagatagaaattaacaaaaagatgtacttacaaattgtaatgtgtgttctgaaggggaataaagggttggatgaagatgttaacatgatttaaattggaggagggttcagaaaagacttctgagaaagtacagtgttactgtgacctcgtgtataactaaggaatttgaagtgagggagatacacagggatggcattccaggaaagggatcagcatgtgcaaaagccctggggcaaaaaggtggggaacttgatttagttcaaagggctgatggccagtttgtatctatagatgcaacatattagcctttggggacaacatttaaaaattatggaaggccaggtgcagtggcttatgcctgtaatcccagcactttgggaggccaaggcaggcagatcacctgaggtcaggagtttgagaccagcctggccaacatggtgaaaccctgtctctactaaaaatacaaaaattagccaggcttggtggtgggtgcctgtaatcccagctacttgggaggctgaggcaggagaattgcttgaacccaggaggtggaggttacagtgaaccaataccatgtcatttccagcctgggcaacaagagcgaagctccgtctgaaaaaattatggagtactgtggtacttttcctatatataacccatatgtaaaacgttgataaacacaaaactactatgggtcaattaatatcctagcactatacataaaatatcagtcagtatgaaggaccctttaaatactgattttctactttggtttatatttttaattttattaactatttcttgattatgtataaatattatataacttttaagctttgagtagctagcttccacaaatatttactctttggagatatacatgtatatataaaatttgtctatttctagtccttgaactccttgaacaagccaagctgacactgaccttggggccactatcattactatttctacctgaaagacttttctccccatatcttcaattgatcagttcttcctcatccttcagtcttaccttacaaatggcaaagaatcctttcccaaccacccatctcatgttattcctgcctttcctgatagaaactgtcacattaccctcttttttccatgtggcactcctttaaattattttcctgtttagcttcatgagaatgataatcttgtcatccttatttactgttttttactccagtactttgaaaagtgacaagtacatagtaagaactcaatacttgaataatgtttatcttacaagttatgataggcttacgtaattaaattgtaagtccaagggaaagtactccatttttcatttctttgtatatatagttcctaacatagtagttcagtaagtttttattggggaaaggggttatcttcttctaaagtgagctcgtaatatagtaatattgccagaaataaatatgttttctcctttggcaatcagccatcatccaaaattcctctcctgaactcccatcctgtatctcaagccacctgctagcaaatatcacctacatgtcccatgtgattcaaaatcacacatctcatctcccattgcatctgcctacgtacaccacctcagcccaagccatttcctgttcagttctccaagcccacaaacctggcctctcctatgatgtcttctcaggcttatgataaggatacatcctaaggttagattttgctgacatttattaagcatacatcatgctccattaacaatgatcatcatattatgctgagagtctagaaaatgtgaagggctgtgaatttgtcctgatacgattctgcaagattgtttctctggctgtgctcagcagcctaaataagtaaaggagaagggaagatggattataagattgatccagagttgggagcaagctagataaatgcagtgggaggaatatgtgggatgccaggttgtttgagattttggtgacagaatggtttggttgattaaccctcagttcttacgaggttaagggcccatagatgtcatccagattggggtctttagaagtaggaattttaggtcgggcatggtggctcacacctgtaatcccagcactttgggaggccaaggagggtggatcacctaaagttaggagttcaagaccagcctggccaacacggtgaaaccctgtctctactaaaaatacaaaattagccaggtgtggtggcacatgtctgtaatcccagctacttgggaggctgaggcaggagaatcacttgaaccctgcggttggagatgacagtgagccaggattgtgccactgcactccagcctggacaacacagtgagactccatcttaaaaaaaaaaaaaggaattttatcttcaggtctattctgaagccacagggaagaattaaggataacctcaccgagatgaaagctaatatcacaaatgcctaaggaaggttcacttactgttccagcaagagagttaggtgttctccccattacaattatcattaaaacaaaaaaggatcttctgctaccttttggtggtgacaaggaagtgacaagacttcattccaatccgtaacaagtctcagagaaacaaaacttaaagggatagagcacatgggggcagtattaaaaagagcagagaaatcaggctgagtccctgcagcttaggggaacagattcaggtttggaggattaataaaatgggtttgggcaatctccaaccctacccagctcccatacaggatttaatttcttagtttagtcctctagtgtctatagcaatttgtatacctgtttgtatcacttatgtacacacatatctccccagttacactgtgatttccttcagggttagaagctttattttattcatcctgattcctcagtcccaacatagtacctgatacataaaaggtgcttaataaatgcaagtatgaagtatgtaacaggccgggcacagtggttcacacctgtaatctttgcactttgggaggccgaggtgggtggatcctgaggtcaagagtttgagaccaacctggacaacatgatgaaacccatctctactaaaaatacaaaaaattagccacgcgtgatggcgggcaactgtaatcccagctacttaggaggctgaggcagagaattgcttgaacccaagaggcagaggttgcaatgagctgagatcgcaccactgcacccagcttgggcaacgagtgaaactctgtctcaaaaaaaaaaaaaaaaaaaaaaaaaaaagtactgtaacaagtccaaaagccatgtgttgtaaatagcaatattcatcagtggccagtacatcacttaaatcaccctacaggtctttactggaattgcaaaacaagcagttacttctctgcctgtttagctattttctttattaaaaaagaaaaatctaaagtgctaatgagaattcattattttaggtgattgatgagatttatcgtgtgttgagatatgtcaattctaccagagcccctcaacgagctcatgaagtacttcaagaattaagggatatatcctctatggcaatggagtactttgatgaaaagattgttccaattttaaagaggaaattaccaggatcagatgtttctggaagactcatgggctctcctccaggtatctctactttataatcatgcttgtacataattttgtaacttgcttccggtttttttccacttaaccagtgtcttgaacttttctgtgttagtagttgtttattggcagcatcatttttaatgagattggattatcaaccataacttacacaactaatccactagttaggctcatttcttgtttctagcttttcagtacttatactctgaagaacaatctgagcggtcttgcgactaaatctttgcacatatccatattgacttacaataaacttattagaaatagaatagctgggcccggccaggcgcagtgggtcacacctgtaatcccagcactttgggagggcaaagtgggtggatcacctgaggtcggtagttcaagaccaccctggccaacatggtgaaaccccgtatctactaaaaatacaaaaatgtgctgggcatggtggcgcacacctgtaatcctagctactctggaggctgaggcaggagaaccgcttgaacctgggaggcagaggttgcagtgagccagattcgcgccattgcactccagcctgagcaacaagagcgaaactccatctcaaaaaaaaaaaaaagaaataggattgctggaccaggcgcagtggcccacgcctgtggtcccagcactttgggagactgaggcgggaggatcgtttcagcccaggagttcaaggtgaaaagttacatacagatgctccttaatttacaatggggttacatcctgataaacccatcataagtagaaaatattgtaagtcaaaaaatgcacttaatacacgaacctaccgaacatcatagcttagcctaacctaccttaaacatgctcagaacacttccttagcttacagttgggcaaaattatctagcaaagcctattttataataaagcatccttgtgtaatttactgaattcattttctattgtactgaaagtgaaaaacggaatggttctgtggatacctgaagtacaatttctactaaatgtctatcacttccataccattgtaaagtcaaaaaatcattaagttggctgggcgcggtggctcatgcctataatcccagaactttgggaggccgaggcgggccgatcacctgaggtcaggagttcaagaccagcctggccaacatggtaaaaccgtgtctctactaaaaaataccaaaaaattggccgggcgcggtggctcatgcctgtaatcccagcactttgggaggccaaggcgggcggatcacgaggtcaggagatggagaccatcctggctaacatggtgaaaccccgtctctactaaaaatacaaaaaattagctgggcgcggtggtgggtgtctgtagttccagctactcaggaggctgaggcaggagaatggcatgaacccaggaggcggagcttgcagtgagccgagattgatcgtgccactgcactccagcctgggtgacagtgcgagactccgtctcaaaaaaaaaaaaaaaaattagccaagcgtggtgacgcatgtctgtagtcccagctactagggaggctgaggcatgagagttacttgaacccaagaggcggaggttgcggtgagccaagatcacgccactgcactccagcctgggcaacagagtgagactccgtctcaaaaaaaaaaaaaaatcattaagttaaaccattgtaatttgaggaccatctgtatttttttatgtttctgatgaattaatattcattttttaaaaaacaaatataccagataaaatgccaaaaactcttcagggacatatttggtgaattatttcagcccccaaagtgtctgcctgctactttattttttattttttattttttttgagatggagtctcactctgtcgcccaggctggagtgcaatggcgtgatctctgctcactgcaacgtccgcctcccaagttcaagcaattctcccgcctcagcctcctgagtagctgggattacaggcgtgtgccaccacgcctggctaatttttgtattttttagtagaaacagggtttcaccatgttgttcaggctggtcttgaactcctgacctcgtgatccacctgcctcggcctcccaaagtgctgggattacaggcatgagccaccacacccggctgctactttaaaagaaagggttcataaggctattttgaacagtatcacttcatctgtgctaaataactgtttttgcaaaagtatattggctcctagagatttgtgcctttatctactgaaagactaaattatttaatgtccctaactctggcaagtactttaaattaggaaagaatttagtaaaactttttgttttgttcagattagttagctccctgtagtactcagtgaggcaaccgagtggctttctgtaattgagtaataaagcctacacatctcagcattaatgtatctgttatttattgagtacctattatgcgcacagcactgtactgtgtcctgtggagactaaaaagaagtgtaatacgtggtgtctgctctcaaggatcttactatttcaaaaggtaagatatacccagacttgaagttaaataaattatcataggcaaaacaaataaggcaatgtccaattaaatgtcaaatgagagcagagaaacaattttaaggtagataagatcagtgttggctggtctgatggaaacatcacaggaagtaacgattgatttaagccttggtgaataagtagaagttggatacggataagcagagagggaaagaagaatgcatccataaaggaaatacagttatttagatgtgcaaggagaagattaacattatggtttaggatatgaatggacccatctggttcttttagaaaaccttcagtagataagtttaaaagaaagtaggttctttgtttaaaatagttatttttatgcttgtgttacattctaattattcctaaaagaataggtccaaggccttcctacaccatgtcaggaattctctgtggtcataatgtatgatgtaacccactgtttagtggagtccctatcatttggctaaagttgaagcctttgtatataacttaagtgcagagtgaacttaagaacacgatacaggctgagtatcccttatccgaatttcttaggaccagaagtgtttcagatttcggctttttttcagattttggaacatttgcattacacttactggctgcacaatctcttatccgcatacccacattccaaaatgctccaatgagcatttccttgagcatcatgttggtgctcaagaagttgcagattttggatttcagatttctggattagaaacgtgcaacctgtaggtgtgtacttctaacttgaaagtttatgtttgttatgtgaattagatagaaaataattattttctgaccgggcgcagtggctcacgcctgtaatcccagcacttcgggaggccgaggcaggcagatcatgaggtcaggagatccacaccatcctggctaacatggtgaaaccccatctctactaaaaatacgaaaagaaattagccaggcgtggtggcgggtgcctgtagtcccagctacttgggaggctgaggcaggagaatggcgtgaacccaggaggcggagcttgcagtgagccgagatcacgccactgcactccagcctgggcaatagagtgagactctgtctcaaaaaaaaaaaaaaattattattttctaattttactgcttgtattttgttactaggttctaaaaatattgtacagtattttaaattcaagtttatgccattaaatgcccttctccgtttcctggcagtctacatactgccacatgagcaggagaatcagaatttaaactcatttatagttaaaataaggtgttaaattatgatgattaacccaactgaccaaatggattgcaaagaagaagaaattatcagaagtgacatagtaagggtattccatttttaaataagtgtaagtattactggtagagagacattttaagtgactgacccttttgaattattcctccacagttccaggaccgtctgcagccctaacaacaatgcagctcttctccaagcaaaatccttcaagacaagaggttaccaaactccagcagcaggttaaaacaaatggtgctggcgtgactgttctcaggcgtgaaatttctgagcttcgcaccaaagtgcaagaacagcaaaaacagcttcaagaccaggaccagaaactgctagagcagacccagatcataggtgaacaaaatgcacggttggcagagctagaacgcaaactacgagaagtaatggaaagtgctgtaggaaattcctcagggtccgggcagaatgaggagtctcctcggaaacgaaaaaaggccacggaagccatagactctcttaggaaatctaaacgtcttcggaatagaaagtaaattggaatgtggttctagttccagaggaagacacagcttagtagcttaagcagttatgcatatcaggatactgtgagcaacatggtgtcccttaagcttctaggctttcagaacacaacttaaacttgaactcttatggttgggacattcttttcctgcttctcctgattgaactgatgcacagaatctttttactttgcaatagatttgtactaaccagacctgttctatcatgttttgaggagttaacttttttctgtgcagataatgttgaaagtaagttaatttgtttctgcatatatgcacatacatacgtaaggatcttaaacccagtcttgacagactagaagttaagtttaatacagaaaatgtcctgttcacttgaaagaaaagacctactttttaaatggacactatcttggttcttttttttttaagtcatctttttgttataagtgacctttgtctggaatgtctgaaaagtagttaatgctttttggtattgaagtaatgggtaactaaaatggacttccatagtattgactgtagaaggagcctctacaatattgactatatatttttataaactactggcaaggaacttacccagctgttatacatgttttcagttctctttgggggccatgtcctacatttgcatggatggatgcatgcattgcctagtcaactcacttaaaaagctcttgcactggtattgatcttgaacctctatacttctccactttttagagcggcgtcttagtttatttaaacgcttaacatcttccaccgcaacagcttgcctctagagggggaattgttcatccatttgtcctccagttttataggaacaagagactattaaagcccattgctttatctgctctctgtagggttcaggtacactggctaaggcagaaccccaaatttcaaggctctttctatcaatattggacctctgggagctaatactcctctttgctcaccaccatgtgatcattgatcagatgtggtgagtgagtaggggactcgacttgcgggatgcagttttgccattgcagcaaagttcattgaggaaaattgtaccatgaaaaagcattttgattatttcatttctggaggatgaccttgagggaagctttttaatattagtttcaagctttccttaccctacaactttaaacaaaagctttaattttgtttgcactcctattttgagcttgtaactggaaaagcatgtcttgcactgttcaacctcctgagtggtcgctttaacaacctccaaattgtgtacagtggttattttccccagttgtatagttttgagacattcaattatcactgtcttagttgtattttaatttactaaattatgtagctatttgactgttaagttcttttaaacaactgtttccttgggcttcagttatttaaagtaaatttaggtgtaatatagaaaactgtccctttccaggtgggagcttaacacctgtataaaacctaaggttttggtaagtaccttagttgaataaaagcacaaggttatcaccttttttatccgtccaccgtgacatggttatgcatcctttagattaacctcaccaaatgaagctttttctatccatttttaatattgtccttacataatattgtccttagattttgatcaattctatgtctgactttgaaattccatttacaatgtagtatgttttcaatgaaaaaccataaagtaacatccaagtgtttcatggtttgttgggaaggtaattttaaaataaaacaatttccaaaaaac

SEQ ID NO: 36130 - DNA, 42019 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggtaagtgctggaaaaagtgggaaccccagccccatgccctgtccctttgccctaacctgcatctcttcgagtaggtaaaaaaaaaaaaaaaaaaaaaaagggaagatatttttaacaaaacaagatgagaggaggctgggagactgtgggtgatgtcagggatggaggagccagttttctcctttcccctgctctggggtgagtggcctccacctcatcatccctgctgctcctgccttcatcaaacaatcctcaggggtttctgggtgctgactgggggcctccaaagcacagcacagtcaatggggagtggggagagctgggaagagcgggagaggggaattgggagaaggtaggcagggtacacagaaagcaggggactggggacctcaggaccatagccgctgttccttggcccaagccttgtttctaagaatcagtctggctttaggccagtcagccgccaggcaacctctggggatttaaatggatttgcaaattttctagattcttaagatatccttctaaacccccagcagctagaaaagtttgagggctaggaaagttcgagggtgatgggcggccatggcaaccccctagcggtcatgctgctgggtctgggggctgggacctggctgtcagatctgggggctcctctgtgaagaaggggtcagccactgggccatttcctttggtcccaggcagctgctcaggcctcctcgttgtctccctccttctggactctaccccttctccatgccattctaaagcataaatccaatcacaccacctccctgcccaggatccgcctatggctccccagtgcctggagaaagtcccagctcctaacagaggctgccactgcttgacacttactgcacgccgcaactgtgctgagtgctttatgagactgatctcatgtaatgctcaccagcaaccccagaggcagtgactgtttttacctccgttttatacatgaggaacttgaggctcacgcagccacataactgtagccacacagctagtaagtggcacagcctggagaggttggaatctccccgtgccccattactccaaacttgggccttttgttcccgccagtcagatcccagaattcccagaaggaatgcgcaccatcctgcttgtgggcatttgccctccctcttccccctttctggaatgcccttcctcatcacttttctttcagggatattccatacaccacctcttccaggcagccttcctaggttcttcctgtcttccaagtgctagccatgcactttgtgctgaagccatgttacttggccctcccctgttggtgatctgtttatgttctgtttgttcatcagagattgttcaggccccagcagtcagaactgaggccgcactttctgctggggaaaggtttaaggtttccccatcctgtgctcttcccccagtgcccagccctggataggcagtgcggctgaaaaaatgtcctggtgaaagggaggaggagctcactgaagaccttctgctcccaagtgtgagactagaacccaggcctccagccttctcacaggtgcccttccaggacatcgtgtggctactccaggcagcattcctccattgcaagcagggaggagtatctctgcttccctctgtgacctcccaattgcacagaggcctctagtgacaagttctgaagtcatgcagtcctcccctgtctccaagcaggagaccctgaatccacagccttcagggacatacagtccctgaacacctacctcatgcaggcatagagcctggtacttcacacaccttggagtcctcatggcaagtttttgaaatcagtgttattacctactttttgtagatgaggaagctgagatctggagaggctaagtgactttcccagggccatacggtgagttaaggtggtgtttaggctgaagtctgcctgactctaaaggcttacctcgtgctccccgggaagctcccagtcagagggaagaatctccatcctcctgcagagcctgctcctggcttcagcaccttccccagcagaaagtgcagcctcaggtctgactgctccaaggtctgcccgggccctggcttggtcttgagagaggaaagagaccatctggtcagcaccctcctcccagacagcagttatcagcagcccccctcctctgcgggaagaagagctgggacttataattgcccacacatgtggggcaggcagtggaaagcaccgtggatccagagtcaggagacccagtgcttgccctggcttgatttaaatccaccgtgtggccaacctcagaccccccacatcccatctctgggctccttccgcagctgggaggcagtgagcgctgtgggtaaccagcaccaggcttgggcatcagatgactatgcattgaccccgagtcagtttctggctgactgtgtgaccccggggcagcaccttgcctctctgggcctcaatctccttctctgtgagcagcaggaccgtgtgtgggctccatgagacaacagcattggcaaggtgcttaccacagttcctgcacttcacagctggacctctggccactggctgagagaaccactgctctcctggcctcctgcattggaacacttggctgtgaaattaatctgcaacctgcaaaaggctctgcccacagaagggacctggacaccatgtatgttccaaagatccgtgtccatcctccaggcacaggccacagtctgactctgagaccagctgccttctaggctaaaggagggtgctctgggcattggctcagaacaggctgctgctgaatgcagtgggaagggagaaagggatgaaaaggtcttctgaaatgcccacccatttcttgcatttgattcagaacccagtgggcagtgggttcttggaatgggaatctttttggtgccccctgtcttctgacccagagcgttaggagggaagggaaggggtgttgggccccttcccagggtcagggcttgtagcacctcagctgggaagcagtgtgagcatgatgatataacaggaaccaactcgttcttagcactttctgtgtctacttcaattgtgctttacatctgttacctcaaagttgctgctgtattcctcagcacttggaacatgctgggcattcaggacattcttagtaaatatttactggattaatttaaccatcgaggctgggcacggtggctcacacatgtaatcccagcactttgggaggccgaggcgggtggatcacccgaggtctggagtttgagaccagcctggccaacatggtgaaaccctgtctctactaaaaatacaaaaattagccagacgtggtggtgcgcacctgtatcccagctactcaggaggctgaggcactagaattgcttgaatccaggaggcggagattgcagtgagcctaagcgacagggcaagactgtctcaaaaaaaataaataaataaataaataaaccgtcacagcaacctcaaaattagatatataaactctccccacttttttttttttttttttttgagatggagtctcactctgttgcccaggctggagtgcaatggtatgatcttggctcaccgcaacctccgcttcccaagctcaagtgattctcctgcctcagcctcccaagtagctgggattacaggcgtgtgcgccaccatgcccagctaatttttatatttttagtacagatggggtttcaccgtgttggccaggctggtctcgaactacctgacctcaagtgatccgcctgcctcagactcccaaagtgctgggattacaggcgtgagccaccgcacccagctaaactctccccattttacaggtgagaaagtgcgcagagtcagttgcctaaagtcccacagctcggaagtggcggagctgggatttgcacctgggtgtttctgactccagatccccttgatgagaggctggatggggcctgggatgcccctggggatccagtgtaaaccctgagaatgtgcctcagctgtgggggccctcagcattccagaggtagtcatcagaccctagaaccctatgggactgtgcacagatcgttcccttctggggcctcagttttcccatcagtcaaacgaggaggttgacccagatgatggtaaatctttcttccagccctaaaacaatttcaggattccaagccatgccagcccagattggcagctgcacaagccttgctgtgtactcagggatcatgcatatttaatttcacaatgaaagggtttttttcttaccctttttctacacattacagaaagaggtcaggatcgatgaccactaatggaaaactttaacctgcaataacaatgaggaactttctgacaattagtgtggccccttaacgtgctcagtttcttgaggagctcagagggctcctacagttcccacatgcccattttcctgagatactgagcagggagggtcggggaggaaggcccactaggggctgtgtgtggatgctgtaaccctttaggtctcttccagtgctgcgttttcaaacctcatatgctctaatttcaagaggaagcaaggctttggcccagatgagtgatgggatccagaggtgagggggggaatggacacagggacctacctctggtgggagtgggtgtgaaattcccatgcttgttgcttccagtgtggaagcccacttcacatccctcctgagccctcaggcccagatcctcaggataaagtcttcctgaacctccaagccttagccccagagcccaccctgcccccgccccctacatccaccagatgcttcctggggtagcccacccccagcctggtgcaggaggctgaaaatcaaagtgtactgctttaaccgcattaaaatcccctcctctcctcaattcagatcagggctatttgatgtctcaggtgcctgaaaccttttatctgccagaggtaccagcttctccgccctgtgatggagagggctgtcccttgggagggtcagggggtctgaaagttcctgaatgtcagagatgaaaaggacttttgggggtcacctgatccaactgctttattgtatggatgggaactaaggtccagagaggggaagggttgcacctaaggtccgtacagatcattggtgatgacgctgagcctgggacctgggctcgcctttgttccaccacaggtgctgggtctttaccatctctctgaaggcctggagagacccagctccacctctgtggttcagggctcagcctccaggtctgtctgggctatgggctgaaaaggagcaaagccgtcccaacaagaaatgggaatcttcctgggtggtttgctggacccccgagcttttggccataccacttcttcattctaatcatagtttcctcttataataaagtggggagaagccaagggagaagtttagtggcccccagaggtccatccagctctgcccttagcccctgagagttcctaccatgcttcttgtgactgttttgccacatcctcattgctgctgctctgttaccttcccttctgagaagtggaaacccaagggcagtgacaccaccagcttcttcacttctgaggctgagcctcagtggttatagggtggggcagggtttccagttagccttagaggggtagggctcagctttctaaacatgtcacagaagccctggcccctcctggcccagagcattgaaggtaaaggtgcaggtttgacctggtggactgtgggtggctcccatctcacctgtatttgtgtccttatcagtgtccaacccagggcctatctgctgaatggatagtgaaataatcactagataaataaatgcatgtagagatgcataaatggattggtgggtgggtggatggatggatggatggatggataaatcgatggagacagacagatggcctcccctttagtccagggcacagagatggcttcatgagtactcatcctcctgagggccccatgcttagaagggcctatgtttggtttaatgctctgcagtcatcattttgaaattgttaataatttttaacaaagagccctgcatttccattttgtgcttgccccacaaattatgtagcttgtcctgccagggagttcaggctgagtttgggacggcttcatccccaacactggccttgcagcctccactgtccccatcctaatccacagcctcccactaaatgccagcctgctggtgtcatcctcctgcatggaggccccctccccacagtgcctggagttacagcattgccctgccaagccagcagctactacccgccatcactatcaacaccttgaaaagttggtggtccagagaaaatcctcacacagcaccgcagacctttcctgaagtctccctgcctccttccctggcctcctgctgcctccttcccaggccatcacctacctgtttgctgaagagccccagtttctagcccaacagatctctccctgccatttctcccagatgcctttcatctctcacagagccctggccatacctttccctggcatcatctgccaaaaaactcaagaaaccctggaggcctagctcaaggccacctccctcaggaagccatacccgctctccccactggagtaatcatatactgttgttagtcaccatttactgggcacctatgatgtgccaagtgctgtgcgtcatcatctctggccctcccagaaatggaaaaggaggtctcccatgccatttcccaggaaattgggactcagataagttaaactcagagaactggggcttggacccaggaataagtggcttccagctggaaccactgctcccagcctggcggggctcccatccctgccctggatggcatcaggcgcagcctgttggcttcagagtgccatatgtctgttctgccctcaccagctcatctccatcacctccctggaaggaaagagtcaccattgcctatccatgccagttccctagcctagtgaatcctgtgttattaggaggcagccgagggcccaggactgaagagctgaccctacagagccatttaatctctcatatcgtgtaagcgtttactgagcacctactgtaggcctaattccatattaggaagttgaagagagtccagatcgttgttaggtaggtatcctgatttgtgggaagtcatattaaaggactaagacaaaagttcaggaaagaagtaattgacagacagtggtgattagatgggtctggccttaggttggccaccgaatcgccgagtgtgctaggatgagacactcctcactgagcctcaggacactgaaaagggctgttgctactgattgtaccaataatcagcagctacctcttcctgaggagcgtcttttgggagaggccttcttgcaccgtctcatttatcacatgcatcactttgctgagaagcctagtcccgtggagtcttggctgtgcgcgcaaggccgagtgagtgagtgacttcttctcccttgagtgaatgaataataataatgtggccaccaactttgcagagggctgtgtgccaggccctattctaagcattttgcttgtgttaactccttcaatagccctgacaacccagtgatgagccccaatctacagatgagaaaactgaggcacagaggggtggttaagtgaatgaccgaagacaggggtgggaggacagatgctgagacagtgagagggtcagtgaaacatgggggttctctgccctcctgctctgccgcccaggagggctctgaggggaatctcaatgtttggtaattggcactgataagtgaagggtttactcattagctagctacccctcccctatttgcaggccctgggcctgtgggggaaggctgtgtgctggtgggtcagtgtgaatggcccaaggcctgcctgtcccctgcccacttggctctgagaacccattctatttgcggcccccaccccagcccatggctgctccgggctggcagcagcccggggaacagaaggtttgcttgtctgcgcctgccgcacccccctcctcagtctcagcctgggacccctctcaggggctcctttggctgccaagggcctggcactccctgttgccatggcaccggccggagatgaggctctggggggtggggatggggagggcagcagcaggatggtggaggcctggaactctgcagctacagaggccctggccctctgcaaacagtggaagggggtgctggggcccccacaggggcaggcctggaccctgtgcacagcaggcctgtggcagagccggccacacacctgggctgattgcctggatgctgtatcccgcaggagcactgcccctgccagaccctggctttcctaagcaaaaactctctcctcagccttgtgtgctcaccctcagcctctgcagcgaaattgtggagttctatccctagtcctgggttctatccctagctcgactttaaaattattggtgacccggggcaggcctcccgcatacactgcccctcagtcagagcagaggcgggacccagatccctgaggatcttctcatccctgagatcctggattccgtatggacgccattagagggagaacgtttctctgtggacagatggacagaactgtttctggtcaggagacagacagtctggcatgacgggcaagaattcaggttttggcagttgtggtgatgcgcacctgtagtcccagctactcaggaggctgaggcgggaggatcacttgagcccaggagtttgaggctatagtgagctgtgagctatgatcatgccaccacaccactgtactccagcgtgggcaacagagcgagaccctgtctctaaaaaaaagaaagaatataggctttggagtcaggccggcctgagtttgcattcccgttcctttgcatcttacttattgtgtgaccttgggaaagttaccaaaagtctctgagactcatcattctcctctgtaaaatgggaataatgagtgtacccccctcacagggtggtcgtgaggatgaaacaaaatctccagatcatctcatttagcagagtgcctggctctaaattagtagggacttttgtttgtttccagattgggggggatcagaacaataactagaaagatgtcctgtatttggggagagggtggttggtggatagaagcaagaccaataagcagagaatacagtgagataaactgtactcagtgtaattaacaattctcaatagtctgccctctgaagattctaagctggctaagaatgaaatgggccacaggtgaggtggtgagagccctgtcatgggaggtgtgcaattgcagagaaggtgggggagatgtgaatagagggaatgtactaagactgtagggctctgtgaaaaatggagtgactgtttcccactcaaactgtcagcttcagctttacccagctcaaaagacagcgtgaaagagtgaaaggagaagttgggacaaagaaggcgaaaagataaggctgacgactttattttttaatttatttttttgagacggagtttcactcttgttgcccaggctggagtgcagtggcgcgatctcgggttcaagcaattctcctgactcagcctcccgagaagctgggattacaggctccctccaccacgcctggctaattaacttttatttttttttatttgagcttgttctgtgccaggtactgggctgtcctttttgcggggctccttatctttgcctcctgccacagaggggctgtctcatgggcattgggctgtgtgctctggagcctgtctgcccagtattaaacactggagacaccactggcaagcttttgggcaaacaatgtaaacagtctgtgcctcagtttccacatctgtaaaatgaggaagcagtactgatgtcatgggattgttctgaggacttggtgagatcattcatataaggagcttagcatagatagtgggtgataagtacagcagacccttgaacaatgagggggctggggacagccaccaactgcaaagttgaaaattcatgtatagcttttgactccccaaaaacttaactgctaatagccagcctactgtgggccttactgataatgtaaagtcaattaacacatattttgtctgttatgtatattatatactatgttcttacaataaagtaagctagatgaaagaaaatcacaaggaagagaaaatacattcagtttatattaagtggaagtagatcactgaaaaagtcttcacccttgtctgcacgttaagtagactgggaaggaggaggaagaggaagggttggccttgctttcaggggtggcagaggcggaagaggtggaggagtggaagggtgggaaggaggtggatgtttcacatgtgtggaacattcacgtgttagtggacctgcacagttcaaacctgtgtagttcaagggtcaactgtactaaatcagaggtagctattattattattgttatttttaaggctgttggaggcccagatggggccggggtgggtggggggactcagggccaggaatccacagggccctgggggtaaccctcaaggcaccgcaggaggcaggaagtgcttgctctgcagccggtgggcaggggtgtgcagcaggcctccctccctcactgacctccttctcaggctgcttcccagccttcctggggacccaggccccctcccttgggcccccagcagccgtgaggcacacactgagcgctttcccacgcactgttccaagtagccagccgcatcgctgcccccacccccaagcacaggcactctgacgggtgagggggtgtttgctgcaggagagcggggctcgggctggggagatcagcccgttctttatcagcctggccccattccagacagatgtttcatcttattttggacttccagaaaataggtcatttctttccattgtgttccctggggaggcctcatggggagaggagcatgcagtgagtgacgagtgtgagggcctggcttgggccctggggagctggaggggcagccgccttcctccctcagttgtgagggagctgtcagggccgggccggaagattctgaaaggctgggcagagaagccagcctttgcctgagggggatggagagcagaggagggccggagaggtcacataggtatttcagaaaggtccctctggctggggtgtgagaacaggtggaggggacagattggaggtgaggagattggcggtgggatagccagaggcagccgagcctgtgctggaggagggggtgcagggggcttagcagccttccagggaaccagcgctattcttccatccagtttggacttccagagcagcgggagcacacgccaggccccatcttagtcgatttctgctgctttgttcaggggactttgtaggtacctggagaaacataaagaggaccccgggcctagaagcagcgtggcacagagaatggctccaacaccgagtgggctgcgccgggctgctctctttctgtagcccttagagtgatcccgaggctggtggggaggttcgtggtgcaggggtggagcactgagccttctccaacaactggaagtggagcgagcataggattgaagggggcgggtgggagcctcggccacttccccagtttctcccctccacctgtaactgtctcctcaccctccgatcctgctctcttctctggctcccaggatggggctccctgatcacatgacccaatcacacccacatctcagcctgcttggggacagccacatggaccagacttgccgccaggcccaggctgtgctgctatccctttcctactctttagctgctggcgggaggacttcatccctggctccagatgcctcttgcccccacagactcccaggcctggaactggcagccttctctgagctgagtcatgacatgggtccctccccagcacccccaccccgagcccagcattccagctcagcacagctgccttcccagagtggagccctgagggccacagcatgtcagccctgaaagtgctcccaagacactcttgcccacccttttgcacagataaggaaactgaggctcagagagggtcaggactgtacagtagtcacccttagctgcagtttcactttctgaagtttcagttaccccagatcaactgtggtccaaaaacattaaatggaaaattccagaaataaacaacttacaagctttaaattttgtgctgttctgagtagtgtgatgaaatcttgcactgtcctgtctgtcccgcccaggagtgaatcatccctttgtccatatacgctacccacctgttagtcatcaacaaagtccactactgacatccagccatcaacaccatcatggctcggtggtccaggatcacttggagcagatgacctgatccttctgataatgtctggaggtcagtagtagcctaacgctacttcacaattcttacgccatcacctcacttcctcttatcacgtaggcaccgtgtcattccacgtcttcacaagaagagtgaacgatacagtaagatattttaagagagagaacacagtcacatgacttttattacagtatatttttatcattgttctattttattattattgttgttcatctcttactgtgccttatttataaataaaactttataataggtatgtatttgcagggaaaagaacatagtatgtatggggtttggttttatccaaagtttcaggcatctactggggccttggaatgtattccctgcagataggggggaccactatcctataagtgggtgtcacagccgggactagagccaggtcttcttacttcccaccccaacccccctccaaagtctgtcccaggcctgtaaagtgccccggtacggagaacagaagactggactgggtcaggagactggagtctgtggctcacttctcccaacaacttagcaaattacctcctctgagtctcagtcgccaatccctgcctggctgggctcgtgcagagaatgtgactttgaaacaaaggtcaatgtgtggcaggacagaggtgtgctgtggagagggcaggggcagctatagcctgaagcctggggccttgagccaccagcctcacatcttagcaggggctggaggcggggagctgcgcagccaggtgagcttcagccccaccgatcacccgagcccatcttgtctaggccaaaacaatgggccctcttgctttccttccctaagcctcagtttccccacgagcacaatggagcacaggaaggcagttagatcagatagatgatccctgagggctctggcgtgctgacattccaagactctgaccccataaccccatggccaggcctcctcctccctcaggcatttggtttattcagagcatcccaggcctgagactgcctgcccccagcacccccctctccctgcagcatggccctctctctctcatctcactgctgtttctacccggcctgttcctggcctccagactgaacatcccactgtcccctcagtgcccacagaccctccctatcctaaacctgctcagttgcagctctcactcctgctctttgacctcattctcatctcagaaaatggcatcgtcccctcagcacgtgcgcgtgtacacacacacacacatacacttctgcctcccagtattccaagccagatacagaggtgcatacctccctctccagcccctcaatattaagtcacccagtcctgttgattctcagctaagtaactctcaaatccatctgtttttttcagtccccactgccttctccccagacccaaccaaacatgcacgttggtcagagaagcggtggagctggtggcatagaacacagagtcacaccacttcactttaatctctgctctaccccttctggctctgtgttcctagcccagttattaaatgctctctgcctcagtttccccactgtaaaatggaaatgatcactgtatctacctcatagagttgatggagaatcaagtgagccaatacgtgccaaatgctcagaatggttcctggtgcagtaacacgggctttctggcttgtctgttcatgcatatggctgtgtgttcaggtgaatttggggttctatgtgcacatgttctgtgcatgttgtatgtgctgcatacacatgtgaactgttgcacacgggtgcatctccacgggtgctgggcacagtgggagctgcgcacatgtgttttgtgtgggtgtgtacatgtttagtacctgcatgagggcttggcacccacatggcctcttgcatacgtatgtgtttcagaggagtgtgcgaggaagtgcgtaggcaggcatctgtgcatctgtgctgtgtgtatgtgctgaccatgtgcaggctccccccatcaacccccgcagcaatgcagggccccctccctggcctgcctgtgtcgtgggagcctcaggaccctgagggagggaagctgttgctggcggatgtggccaagatgggctggatttatttagattaaggcggtgggaaaggagtggagaattgtacgtgctgggaggagggaagtctggggctctgagaatgactccccaagcatgcttgctctcctggacttggggcacccactcctctcccctggacttggggtccttactctgctcctttgacttggggtccccactctgcttccttttgacttggagttcccagtctgctcccctggacttggggtccttactccgctcccctagacttggggccccccactcctctcccctgaacttggggttccactctgtgccccggacttggggtcctcactctgctcccctaaggggtccctctgagtcacgtgaggagctgggcatgatctccactttgggcctctgagcctacaacctggccagaataggaggaatcaggaggggttcctggcacatagcactctcttcatgggcaaaagggggacacctaggggtgccctccctctctctgctctagaggcctccctgggcaggagagtacagcagatagggggagtgcctgctctctgactgtgacatccagcttgtcctaggtggcccttccctagagtacagtcctcctaaagaggggaagttgtcacaggcaagcccactaccaccaagtcagctgcctgggcctccctgggattggctggaaccagaacagcctctgggaagcacaaagaggcctaacacatttggtggaaaatgtggggtatcagggagtcatccaggatggcctgggaagtcatgtctgggtgccctaagcccttctctgccctccctggccctccagcctcttgtccctaccactctttccttgccacctcctggggttccacgtcaccagcggaaagtcccctgaaacactgttgaaacactgttgtctaacttttttttttttttttgagacagagtctcactctgtcaccaggctggagtgtagtggcgtgatctcagctcactgcaacctccgcctcctgggttcaagcgattctcctgcctcggcctcctgagtagctgggactacaggcacttgccaccatgtccagctaatttttgtatttttagtagagacggggtttcaccatgttggctaggttggtctcgatctctcaacctcgtgatccgcctggctcggcctcccaaagtgctgggattacaggcatgagccaccatgcccagccttggtctaactcttaattgtatagatggggaaactgaggcccagagagggaaacaacttgtcaaagcccgcacagcaagtctgtggctgaatagtcatggaaattcctttcgtggaatgagatggctggtggattcttatgtgactctagcctcaggaatgtagccccctcctgcttactagcccccacctcctcaaaacaccccggtaagattcgtggtgactagaatcttctctttggcctgtcagaaaggcagagcttcaccatagggacagctctttgagatgacacctgccaacctctctatatggatggggacgcagagttcagagaggctggagactcgctcagtctcacagtgggtcccagggtgcttatgaggggagctgattgctctattcatagtaaagccagtccgagatccctggggtgcctacaacctccctacggcatccacactgcctgcctgtcctctccccacagcttgaatctgcctttttgctgtgtgactggggcatgcttctgtccttctctgggcctctgctgcccattcaaaaagcatacctcctagctcagagtctctaagccacccccagccccaggcccagcagaagagagcctgaaggggagaggatggagtgccacatgggaggagggtcgggggctgcatgccatgaaggcccagcccacatagccagcccagccttccagagccaggccagccccgctgcagtgacctcccttctcctggccagccggccaaattcctcctttagaataataaacagtgtggccagccagggagactgggagaggaggggcagggaagctgaagtgaccccctcccccagcctctgctaatgattttctttggctgagatctctagcaggaagggggcagccagaggggcaccgacggaggggcagatgggcctctgtgggggctgctggctccgccttggcgctgctccctcctgaccaaggaggcctggcatccagctggaggggctggggcagaggaatggtggggagcagaggctggagggggcgtcagaagggctgggctttgagtcaggagcagttcagagaggggagaggaagaaacgaggagaccttcaggcaggcagtctgaaagggaggagggaggagaagagctgatttgctcagactgtttcttggggtgttgggaagagctaagattgggggtccataggcgggaggagccttgcctatgtcccacccctgacatgtgaatgcagccctggtaggtgaggtactcaccatcatccacttccagagctggggacttaggccacagggagagcgatggcacaagaggtggcatgctggggcctgaacccggtctgcagacctaaactgaaaactaaaaggggtgagatggggaggtaggggcaagctgggcatggccttcagaggcaggccaggctgggcagccccacagccagaggaggctccttgttgcctcatcatgccgtcacctcccaaagctcatgctctgcgacccctgtcctctggcgtccttcctgccaatgctgcaggcagactcttggcatacttggctcctggtggtctcttgggacctgaggtgtgtcttccaagatagaggagagcaagggccaccccattcagtctgtctctgtctttgtccttgcttctgtctctgtctttgtccttgcttctgtctctgtctttgtccttgcttctgtctctgtctttgtccttgcttctgtctcttagtgcctctggtgctgtctctctgggcacctcctctctgtctctgtgtctttgtctctttctacttctatcattccaggtctctttctctctgtctccctctcagacaggctctgctgtggaatcttgggtaaacttctcaccttctcagagcctcagtttccccatctgcaccctgggggtgggggtggggggagcctggcttcactggtctccaaggacctgtgaggcctggctgctcgatgggacctctcctgggcccagcccctagccgctgtcccctgggcctccctgtatgctctgggctgagtaaaggtgtccaggcccacctcccacattccacagccccggctccccggcttcccttcccacagcccacagcctcctccatttcctgttgtgcttgtggagctgcgggagttctctgggttctggcctcccccctcctcctcccatccctttcatcacactttcccaaatatttgtcctggcagataagagcctggtattggaactgtcacccggaggacaggctgtcagagctggtaggctactggataccatccagcccaacttcccctccctcactgtacagacagggaaactaaggcacagagagagtctggggacgcagccgaggccacgtgagagtcacaagcagagccaaagcaaaggccaggaccccaaggctaagtccgggatggagaggagacagcctgtggtcatgagtgccctttcaggcttgggacgtggtggcttttgacttcagcccctcggacatgaaggctgggtggcccaagctggggctcattctgcaggagccaggtggtgagatagcccctgtcgctgcctccacctgccctgggccctgactcctgtttaactctgcaggacaccatgcggcttccgggtgcgatgccagctctggccctcaaaggtgggtagatgggagataaggtaggggacccggggggctgcggagtggaaccctggagctggcaggggtgatgtgtgctggtggcagggcgtgaagcaccaggcacactgccctgcccttcagctttagttttcaggatttccagtgggctctgtggaggcctccagctgccagcccttcagctcagaaagcgtcagtgggcccctgcttgtccagaaccatcagctcaaatcctttgattggccctccagaccccatcccaccttctggcccacacccctggcctcctatcctcggtctggtggatctgtggcactcggcttggacccctcattggctgggagcttccaggtccctgctgggcttctcagcacaccccacccctcactcctgcccgttaacatgtcttcagctctgcaggggctgagcgactgacccagcaattaatgaccagccagcagcctgcccggcagctggccataagatggactggctgcctgaccgcccacctcccctcctgatctgtatcaccagggggcatggagggcgtggcctgaaaaatccttctccaggggatgtcgtggagggggaccaatcacttgacacacacacacccccaaccccagttccctccagcccaaaagggcctcagcatcttttctggcccccctctgagctacctaagcccctccctcccatctctctcccacccagagccacctctgggccttgggcagaacctgggcagtcgggggagggggcagagagctgtagggaagaggctcagaaagtgacctgggaagcaatgcaggaactggaggccagggaattgcttcccgaggatttcctggccccttctggtgcctactgcctacacatggcactgctgaaggactcagaggctggggtctaacgggactgacagaggcagtccagaggaatccctggggccttggagctgggcgagcggtcctcagagccatggctggagagccccagtctgtcggataaaggagctgtgctcctcaaggacctgagggctgtgcatacgtggcctcctcgcaggctcagccttgggagaggtgctgaagcccctgtttcctgatgtctgatacctcctctcccaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccaggtaagggctcccagcctgtgtgcccactccttacccctcttgtcaactggaggcatcaggggaagtccagagagtgctttagtttattgtgaaatgcagccatcctagaaaagcagacaatcatggaaccagcctggctcagtcggggagtgtgttcgcacccactccttggtctgggtgatctgcctgctccctgccagtcaccctattcctgcctcccaagaactctatattctcagctgcttccaatctgctccctcttgaccccacatcccttcttccccattctccaagctccagatatcagctgcatttcaacttgtgacttgccttctttcttaccctggcactgtcaatatcaaacattagagctggaagggaccagctctaacatttgatttatgctcttctgggagcatccctattctgtaacggggagacagagggccagagatggcaaatgacttgccacacagcaattcaggggatggccagaaacccagttcccctgatttattcacggctccactcctggcagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccagggtgagccccctttctggcctgatgctcagcagaggcaagtataaccctccacagaggaatagccctttacagtttacaaagtgtgggactccacttcccagtggattctcaccacagccttcgaaggaagatagtgttttccccatgttacagaagagggaaactcaggcgcagagagaggatggagcttgtcccctgtcgcagaattcgatagtggcagagctggcctgtgcaacatggtcggtgagggcacaagcttcagagccagctgggtcgaaatcccagctttgctatttcctgtctgagtgactttacacaaagcacataatctctctgagcctgcttcccctcttgtaacgtggggataacaatggctgcctacctcataggatcaattgtgaagattaaataaaagatggagagtacctggcacatgttatgtgctcaatacatttctcctgtacatagatctccagagggtactttgatttccagactgttatcccttctagaacgtcagctccataagaacagagattttgtccactttgttcactactgttgctccagtgtccagaatagtacttggcatgtagtaggtattcagtaaatatttgttgaatgaatgaatcttctacatcagtcatcctttccctctctagccccctaccctatccccaagctgaagtgctagtggctggtggtgacttccccagacctaagccaatctctctctaccagtgtcatccatcaacgtctctgtgaacgcagtgcagactgtggtccgccagggtgagaacatcaccctcatgtgcattgtgatcgggaatgaggtggtcaacttcgagtggacatacccccgcaaagaagtaatgtggggccaggcaggggtcggaggaggggccaggaacgggtggatatctggcttgcaggctgatttctccccggcccctcctgatttggggggcctgcccaacctgttgctgcagagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttggtgtgtgccttgggctcagcccaatccccaattccttcaacgctccccaccctcacccactttgctgggtgcagagtgatggtgagagttgcatttttgatacagtgatcagggctgagctggacccagtgcctgtcacagccccggggtatagtcagccacactccagtgcagccctagctagcctctgtgccaaccaaaaccccaattccaggataaaccccaaaccaaaatgtagtgtcagccccaaatccaaccctatctcaacctagactttctgactagccagagccccagccccaacctgacttccaagcccaactgccatcccaggtccgggaagccccatccccaaattcaaccttatcactagtcccagcatcagccacagtactgacccagaacagagaactgttagtacaactctgttcccaacctgggagctggccccagcatccatattagccccaaattcggccccttctccaggccctgtccccagcccaatttcaacctcagctccggaaactccatggctggcacggtccccaggcctgaagccccaccccacaggctggcctcctttgggattcagttggtgccctgcccccagggccccgcccctgacggtcaccccttgcagagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtgagcagctcgctctcccatcccattcttgaagttatttttctttgcagccgccaggcagccctcggctttcagccacaaacctaggcccagctttctgagagcatattaggtgccaggtgctggggatgctgcagcgaccagagctgacagttcatccctcctagagtttctagtctagtggaggaaacagtcgccggtcagatgatcacccagatgtttagttgtccttgtgatgggtggggccagcagtagcagccaagaagtaaacgggcagatgactggggaagagggtgccaggcaggccactcatggcctgtggtatccctgaggctggagatttgctggctgacagagactgtggtaggttaggatggagcagtgtccacctttctgaaggggagagaaataggactttccttcaatgctccccacccccacccacagttcatctcaaccctccctcttggcctaggggaactgcctgtgggtgaggatttacgagacctggtttgagtcccggctctgctaccaatgccgagatgaccttggcaagcccttcccctccctgggccttgttcctctttataccaggagggtggggagaactgtaagagtccttccgactctgacagctgcctttcctgctccccaggtatgtgtcagagctgacactggttcgcgtgaaggtggcagaggctggccactacaccatgcgggccttccatgaggatgctgaggtccagctctccttccagctacagatcaatggtgatgagcacgcccctcgccatgtccctgctccttcccctccctgcccccgttccctctcccttcctgcactgtccacccacccatgggaggagtgggagagggagcctggaactcaggagatggattctaggccactgacccactgccgtgtgaacctggcctctgggcctcagtttccccagctgtataaggaggccatctggctagattggtgtttccaaaacttcaggcacttaggtaccaaggccatgattttcccttctcacattccacttatactgtactattaactcgataggtatttattgagcaactaccatatgcctgtctcttcaaggttcttgaacttccctccctgcctttgtgcagcttgcatccaagtaggggaagacaaacactaacagtagggaggaaaaccccagcaaattacataggttagaaggtaactaacactgcgggagaggaaaaacaggggccgggtagggaaggttgagagtgctgggcacagagtgatggtgtgagttgcatttttgatacagtgatcagggctgaggaagtgacatttgcatgaagacctgaagaaggtgaggacattagcttagtggatatttggggaaagggtacctcgggcagtgcaaaggccagagcaatcactgaaaggcttgtgtggttggaacagggctgttggggagagtggtgggagatgaagtcagaacggggatagggcagtgggggctgggagaagggcaaatcgcataggtctttgtgggcctggtgcagactttggcttttactatgaccgaaatgaagagccatggcagggttttgagcagagaaatgacatgataatgacttaatgttttgttaattgactttctaaaaacaaatttattttgaaagacaaaatgtaacctctctattgtaggtggaaaatcggcatcacatgtcataaatataaagcaaccactaaaataaactcagagaagaccaaacaatgctattaaatgctggcttcatgagcttggtggcccagggttctgagcttgaggcctagcctccctttgttaaaagggaagattagcaagtctcagagaggtgttaaagacagactagcaccctgctgaggcgttccctttgaagtacccagaagggaacccatcggttttcacactgattcctggtatttaatgttcacctgcagtctacagccctcctcccccaagagagtctctgggccaggtcctcccctgaggacctgtcctgttaactgtcctgaccctcccgcctcctaactcagtgctctctccatgcagtccctgtccgagtgctggagctaagtgagagccaccctgacagtggggaacagacagtccgctgtcgtggccggggcatgccccagccgaacatcatctggtctgcctgcagagacctcaaaaggtgagcagacctgggcctcagtctcccagtgtccccagctggctagaaaaagctcgtgaaggttatctagtcccgcccgttcttcttggcatattgttccgggcatagagttgcatcctaggaggccaggtcaccacctccttggtcctactctgtatgacctaaatggtcccttttccttacctttacccctgggcagtttggcctagcaaagtgcagggtctgagccccagagacctcacccgccctgtagatcagttctgcactcctggccaggtcgattctaatgcagtggacagaggcaggattcagtgcaggttctgcctctaccccatacgccgtgtgaccccgtgggtcaaataagaatggattttgcaatccacgttgtcagttctgggatgggagcaccccctgctgaccagtagagggagcacaggaggagcccgctcggaaacaggcagtgggacataggaactggacacgtcctgcctccttccaccagtttctcctcagtttccctgtctgcaaggggaaggggctggcagccaaccctaccggctctcctggcaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactgtgagtccccagcctcagtggcccctgacgatcccaatccctaccttaatcctgcctaattggtaatgtgcccatgtacccacagcaggccaaaggagttagcatgcccaggggcaaacaggagcattgtgaaaccctgttgtgtacatgcataggaacacattctggcaaacacaatatgggtacacacgtgtacaaacacaagtctgtaagccatggatatgaatatccttcagtgtggtgtacatatactatatgtatgtcgtaagccatgtacatgagcatgcctgttccttgaacataggtgcaaatcctctgtgtgtagatatgtaaatcgtctactgaagaatgcccaatctccagtcactcctgtaaagctagagtgtatgtgtataagcatacacctgtgcactatgcctgtccatgtatgtaaacccaccacgtgtttgtaagccatgtacatgagcatgcctaattcccagacatctgtttaaaccccacagtgtatgtctgtatgcatgtaccggtgggtacacaattcctgtacatgtgtacaagcaatgcatgtacaattcctttgcatgcatgcaaactggcatagtgcatgtctgtaagcatataattggagcacacctttctagaaaagtgtacaagcataattcccgtacacatgtgcctgctgtacaatgtacatctgttagcaggtacacatacacgtgtaatttctgtgcgtatgaacaatgcctaccagtgtcttgatgcttttgtgtatctagctgcccgtccttatgcatacatgcacctgtatgagtgtgcttcatttattcacctttcttcttcattcgataaatatgaggacccaacttctcattgaagtataaaggtcaaagggctcagccctgcctggacctcctagtacccatagtccagagagagaaggcagacaaggaacttggcaattccctccgggatcaccacattaggggcaaagcctggagggagaaggggtcccatgcccagctatgggattcaggaaagtattctagaaaaggaacctttaggtgaaaacctgaaaaatgactagaagttagcctggtaaggaatggtgtcccactcagagggaatggcctgtgtaaaagcccagaggcaaaatgagttcctagaaatgaaaagagttcaactcaatctggctggaggatcgagtgtgtggatacttaggggctggaagggtggcagataaaggggaaggaagtgctatgggatggagctacaggggtcggcagatctagagcaggcagggctccaaaggccatgtgaggcatcttggtctctgtgtatgcaggtccctgggcatgttcaggcacgtgcctgtctagagctgcctcctgtcccctgccctgtggtggatgggtgggcttctttcatcccctcatttcacccatgctcccacacatgcatacacattctctgagcaagtgggtatctgggcagacagtgtggacagcctgagtggaagaccagctctgagccaaggcagatgtgacacttttgtgtgactaaagcctgagcgggaagctgagcaccagcacacagggcctaggatggctgcaagagggctccttcatgcctccagcgatggctgcctagaagatgcaggcttccttcccaggaccgagatgtgtgatgagcgggaggagggaggagaagagggatgttggtctgggaccctgaggaggaaggcatggcgaggataggtaagggtaagggagaatggataaggggtgagagacgaagttggagagggaagcagaggtagagtcatgaagcctctgccttatgtgccattttaggagtttggcctttttcctttactgataacatggggaagcatccaaagttttttttttttttttttttttttttaagatggagtctggctctgttgcccaggctggagtgcagtggtgtgatctcggctcactgcaagctctgcctcccgggttcaaacaattctcctgcctcagcctcccaaatagctgggatgacagcagtccaccaccacgcccagctattttttgtatttttagtagaaatgggatttcaccatattggccaggccggtcttgaactcctgacctcgtgatccgcccaccttggcctcccaaagtgctgggattacaggcatgagccactgcacccagcctccatccaaagattttaagcataacaatggcattcacttagtaattcaacaaatagtaccagctacctaccatgtgccaggtgtggttttagggactgaggttatagcaatggatggggaggaggaggtgggacaggactccctagggagcaaagaagcatagattggggacagaagaggagggaatgagttccataggacctcatgggtggccagcagggcagggcaggggagaggcaggtctggcggggctggatgaggagagtgggaagctgtacagcgaagaggctgaggccttgagggtggaggagactcgaggcttgtaagggccagtgtgagccccactttgttaactaccgtcaccactccaaccccaactgggccctttgggtgaagtggggagaagtggcctccgtgctgaggtctggattcatcaggctgggggtctcagccattgctccctcagtggccactcactcagtccaccggccactcggtcaggcatggagcttggagtctgaccgagctgtggcagccccagcaagggtgtggactcagaggagaggtaagccacaacccagccctcaggggctccagggctaatgggaggtccaggcaatggacaggaactcagaacaggatttgcaccccgtccagagctctggcagcaaggccagactgactggcagggctgaagggacgtggaggccagcagtgatctgagtgggggtagttactgaggggatggagtatttacaggacagtctgaacgtgtggcctagagcgagatgctgagggtctgacactgcaggctgatggggaggtgggcgcttctattctggacaggatgtgtacggagggatctatgatgccaaagatggggtgaggggagggtagctgcccagtttgctcatggcctgctctcatctctgcctccagccttgccctttaaggtggtggtgatctcagccatcctggccctggtggtgctcaccatcatctcccttatcatcctcatcatgctttggcagaaggtaagcccctccctggcccagtgggtgaagactggcacatcattattttgcataaattccacccctctgccctccttgaatgctgcgtgatctggccacatgcagggctcagcatggaactcaggtggggacttgtgacgctggctgtctcagcttcctccacccccagcagtctgggccaacctgagcctggcccgagctatccaggattcccttcccctactgtgtcattaagtccccgggtcctgctgagacaccattcctctcatcctagccatggagcatgggacctttgaggtggactgcatgggctccaggattcttccaggtctcacccatggagaacctgtgattctactgaaatgcattctgatcctattagtctgtaatttcagtgttctgctttgagattttaccattctgtgattccaacattttaagcttcctgaatcaggattacagcacctcatgatcccatctttctaaaattccagtcctgtggttccaacaccttaagatgtcaacattctaagcttacatctttctgacttgcccagcactggggagggccatccgcatccagccgagtaccctacctggtgtcactttctggggtcacctgctctactacttccatctgaggagcagcgaaggctgggagagaagctagagaggaggttctcatgagccaggccctcagctgccagttgctcctcagtctgccaagtcctgaagcctcctctggggccccttggtccctgttccctccgagcccacgaagaccttggctcagttgagcacttgctgtgtgacttcaaatatgcccctgcccctctctgggcctcagggtctcctgccccatgtgtcctagacggacgaacctaatggggctcagggcctgagactccctctgataactaattcctggggttggtcctccagaagccacgttacgagatccgatggaaggtgattgagtctgtgagctctgacggccatgagtacatctacgtggaccccatgcagctgccctatgactccacgtgggagctgccgcgggaccagcttgtgctgggtcagtcctgagaggcctcatgtggcagtgtggggactcaagttgggtgggaagactctctgaggtctggtcccagccttgccatgactagctatgagacctagggctggtgtcttgccttctctggccctccatctcctactatgtacaatgagagcaagaccatcccccaggaactgcctagcattgaggttctatgatcctgtgaccctgtgagacgggatccctatgtggcaaaagtggaaggattgaggacaggctgagtagcaggcctggtctggctggggaagctgaggaggtacagagaagcgtgctcccttgggagggaagaaactttccagagattaaagatggggcagaaagcaggcaggacttagatgagataccaggaaagacagggaggtattgtggttgcaggagtgtgtttagggaatatcctgagtccaaggtggtttaagtaatgtctaggttgacctaagagagtggctctttcccctcactgggcaggaagggtgatagcggccgggggtaggggagtggggggaggggggcagctgggggagcggtgcagcttcctggtaggccaggagctaatggatcatctctgcaccaggacgcaccctcggctctggggcctttgggcaggtggtggaggccacggctcatggcctgagccattctcaggccacgatgaaagtggccgtcaagatgcttaaatgtgagtagtccttggagccctccacatctgggccttcacctctccctgcccctccccacacacttagcctctcccagggtggcctgatgctgatttgcaggcactagaggggccatcacactgcagcaggcactgctcccgagtctgggtctggtttgggaaagagcgttcctctccctggcctcctcggcctgcttccccctaccctggcctcttcccctcctcagagtgtgggtgctcacccccgccaggctgcctgggtcttgcagcacagggcggggcagaagagtcagaataggctcctgtggtggggcctccatggagcctccatgactgggcctggcctggggcccccattttcctcagccacagcccgcagcagtgagaagcaagcccttatgtcggagctgaagatcatgagtcaccttgggccccacctgaacgtggtcaacctgttgggggcctgcaccaaaggaggtaccgagcccactgccccagaggcctcagggaaagtgcccaccaccaaggccaggccccgcctacccccccctcaggccttgcacaacagcacactcctgctggagggtccgtgcccacccgctccagcgccctcactgcgcggtcccagagggcggtggggtttagaaactcacaaaatcacaacaccttcaaggctgaaggattagtcaggtcaccagtcccagcagcttccagaccatggtgttggctgacacttttttattttcccaatacattttgaaaaccaataaataacagctcacatgacattaagatgagttatatgcccaccattggagaccaccagcttgctacttgggagctaccttcatttgatcatagaagaaagtctctgtggccaactgggtctatttgaagctctgattgccagttaggctgaaaaaaaatgttatcaccatttgcagctgcttattgtgagatttgggattttcctcagcattatgcaaccaaaataaaatacagaagtatgttgggtacatagacttattcacgtttgcaatgatcgctcatttcaacattttcgtttgtgtagatatcttcaagttctcactgattgactttaagtaaatgcattgtagttgaatttaactactaaagtgatcgttgtaaacagtggcctttatctgctttctatactgggctccaaagtaagctttagtttgaaaacatatcaataagagccaacactgcgagctcgccacgtgcccagccaataaagacatcatctcattaatcctcatgacagtgctttgtggtgggtttaattagccccacttaacagctggggaaggtaaggctcagggagactaagtaccttgctctccaccacagaggcaggaaaagaatccagatttgcaaggcactaaagcctcctagccgtcatgccaaagtgtctctcccacatccagcccctgattagcctcatggccttgaagggacgcctgaggcctccatagggactgtccctgagcctgtccctctgcaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccaggtaccaggagggaggccagggactgaatctttgggatacctgaggagcaccgctccttcccctccttttgtccaggaggggaagctgaggctgtgacagggcaggggacagaatcactcctggagctagggctgttccacaagatggtccaccccagatgagggaataacactaatgccaggccctgtgctgctaagccctctacagatgtgacatgccatccctgtgtcgtgggtgtttgcccttcagtccagggcaggcagtgatggaggaaggggcagaggctgtggtgagatgagagccaagcctcccaatttgcacagtggtgctccaggctgtgttcctctctgcagcctctacacatcagcctccacactgcctctcagggagctcaactccagtctttgtcttttccaaaaagaacacttcttagttctgttgctgattacaaaaacaaagacaagagtagcttcagaaaagcgtaaaagaccttaaaacccactcatgtcctctccaatgttttgacattcagtctcccaggagccaaagggcttctcccatctttttcctgcctatagagacagatgtgtgtagagccccacagctctttggggagctgatgctacaggcataggtagcggggtgaatcctggctgcctatgctgggttgcagtcaggcactcccatggccaggtggcgctggggaggccacaggaaggcgcctctgaacacacccgtcttgtgacctttgccctggggtgctgtaatcgcctctgggtgtgagctctctgggttctaactgtcattttggtagcctcagtgcccagcttggcccagcaggttggttgaaaagtcttgatccacaggctttcctactgggatagactgaaggaagatgagtgagtgtgtgagtgagagaagaaattcatgagtggcaaggggcaggaggggaggggaaggcaaagcctgcaggctctcctgtgatgctcctttacccccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctggtgggtggacatagtgacatagtaccccacatccaaacaggctgatgctcttcacatgcccagccttgccaaaaaccctgagaagaagggagcctcgtgcccatttcatagatgtagaaattgaggctagccacctggccaaaactgatctgtagtggacccctaaacggaagccctgtttatggatccggaaacatgcgtagaaccctcagggagggagagagcagggatatgggaggacctggccttttgtcgtggtagggaaagtgatctactcagcttcagccccaggctggtctagtgtccctgagaggcaggcaggcaggccaggctgggcaaaagtggcccaagggctaatgccaaaaggccaatgagggcactgataaagcaggagaactttgagtttgatattaagaaatcattctccttttaggggagacctagacgatcagtagccacctgtcttggacattcagtctcccaggagccaaagggcaggggtcctgtgggccagaaggagatataagatagcaggtgaccctctgcttctcctctagcccctgagaggacctgccgagcaactttgatcaacgagtctccagtgctaagctacatggacctcgtgggcttcagctaccaggtggccaatggcatggagtttctggcctccaagaacgtacgtgtggtgttggtggggcagagtgggggctgtggggaggtgggtcacccagccagccagcatcctccaagagcacaccagggtggcctctcgcacatgggcagtgttgtattttcccaaagcccttgacatgaagggtctttccccacaattgtccccaaggcctcagctcccctctccccaaacccagtgcgtccacagagacctggcggctaggaacgtgctcatctgtgaaggcaagctggtcaagatctgtgactttggcctggctcgagacatcatgcgggactcgaattacatctccaaaggcagcgtgagtaccttccctggcccctgcagggcagtcacagtgcctgtgaccgcaggaacagattccctcctgaccagtgtggctgcagctcataggaaatctgtgtggggctccttgtggcctgccctgacagcagtgatgggctgtgcctgcccagctatgtgtgcagggacaggatggggagccgcccaggagtgcatggagcaagtatagcggcggggagggctggctataatgggtccagggtgggggaagggggaacaggccgaatgtgttgttccagtggtggtgggcagaggaagaagcccaggtgacagggcaagaaagatgagcaggtcacatgcagtagcagggattggtctggttaaaacgtgatcatcctgcctgtctctcatctccccacttttccgcaaaccccagatggagggacgctaggcccagagatcaaaggcagccaggataagagcttggggggtgccttgacaagtccctggctcccacacttcactactcagaccctggggcttttccccagggacaggggctgccttgtccccagctagtgagaaaggaaacagcctctggtcctctgaccagccctgggatggacatgggaactgtgctgcgcagagaccagggccctcacagggaatgggacggagaagtggttgtgggtgggagctgccagataccctcctcccatcccaggtgcagagtggggctgaggtccttccttgcactcagcacctgtcctgacctccctacagacctttttgcctttaaagtggatggctccggagagcatcttcaacagcctctacaccaccctgagcgacgtgtggtccttcgggatcctgctctgggagatcttcaccttgggtatgcttgcttcctcctccagccctcagcatcctggcctggtgtctacctcgaccactcatgcctctggcctggtggggctatgggacgagccctgatacagggatcctggttcaggtcccagctctgctaccttctccctgctgtgtgatgttagcaaattctttgccctctctgggtctctttatctccctgtctgagcattgacaggtttgaacagtgacatcagaaagcctgcttggctctcacattctggctgtctatcctggggagggttgtggtctctgttcagagcccatgaaggagcccacagttccaaatgccaggggcactgcccccttacccataccagggccagcatggctctccttgtcctgtagaagagggtgccctgccacttttccacccctgagcctgtgtatctcttgtctctgctccccaacaggtggcaccccttacccagagctgcccatgaacgagcagttctacaatgccatcaaacggggttaccgcatggcccagcctgcccatgcctccgacgagatgtgagtggagtctcatgcatttgggaggattttgtgctgcaaacaatagatatccaactctactggcttaaaccaaagatgagagatttgttagctcagagatctagaaagccttggtgtaactggatccagccattcaaaggatggcatcaggaacctcttgttctagccctgagctctgctttgctctgtgtggcctcattttcaggccagcattgcccaaatggctaccagcagtgccagtctcatgtcctactgcttgctccatagtgccagcaaaagtcccagagctgaccttcaagggctcaggtggggtcacatgccatcaagaaccaaccgtggaagctgcagggctgaaaactgttggcgaaggttggctcctgtgctcacccaggcgtagtcaacctgtggaaccatgtggaatgggggctctgcgagggcctcccaagggaatatccagagacaggacctctggatacacccagccaccacttccctccagctcctttccatggctcaccttgttctgagaggcagcagcctcctgctcccccagccctgccttgtcccctgaaccctgggccagaggccctgacccttctccctatccccagctatgagatcatgcagaagtgctgggaagagaagtttgagattcggccccccttctcccagctggtgctgcttctcgagagactgttgggcgaaggttacaaaaaggtatgttgaggcagggtaggggtggagcacggagagctctggtgcagaagtcagacaccgagtacaaggctctgcgtgatgggctggcatttaggggaccaccctttgtcctctctgggcctcagtttccctgctggttctaggaggggatgggctggcgctgtgagtttattttagcagcagagagctttatgaaatggaatcctacatggaagctgatcgattagatgcagggagggggcctagagcactgtctgtcctgctgcctccctcaggcctttacctccataccgaaccgtggggctccttcagaagtgtgaataaccccaggttacatgaccatgaaccgcctgaccacttggatcctgtcacaggattgtccaaggcccaaagagccagtagggccctgaaaccctgccccgtccaacaacacgggtccaagtgaggaggaaatacacatggcctttgacacagaggcagctccttctttgggttcatttctcacccccactgccccccggggatggtcccagggacctgggagatggagtaaggtcatcaccacttcacagcaaaggaaactgaggccctgaagaaggacgctgaggcagcatgagagcctgtgcctgtctgctctgaagtgggggaagagttagagtcctgggtgctggtctgataactgcccctccctgggtggtcctgagctcaccatgccttgtaagattctatgtgaggtaggagggcagctcaaccatgtggcttgggcaaatccctttcccctctgagcagcgggggtcttatttatacaaagggggatgggctcggttagaagatccctgaaggcatttctggcctgaccatccctgtttctttggttctccctgccccgggagcagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccaggtaaccaccctggcctggggccaaggaaattgtgcacagtgtgtgtgtgtgtgtgtgtgtgtgtgtgtgtgtgcgcgcgcgcgcgcgcgctgccaggtttgcctcagaggtaagttacgtagggtaagtacttatccctaccaatgaatagaagacagaatggaactcatttgaactttgatgccctgaggtggaaagggcaggctagtaaaaacaaaagtatgggctgggacttacttgcaaggtagctatttcctttaagggagcccccagaggttatctatactctcttatctctaggtcctgtcctagccccaaaaagaagaagcaaacctacttagcatccccagcaccccagctgttactcatggccagcctgaggcctatgttctgttcttcagcaccacgccctggggccagagggagcctgcttggttgtaggagtcagaggtgcctaaaggaattcaggacagaattcagactgggaaggagattcgtggttttcttttgccttgggaagtggtgaagttacagcccagagggggctttataggaggaccctgctgttgtgtggacttgatgtccacgcaggatctccccttaactggagagaagggctccccatgaggccacgcccacctccaaagcgagatccagcccaaggtgaagtggctggagccccaggctggggtactgtcccaactctgccactagccgctgagacctgggaaggcttctcctctgcgagcctcagtttctccatatgtgccaggagtgcacaccggccttagaaggctccgaaggccctcattgctctaactgttgaagaggccaaccatccaagagtcccagtggatggtgcagaggagtgaagtgcagcgctcacacagcttgaggtgtgaatgctcaccctgttttgtgccctcagacaagctgcttcactgtctaaacattggtgtcctcttctttttttttttattatttttattcatttatttatttatttttgagatggagtttcgctcttgttgcccaggctggagtgcaatggcgcgatctcggctcactgcaacctccacctcccaggttcaagcaattctcctgcctcagcctcccgagtagctggaattacaggcatgcagcaccacgcctggctaattttgtatttttagtagagttggggtttctccatgttgagactggtctcaacctcctgacctcaggtgatccgcctgcctcggcctcccaaagtgctgggattacagatgtgagccaccacgcccggccagtgtcttcttctgtaaaatacaaacagtaaaagtacttctattaggcggtcattgcaaggattaaatgagatagcatacacctttaggagtgcagaggagggagatgctggtgggtgagaaacgagctttggagccagctgaccctgctccgaagttccagctcctgcacttccctgctgtgtgaagtggggcagtgatataacctctctgagccacactttcctcacggtgcaggccttgcatagttttcacaagagttaaatgagccggagtgtgtgaagcctacggtgcaggggtggacacaccgaaggctcttcatgactgctgctggaatcctcctgggctccttcctagcccctcactcactgcctctttcctctagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaaaatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttgagtttttctatctgtgtacttttttttaagggaaagattttaatattaaacctggtgcttctcactcac

SEQ ID NO: 36131 - DNA, 26645 bp, Homo sapiens
acaccagccctcagtcactgggagaagaacctctcataccctcggtaagtactgtacggcttttgccacctcttcctttccggggctgcctggcctcctgggtgcgggaggtgcctccagattggcctggcttctgtgacgctggcccagatcacacaccagagcccttggtgggcagcggcacctgcaagcatactgcagcctgctgagaaaaggcgtatctggccatgggacatcctggggcaggggcagcttggaaccgtgctccctgcctcagaatggggactggcgggatataatgcctgcagtctctactagccctgctccccagggccagtgcagatccacaccctgatgtcctttgtcttgggttagaatgtctgggaggctgttttaggggatcatatactttgcagaaaagcagcttttcagaatacttgagtcaaagccaacagtggtcctggtgtctgtgagctgtttagtccatgaaatgtctgtgctgggaatgggagggtattttcttcaggtcccctgtgggtctctctgtcctctgatctgtgcttggctgaggagaatggagggtttctgcagtccttgaaggctctaggatcattgggggatggagaaaattccacttgccctgtggcatcgtgaggtttcagggtagaaggaacttgggacccatctagttcattctcctctgatgaggacattgaggcctagagacgtacagccactcatccaaaagactcacacccaactgtgacccatttgcagatgtcattactccccccaacccacccaacacacacacaacacatgcacaaagaattaagaggaagatgagatgaaggggccacttctatgtttggcatcagaattcactagcatctcttcacaggtgaggcaggctgggtgtggcagtgcaggccttgaaggcagactgtcaggctaaccaagttactgagcgacctcagcttcctcacctgtaaaatgggggcaagaataataatatctacttggcgatggtgtgaggattaaacgagagaatgcgtatatacagcactcagctcaaggctgtcagggcccggccctgagttctcaaactttaagaatcacctggagtgcttgttaaaacacagattgccccatgccccaccccagattctgattccagtaggccgagatatggcctgatacttggaattcctaacaagctcccaggcgacactgaagctgctggtctgggaccacactttgtacagggaggctctaagtgctcactttgattacttgaatgtgggtttggactctgatactaacccttgggctgaaaagaggaagagcttcctgtgacagagagggatgggtgctggagaaactgcaatgaacagtaagatcctacatgccaggcctgagaaaaggggatgggccgtgtgacatcatgaccttggggcgagatatctttcctctttccccttgttcattctgccaacatttattgagcacttattatgggccaggcactgtctctgctccttagggacagtggagaggcttctgcagttactggaagagacagataaacagatgagaaccatggagcaaataagtacacgaaaggggtaaaggccaggaggagcccatcactcaacccaggagttatcagggaagacttcctggaggaagaggtgcctgagcttggtcctgaagtaaggaccaagcttggtccttcctggtaaagaggaagcatggtctttgggactcaagtggctcaattccactgaatttagatagcaaggcaggaatcaggtaaaactaaattcagaggggtccgcagggctggattacaagggctttagactctaaaggatcaggctatggggagccatggaagggttttaatctggagggtatctgttgaaggggctgctttggcagctgtgaggagagtggactggaacagggcaagagcgctactgcagcatgcggtggtcctgagctggtggcatgggtgccgtgcaggtagaagtaagaagggctggtgataggttgggagggaagagggcggcaccagggcattgggcatgggctcagggtgggtggtgtgagtctgtgagggcagctccgggcagaggctgctgatgaggagagcagtcctggaggtgtggagttggggtgccaggggggttttggtgggggagatgcacggcaggctctgcaggcctagagctcaagagaggggtctggacaggagcagagccaggggagtgaatggaagtccgggtaagagccagaagataaggcacccacgacagattgtggaggatccaaaatattactcagcagagttgtttttaattgaactcatgtatatatagaacctagtgaagatatcctgaagttaattagaggtgctgttagaattttccatcgtggcagtgtttttcatagacaatttctctctgccagggtttctgatggtttgtatatacgtgtaggcaaataataaaaggcagagacgcagctgcttacatgtcacttgaagctctcacccaaaaacctgtcgccaactattgtttgaaatctcatcatcgcagaggccctccgtttaggcctaacactttctgtcaaaatgaaaatgtctttgagaactgacataaattcaactttcaatagtcattgatgtgtgaaatggatcattcaattcctttcaatatgacaggcttcatcctgggagcaagttttgatggagaagagtaagagagattaataagaatcattattctttacagcccttgacgacagggattgacgaagcccggatagtaaatattttaggctttcggagcctgaagttctctgtcacaagtactcaattctaccattgtaacaaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccaggagtttgagaccagcctgggcaacatagcaagaccctgtttcaacaaaaaaaatttttttttgaaattagcagaatgtagtggccatgccagccacatgcctgccatcccagctcctaggatgaggagaaaggatccttgagctcaggagttcaagcctgcagtgagcttgatggtgccactggactcaatgcctaggtgacagagtgaggcccagtatctcaaaaaaaaaaaaaaaaaagaaaaaccattctgagatataggccatacagaaacaggccggaatttgccttaccctgatttacaatgtctacggcaccttcatttccgttctgtcatcttgtgagatagatactatcatttccatgttctagcggaggaaactaaggcccagggaaggaagggactgggctgtgggaaaggggaaccaggagggagaagagggtaaaggaaggaggagcagtgggaggatttctagagccaaacttgtctcctttgaggtgctggggagggtggattttaacagctctgccctcacattgggtttgaggtggccagggagacgggtgagtgagcaaatgacttgcattcattatgtctttggtttctggccacctttggggctaggggaataaaagcttcattcctgagtcagtgagagcttcaatgaagcccagatgtcattcgtgctgaaagaaccagaacaactctctgctccctgccaagcatgaagcggttgtgaccccaggaaaccacagtgactttgactctggttcagctgacatgctcgagtctagccacaaattaccagaaagcagctgaggaaagtttagaatttctcctggcagagatggtccacgagtctggctccagggtgaaccccttcttcccagagcagcacggggccctttggaggctcgactccgccagccctcccactgccttccccctgccttccccaccctcacttcggttgagttttgccttcaaaatagcagactccaagccacctgaagggctgcagaacagcgttgttgacagcttcaagtcgccttgtggcttctctgagctgctgctgtgctttggaaacaaaattccaggctctccctctttctgtgtgtgggaaacaccggagagagtttggggagggagacaaaagggcccattgaaaacccagacaggcttgaactgtaagtcacaccggagagagggttgctgaggggaccctagagggaggcagtcccggagcacagctttgcttctttggctacttccttgctttggaggttgctttcttctcaaggtggaccacctgctagaacagggcagcactgctgttcactggccagcttggagagaagactgcccatgtgattctaagtcaggcccttgtgactgaaccaccatgaggctggactgtggggactcgggtatcccagaggcagagcacaccaggtctgggaggggggccactcagacggcaacattgtcattcaatatctattgaacacctactgtcttaatccatgtttgttgctaccacagaatatgtgagactgggttatttataaacaatggaaatgtatttctcaaagttctggaggctgggacatccaagatcaaggcaccagcagattcagtgtctgtctggtgagagcccagagtctgcttccaaggtggcaccttgttgctgcaccgttacatggcagaagagcaagagagagtgagaagggaccaaattcgcccttttataaaaaaacccattcttgagaaggacattagtccattcaagagggcagaaccctgctgttaaaattggtaactaaatttcaacatgagttttgagggggacaaacattcaaaccatagcaccgcctgtgtgttaaacacccacttaggtgctggggctgtaaaaagtaaatctaggcgtggccctggcacaggagggactccatttcatagagagaaaagaacacagacccttttgttttagggtgcttgctgccaaccgctctggagagacaggctgaagcaaaaacaccaaacatggagaagttatgacagttccccaaagtagtgacgaaggcacatctcaggcttgggaagtgtcctcggtgggtgccaggcctgcctttcccagcctcttctcggtgaagagatctctggctaagttctttaccttctctgagatttggaacatactgctgtttcacctaccaaagcaacttgcaccttttctattgtattaaatatttcagtttctccattgtatggaggcttccagcaattagtttacaagccaacttatttactattcagtaactttttttgatattgagattgttcctaattttgatcattttaaacaaaggtgtgaaaacaggccaaatcttttcattcactcatgaccatttcacaaagatagattcgtagaataagtattttcaaattccctttcagaaaagtagtacaatttaacactcacaagcagtgaatgtgaagccaattctccatacctttgccagcaagggtggccccaagaaccacacacagtaccccagctaaaggcaaaggtagcttttatcctggccatagcacactgctgatggtcaacaagacaccaagtcctgctcacagatgctaaacagagctttcttttttcttttcttttttttttcttttttttttttttttttgagatggagtcttgctctgttgcccaggctggagtgcagtggctcgatcttggctcactgcaagctccgcctcccgggttcacgccattctcctgcctcagcctcccgagtagctgggactacaggcgcccgccaccatgcctgggtaattttctttttttttgtatttttagtagagacggggtttcaccatgttagccaggatggtcttgatctcctgacgtcgtgatccgcccaccttggcctcccaaagtgctgggattacaggcgtgagccaccgcgcccggccacaagaactttcacagtttggtgattgaaacccacatataggaattcatattcatttcattaaatttaaccttggctgtgtgtggtgggtcacttgtaatctcagcactttgggaggctgaggcaggagaatcacttgaacccaggagttcagaccagcctgggcaacagagggagactctgtttctacagaaaaaaatttttatatcagccagccatagggcatgcctgtgatcccagctacttgggatgctgaggtgggaggatcgcttgggcctgggaggtcgagtctgcagtgaactgtgttcttgccactgtactgcagcttgggtgacagagcaagaccccatctcaaaaaatatatatatatatatcttctgattcagctcattttctgtgccttttgagatcttcttggacttttattctttcacccagtgtatttaatattactctctcccagctgttttatctgaaaactttatcaacctgtgctttatattttcattcaattcatttataaaaatgtcacatgagaaagggtcaagagtagagccctgggacatattgctgcctcctcattgacattgactgaggcagccgcaaatataccaaattgtattattgcttagtacatggctttatcaagagggatatcctattctggaccttgtgggctggtttagagagtgaggactcatctctggggctatgggagacataaggatcagcagagacagaggcaaagctggatttaagaagtcacagcaggcctctcccctagtatgagccttgctttgaacatatctgggaagggcttccttttagtcttgaaaatgtttacaagcctctgctcagcatctacctagccttcagacctcgcgttctcaggcctgtggtgctgtctcctctctgcttcagtatggtcttctctgtccagcttctgcatgaggccatctggggccaagggtcacaggttttagaagttcccctctccccgctccatgccataggcacctgcaatcgcacatcctggataaaacttcagccggccttctctttatgtgcctggcgcctctcttttctctgggtttttggaagtctgcctgcccagcccctcagctggggccttccccacttctgccccgccccactgggtcctcccagggtaggaggcaatctctgactgtcttccgaggctctgttgcttctccttcatcaccaaatgccaggaatttgtcagatgctgtttgtaactcaaaagaaagaaagaaaaagaaaaagatacaggaaggaaggaaggcagaaaaagagaaagaaagaatgcgtgcagcagatgttgggaaagttaatttcttcattattttgcatccatcccagttcggatctcagcatggggtagggaatcctctgttgtccccatctgtcgaggcaacagtgagtcccatcatggagtcccttcttttcctctctcctcccagagtgccccttcctcatcaaggtgcttctacccttaggagtgtacatttcacctataaccactgcctattttttcctagtgatatgttatgctattgatttttaattatataaactatatgcaaatgcagcctccttgtaaaaaaattaaaatattatagatataacccagcacttcttctcccagttcctttccacactcccagaggtaatcatgataatcagtttgctaggtgtccttccagaacttttagcttctttctttggcttgtatatggccaccttctcactgcatcctcccgtggcctaccctctgcatgcatctggatcctaattccctcttcttataaagacacccattgtactggagtagtcatactggatgacagccatattgcattaatctcattttaacttaattacctctttaaagaccctatctccaaatacagtcaccttctgtgtactgggggttaggacttcaacatgaatttttggggggacacaattcacatttcagggcagagggaggaggctcaactgccagtgagtgggaggccaagcccatgcctgtccctcctggaagtgtgccctgattgcaggtagggtcaggccccaaagccaagaaactgtctccaaactgatttgacaagtggctgactagttctcttctcccgcaaatcccaaggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggagtaagcgctgcactgtggagaccctgctgagctgggggttaggggaaggaaatgtgtgtgtgtgtgtgtgtgtgtgtgtgtgtgtgtgtgtgtgtgtgtgtctgtgcgtgtgtgtgtgtgtgtgtctgtgcatgcacatgcgtgtgtgcacgccaggtgtagggagttcttttctgattaactgatagagcaggaccctttaaatagaaatatccagggccaaaaccaacatacatcaggcacacaatgacactactatgtctggcttacatttggggggttgccaggtttggaaaagttaatttatatgggattgaacaagcctcttgcctttaagaaatttacactttgtgaagaaatacacataactaaccagagatcatgggctgtaatagaggtaaaatatttcacaggaagggaaaagtatcacagaaaaagtaatatctgagaataagaaggatttcagcaggtggagagaatagcaaagatttggagatctaagcaggcacaggggacttgaggaggatgcatacaagtcgtgtgtgtgtgtgtgtgtgtgtctgtgtgtgtgtgtgtgtgtgtctgtgtgtagtaggatgaggggaagaagtgtatgggaggggcttgttttatctcagaaaacatcgttgtctgaagagaaagaagaaaggccaccacacaagaaatcctccaccttctcttcctgacaccttcatactcactggcatctgctccatcctgtctcctgctatcctgtttctgggggaagaaaggctgtttttcccatccttatccttcttcagagaccttccagtgcctgaatccctctgtgtggagccctcagccattcatttctcttttcttctttttgcattgcagggtgtgatggtgggaatgggccagaaagacagctatgtgggggatgaggctcagagcaagcgagggatcctaactctcaaataccccattgaacacggcatcatcaccaactgggatgacatggagaaggtatctgtagacttccccttaatgagcctgctttaatgatcacccatcatcatgaccctcgtattcataggccactgtgctctgtcaactctccctctaaaatgcttctcacttctgtctttcctttcttttcagccccacgaccatttctccaacctaggctgccaacatctctccctggactattgcaatggcttcctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatcatcttttcctgcaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggggagcgggatttttaaatggtggagctcatggtaaacaaaattatgtgtgcaaaatgttaatagagcctttctaatattcttgtgattaactctggtgacagttggctgagtgttcttgtttctgcaacgcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagtggagtgggtaagagcacagacattagaggcaatggcaggaaatccaggtgcaaatcccaccctataagtcttagttttcccatttgtaaagtgaagataaaaaacactttgtgcattaggttgctttgaagattgaattagctaaatgcttagtataatcccaaggcatggaacatacttatgtgctcaataagtgacacatatgattcatatatatgtaacagtatctaatttaaaaacataataggccgggcgtggtggcttatgcctgtaatcccagcactttgggagaccgaggcgggtggatcacaaaatcaggagcttgagaccaacctggccaacatgatgaaaccccgtctctactaaaaatacaaaaattagctggacatggtggcgggtgcctgtaatcccagctactcgggaggctgcggcaggagaatcgcttgaacccgggaggcagaggttgcagtgagccgagattgtgccactgcactccactgtgggtgacagagtgagactccgtctcaaaaaaaaaaaaaaaaaaaacaaaaaaaaaaccacataatagaggccagtggctcatgcctgtaatcccaacactttgggaagccaaggcaggaggatagcttgaggccagcctgggcaacatggtgataccctatctctatgaaataaaaatgtaaaaattcactgggcatggtaacacatgactgcggtctcagctattcaggaggctgaggcatgagaatcacttgagcccaggtggtggaggctgcagtgagctgtgttcacgccactgcactccagcctgggtgatagagtgagaccatgtctcaaaaaaaaaaaaaaaaaaaaaaaagaaaggaaggaaggaagaaaacataatagacaaataatagacaaactattttattcacagtagtgacaacatgtgaactctttaaagaaacccttaaaaataaattatgtgccttaaggccgggcacagtggctcatacctgtaatcccagcactttgggaggctgaggcaggtggatcacttgagtccagcctggccaaccaacatggtgaaatcctgtctctactaaacaataattagctggatgtggtggttagcacctgtcgtcccagctactccagaggctgaggcaggagaatcacttaaacttgggaggtggaggtttcagtgagccaagatcgcatcactgcactccagcctgggcaacagagtgagaccctatatatatttttttttaaaaatgtatatatgtataaatataaaatcatttcattatataatcatttcattatatatctataaatcattgtgtgtgtgtgtgtgtgtgtgtgtgtgtgtgtgtgtgtatatatatatatatatatatatatatatatatatataatcttgtgtgccttaaaagaaaaaccaaattgggtaaaagtgtcaaatgtcctcaaattaatttataggctcattgcattccaataaaaattatgtgacataattctaaagtatgtttgcagaaataaataagcaacaattatgagaacaaaatgaatttttttaattatgaaggaagacataatgtaataaaatacaatataaattataaagttaaaacaatttgataccagcaaaaaggtaaagaggaaatatataataaatgaaacttccagcatcagaaaggaggaaaggactagtcaataaattatttctgggacaactgattagttatttttggagctagagaatcttggtttatagccctaagctcataccatttcaccaaacacatgtcaattaaatataaaagttaaatgtaaacatttaaattaccaaaaatataatacagttaatgtgagcatttaatcaaatttctggtaagagtggtcatagagaaaaagaatgacaaatttgacttcttaaaaaatcgtaacttttaatatctcaaaaataaccaaatttaaaagccaaataacaaattgcaaaacaaaagggcaatgagggattaatatgaacagttaatgcaaattgacaattaaaaatatgaagtgtcccccagacaaataaaaaacagttaattagctgaacagaaattatgaaaagttgcaaatgtgaaaaaatttaaactcatttgaaacaaaaaaattgaagtaaaataactaggtatgatttttacctatcaaattatttcatattttaagagtgagagcactgaattcagttaagaatggggtaaaacagccacttttttattctgaagtaaagattggtttagcctatttgttaataacagaaatcagaaagtcttccaattgctatgttctttagcccagtcattccacttttagaatcttcttctttggaaaacatcctgaatacaaaaaataaattgcaatatgcacaaagataactatcataggattatttataaccaaaaatcaaagacaccatgaatagtaatgtgattaaatatatgatagtatatgataaaatgttatataagcattttcaaaagtttaagtttatcaaaaataaatatttattatgaaaagtaaaataatttgttataaaaacaaatttgaacatagtataataatataataaataaaagaatatgaaataaataatgatagtaataaatttaaaaatacataaagacaaaggttaggaaaaagaaaaaagccaaaatgttaactgtttgttgttaggtgatggacataggggagatttttattccattaaaaaaaattttggccgggcgcggtggctcacgcctgtaatcccagcactttgggaggcggaggcgggtggatcacgaggtcaggagattgagaccatcctggctaacacggtgaaaccacatctctactaaaaatacaaaaaattagccaggtgtggtggtgggcacccgtagtcccagctactcgggaggctgacgcaggagaatgccgtgaacccgggaggcggagcttgcagtgagccgagatggcgccactgtactccagcctgggcgacagagcaagactccatctcaaaataaaaaataaaaaataaataaataaataaatacataaaaattttgagctaggatcttcctctgtcgcccaggccggagtgcagtggtgcagtcataactcactgtggtcttggcctcctgggctcaaggaatcctcttgcctctgtctccggtgtagctgggaacagaggtgcacaccacatccagttgattttttaattttttgtagagacagggtctcactttgttacccaggctggtctccaacccctgggctcaagcaatctgcctgtctcagctccccaaagtgctgggattacaggcataagtcaccacactcgaccttaaaaatatttttctaactttaaaaattatcaacatctttaacttttaaggtataaaaactccaaaaaagaaaccaaaatcaagtgcagatgcttgagcccaacacccaaggattctggttcagtgggtcagatgatcccaggtgactctgagacagggccttgaggaagcacattttaagtagcatggggtcccctccttaagaccagttgctgtccttcaggctcctgtgcaatgctcacagtccagggcctctgcctgtgccattccctctgcctcggatgccttttgcagcagcctctggagaccttcttttgccctcaaggcccatttaaatccctcagataatgaattactcctacctcttctttcacttaaaatgtggcttgtgtttttctttttgtttgttttggtcttttttaaacgtctctctcccctctggactttgcaactgagaatagggtgccatgtctgattcatatctgccctcatcacacttaccaccgtcttagcacaaacctggcggtccataaatacatgggtccaatggcatcaaatgaccctgtgcctcacctctgaggaaaccaaagccccatgtccctgctacactttgcccaatccctctgaaagactcctttttggtcgtacttgatcactgaagaaggaactggacacaggaagaaattaacttcctctaaaacagtggttcttttttatttttgagacagggttttgctctgttgcccaggctggagtgcagtgccatgatcacagctcactgcagccttgacctcctgggctcaagcgatcctcctgccccagcctcctgagtagctgagattacaggcaggcgctaccatgcctggctaattttttatctttttgtagagacaggcccacagtgtgttgcccaggctaagcggtggttcttaaccaggatgattttgcttcccaaaggacatttggcaatgtctgcagacattttttattgtcacaactggaaaactgctgctagcatccagtgggtggagaccagggatactggtcggccctccacaacaaagaattatccaacctaaaatgtcatagagctgcgattgagaaaccctgctttaaagcaccagcctggccaataatagccagtgaaaattgagcccaagtgcctctgtcagattctcagcaggagatagtgtacactcagctgcggttttgaaattgtttgacagtgtatactcagctggggttttacaactggttaaatgaatgtcctacagaaatgtgcatagggttaaggcaactacaaagggatgtcgaggcacccaagagccagcaacagagggagctctcacacccctaaacatgaaggggtcaggtgacgagggcagtgtcattggagcttagtgagagcttgagctctgaaagaggggctgcccaacaggaactgtgctcatggagggccacgccattgtcaggagatagaccctgacttcttttgccctcctactttccagcctcttgcaggaatcttctatcagccaaatatagccagaagccagaaagcaatgaacacttgagtgatacaatgtgccttgcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcctctccagatccatcccatcctgtgtaacatggtgccacactctcccagcatgggaatgtcaatgagaattttccagccattgggagtctgccaggctcatatggcttttgtctccactagatctggcaccactccttctacaatgagctgcgtgtagcacctgaagagcaccccaccctgctcacagaggctcccctaaatcccaaggccaacagggaaaagatgacccaggtaagaagccaggaagacttgaacactggcataagaatgcaacatggatgcttggccagatactttctccccttcaaacatcagtgcaacagaactctctgaggacctgctatgtctgtggtccatgccaggccctgggggagtgggtgtggaataatgaactatcaaactggcatagttcctgcccttaatgagattacaaaccattctacaggccaagaagtgctgtgatttttgccaaataatcttttattcttcattgtcctttaagatcatgtttgaaaccttcaatgtccctgccatgtacgtcgccattcaagctgtgctctccctctatgcctctggccgcacgacaggtgagtaatcctgtaatccattccttttctgacttcaggggaggtagggaaaagctggggtctggcagaggctcctgctcagaagaatcaaatggacagctgaagtccaggcaaaatctttcttagggataataggtgagaatgcccatgtggaatgccagatgtgagcctagctggtatagttggaaaaaacatccagcaagaactgtttccctcacagtaataattccaggagcttctacacatacacacattccaacaatactggaatgtttctgcttcatgaagcagaaagagtagaacctgtggtggtggaaatgtaagtgcagttacacattgcttaatgacagggatacgttccgagaaatgtgtgtcattaggtgactttgtcactgtgggaacatcagagagtgtacttgcacaaacctagacgctgtagcctactacatgccccggctgtatggcgtggcctattgcttccaggctacagacagtatagcatttaactataattaatactgtagggaactgtaacagaatggttaggtatttgtatagctaaacatattgaaacatagaaaagttacagtgaaaatataatatcaaagataaaaaatggtacacctgtgtagggcacttacatgaatggagcttgcaagactagaagttgctctgggtgggttagtgagtgagtagtgagaaaatgtgaagacctaaaatgttactgtgtactactgtagactataaacactgtacacatcggctgtactacatttataaaaatattattcttggccaggcacagtggctcacacctgaaatcccagcactttgtgaggctgaggtgggcggatcacctgaggtcaggagttccagaccagcctggccaacacggtgaaaccccgtctctactaaaaatacaaaaattagttggacgtggtgtcaggcacctgtaatcccagctacttgggaggctgaggcagaagagtcacttgaacctgggaggcagaggttgcagtgagccaagatcacgccactgccctccagcctgtgtgacagagcgagactccgtctcaaaaaatatgtatatatatatattattctttcttcaataataaattaaccttagcttactgtaatgttttttaccttataaactttttaatttttaaagccatttttactttttttgtagtgacagtaatagaaaaacatcttttttcgacttttttttttttttttttttgagacggagccttgctctgtcaccaggctggagtgcagtagcgtgatctcggctcattgcaacctctgtctcccacgttcaaacgattctcctgcctcagcctcccatgacttttttttttttttttttttgagatgaagtctcactctgtcacccaggctggagtgcagtagtgcgatctcagctcactgcaacctccgcctcctaggttcaagtgattctcatgcctcaaactcccaagtagctgggactacaggagcgtgccaccatgcctggcttatttttgtctttatttagtagagaaaaaaaaggagtacaccctttaaatgtcgatcagaaatttccagggctgaccattctcctctccagatccatctcatgttggccaggctggtctcgaactcctgatctcaagtgatctgcccacctcagcctcccaaagtactgggattacaggtgtgatcatcacccccagccaaaaatagtttcatttatatcctttattctacaagcttttttctattaaatttattttattttattttttacttttagagcttttttgataaaaactaaaatatacacattagcctcggcctacacaggttcaggatcatcaataccactgtatttcatctccacatcttggcccactggaaggtcttcagggttaataacatgcatggagctgtcatctcctatgataacaatacctccttctggaatatctccggaaggacctgcctaaggctgttttacagtcaactttttatttaataagtagaaggagtacactttaaaataatgattaaaaacatagtataagagctgggtgcagtggcttatgcctgtaatcccagcactttgggaggccgaggtgggtggatctctttgagctcaggagttcaagaccagcctgggcaacatggctacaacctatctctacaaaaaatacaaaaagttagccgggcattggtagctcacgcctgtagtcccagctactcggtaggctgaagctggagaattgctggagcccaggaggcagaggctgcagtgagctgagatctcaccactgcactccagcctgggtgacactcaaaaaaaaaataaaaaaataaaagacagtataagaaatacataagccagtactagtaccatagttgtttattatcattttcaagtatgttgtacataatgtatgtgctgtacttttatacagctggcagcacagtaggtttgtttacaccagcatcaccacaaacacgtgaataaagcgttgccctatgacgtgatgtcagctatgatgtcactaggcaataagaatttttcagcttccttataatattatggcaccaccattgtgtatgtggtccgaagttgaccaaaatgtcattatgtggacatgactatatgtggccttggtatagaagtgtgctcagcgtaacagaggaaatctcaaaataaaatggtctttaataggaacttgacagcttccataaacatttgtttaaacgttcattaatcatttattcactgatttatccattcattcatccatcatatattttccattactccctacaatgtgccaaacatggtaccaggccatgggcacacactgacaaataagacagactttgtcattatggagctaacagtttagtgggagatagacaaaagtaaaagataatttcactgcatgtgataaggacaatgatggagaaatgcatggcatatacagtgtcgtatcctgtgctttgcactttggtttttgtttttgttttcattttgagatgcagtttcgctctgttgccaagactggaatgcaatgatgtgatctcagcacaccacaacctccacctcccgggttcaagcgattctcctgcctcagtctcccgaatagctggaattacatgcacctgcctctgcacccggctaatttttgtatttttagtagcaatggggtttcaccatgttggccagctggtcttgaactcctgacctcaagtgatctgccccccttggcctcccaaagtgctggcattacaggcatgagccaccgcgcccaaccttgcacttcgttgcaaacatcatgtttaatagccacgtggtagtcgttgtatgatggtttcattatgtatttattttaccatttctctattgctggagctttaggttgcctctcatttttattatacaatatgccatgattcaggtccttacacaagagtaagttgctgctttctggacatttattttgcatctggcccttactgaaccatctaactaggtctaatggtttcttaattgattctgttgggtcttctgtataaaaccacattatctgcaaataatgacaattttggtagtcacacctcctatttctattttctgtttcactgcaattggctagaacatcctggacaatattaaaaaatggtggtgatattgtaatgttttctcatccgttatgatgtggctgttagattaagaaatatgaggctggacgcagtggcacatgcctgtaatcccagcactttgggaggccgaggcaggtgaattgcctgaggtcaggagttcaagaccagcctggccaacatagtgaaaccccacatctactaaaaatacaaaaaattagccgggcgtggtggcaggcacctgtaatcccagctactcaggaggctgaggcaggagaatcacttgaacgtaggagacagaggtttcagtgagccgagatcatgccattgcactccagcctgggcaacaagagcaaaactctgtctccaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacatacataaaaaataaaaaatatgattgatgattcttgtgatgggtgaatattcttaactggtaaaggaaaatatggtagtcagagctcattggtaacagtcctagaaagagactgatgaaaggcaagaatgagaattttataagcctgatcctctctgtccacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacaggtatccagccccttttctgattctgactggagctcagaaccaatctggtttaggacaagaagttctcaggaccaatgagaattctgtgactctgtgtctttaaactctcctgagatagactgagaggccttaagctggggctaggcctctggataagaccagatagtcatggaagcagtccctccttccccagagaccagctgcctctgtccacgtccacaccaggactagggctagtttccacaggctgaatggtagtgaagatctgctgatgcatttcattacctaggggcacctttggtttgaggacaaattgaataagtgaggcccgaatttctaaggggaaggtgtcatgtggcccacctgggcaatcggcattttttaggtgggagcctctctaggttctgtaagatcaaacatctgagtctagaccagaaatatgtcctgcaaagcccccaggaaggcctaaggctttgtcagaaatctcatgcaaagtcctgcatgggaatcaagacttgagactccctctttagaaagaggagtggaagaattaagattgaatggagtgacgcttgaccctcttcgcggcaagtctatcatcatcctatgactgaacctaaagtagacgtgaggccaggcgtggtggctcacgcctgtaatcccagtactttgggaggccaagcaggcagatcacttgaggtcaggagttctagaccagcctggccaacatggtgaaatcctgtctctactgaaaacacaaaaattagccgagcttagtggcgcacgcctgtaattccagctacttgggaggctgaggcaggagaattgcttgaactcaggaggtagaggttgcagtgagccaagatagcaccactgcacttcagtctgggtgacagagtgagactctgtctcaaaaaaaaaaaaaaaaaaagaataaagtagatgtgagaaggaggttttcatggagatcaaaatgggacaaccaaactatcagagctcagtattcaccttctgtcatttctgctccttccagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggtgaggtgctgcccacagtccctgccaatctcaggaggggagggtggaggagtgggtgaggtatggagagagaaacaccaggagtcatggccactttgttaattacatacacgtacctcacattttcctaggaagggccaaaaatgtattttaaaaaaaattagggaaaaatctcattttaaataaaagggaaaggaaatcaagatacaggaaaagcagaacaggaaatataacatgaaacttaagaatgaggttaaaacacagaaagtttgtaggcagcaatgtagcaaggtcaggttgtagtttagcaagattcttctatctacagtgtggaatcatattgcatggataaaagaccggaggcttggccaggcgcggtggctcacgcctgtaatcccagcactttgggaggctgaggcaggcagatcacttgagcctgtgagtttgagaccagactgggcaacatagcgaaaccccatctctatgaaaaatacaaaatttagcagggcatggtggtgcatgcccatggtcccagatactcaggaggctgaggtgggagaatcgcttgagccgcagagatcaaggctgcagtgagccgtgattgtgtcactgcactccagcctgggcaacagggtgagattctgtctcaaaaaaaaaaaaaaaaaagagtagaggtaagtagaccaggcagatggcaagagccagtttggcgtgcaggaccttttgctctagaagactgtgatgccaggctacagtagctggatgtcaacctgcaggcaatgggtgactgtcagatgacatgacgagtatatccatacaatggaatcttatttggcaataaaagggaatgaagtattgatccatgctgtgaccttgaaaacattatactaagtgaaaggagccacacacagaagaccatatggtgtatgattccattgacaagaaacatccagaataggcaaacctctaaagacagaaagtggattcactgttacctagggctggggcagggatggaggggaaaatggggagtgaccgctattaggtatgggggtctcttttgaaggtatttaaaatgttctaaaattagattttggtgatgtttgcttctgtggatatactgaaaatgactgaattatatctcaaaaagttatgaaaaaagaaagatgatataacaaaagtgttcctttagaaatatgcttcaggcaacagtataaaagatcaggccgggtgtaatacctcgcgcctgtaatcccagcactttgggaggccgagatgagtggatcacaaggtcaggagatggagaccatcctggtcaacatggtgaaaccccatctctactaaaaatacaaaatttagctgggcgtggtggcatgtgcttgtaatcccagctactcgggaggctgagacatgagaatcacttgaaccagggatcagaggttgcagtgagctgagatcgcgccactgcactccagcctggtgacagagcagactccatctcagaaaaaaaaaaaaaaaagatcaatcagaactggggacaataaaggaaaggccatgacaaggaagggggtatgatcttataatccttctgggagatattaaggttctgaactagggtagttgcaacaatcgaagaagggtcatttgaggagctggaggtgtgcatatttaggaagtgatgcctgttgaccagacactgtgatctccactaggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaaggtgggtcttgcctcagttgtctccatcctgttctttgtataaagtcttgcctacctgggagttcctcggaggcagactgccagacctgataacttgctggtctcctgggttcaatatcatcctggactggagccaattttatcctacggaattatgttccttgggcattgatgggctgaagacccacttagcatggatctcaaacataatcccaggaatgtcacatgagaagaggctgaaagaatttgggatgatgagaatattatccaggtgtaatggctcatacctgtaatcccagcattttggaaagccaaggtgggaggatcacttgagcccaggagttgaaggccacaatgagctctaactgtgccactgcactccagcctgtctctaaatataaattcagatagatcctgtctctaaaaataaataaataaataaatagaatattgagagggttaagaaggaaatcaggagatgggaaatagaaggaaagaaaagaaggaggtcacactatggtatctttaaactttattgctccgaaggagggtaaaagttccaaagagtggatgtttggtcatagggccagctctgcttcaaactcaacagggacattccttgattcctgaacatctctgatctactgtcccatcttggccatgcccttccccatactgcctcccaacagggcctctcgcctcctgggcatctgcaggatgggagcttctcttctgcctctggtctccaagcagtcacacagacatttttagctccttctaggaactttgctgctaacagctttagagaaagagttgggaatagaaatatcacattggttgaaagttacaaagtctcacaataaagctggtctctggggagtaggcctgatgtaaggaaatgtgttctcagtcaatattctaagaaccttcatgaaggaaggctgccccgggccttccccctgcctaacagatggtgttcatcacagagaaatggagcaaaccagcaggaaactggtgagaacctgtgggctcttctcacccagagccacaggaatggtgcattactgaggcctgtcctgtggagagctgtgccaggcctggggcaggggctttttaccaggactgtgtgtcagtataccacgcctagcctcactcccagattctggtccaacaagtctgaattgctcccccatcacctacactgataaacaaccaccagtgatctgatgcatttcccaattcatgagccacagctctgacttaaacagtacgtgccagccttcatggagtttaggatctaattagtaaacattatcaataccaggacaatctaaataaaagcggaagggaaaggacactctaagcagaggaaatagaaggagcaaatgtgtccaggcaggtgtgtgcttatatgagcacctatccaaattggacagcaggatttgttataggggaactgggggagatgaggcaagtctcaaggacacagaagaacagatttggggtgggggtagggcttatatttaggaccaccaacctaagagaagccagagttttctcatgagaagtgtccaacaataaaatttgttaccttgctagtggctgtgcattcccagtccttgaaataatctgttcaaggagcatttgtgtgacttttgtctgcctggataataaaataacttctaaagatccttcttattctacaattccatgatctctgtgatttagggaatatgtaaagagattctacggcaacaaaaaaaatcaatttattatctggtttgctctagcactgaattcttagacccttccaaaactggaaaactagttgaagaatcatagtccttctggatcccctttgaagtagagttcaaagttgtttgacctgacaatcaatttctaaaagctaagcccaggattcctagtggaaagcatgaacaatgtagatataaatttgaggacttctgagatataattggctgatgacagatagctcaaaacagggtttgggtagactggtttatactcaggcatggaggaagcccagcccaacctgcccatgcttccaaactccaggcaagaacagaacaaggttccccttatagatatttgtattggtcagctattgccaagtaacaaacaaccgtggaatctcaggggcacctaacaatgagcatttattactcgtgcatctgcgcatcacctggaagttagctgatcaaggtcaggcttggctaagtaagtggctctgaattaactgcaggtccagccagctcaggtcaagtccatatttctcattaatgggcccaggctgaagggctagctgcttcccaggggcagctcttctcatgcacatggcagagcaagagaacatgcccaagtacacaagcatatttcaagcccctgtttgtgttatgtctgctaatatcccattggtcaaagcaaacacaatgcccagccttacagggagcagtgcactcttcccatggaaggaataagggaagaggggggaagtgaaggttttgagcaataatctaatctatcacaatgtttctcctgttcttttctgaccatggggctccccttttctgggataagtagatttttggaccaccttgcttattcccttggggactgatcatgattcaccacatttgttctttgcagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctt

SEQ ID NO: 36132 - DNA, 15616 bp, Homo sapiens
ggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggtaaagcagctccctggctgctctgatgccagggacggcgggagaggctcccctgggctggggggacaggggagaggcaggggcactccagggagcagaaaagaggggtgcaagggagaggaaatgcggagacagcagcccctgcaatttgggcaaaagggtgagtggatgagagagggcagagggagctggggggacaaggccgaaggccaggacccagtgatccccaaatcccactgcaccgacggaagaggctggaaaggcttttgaatgaagtgagtgggaaacagcggaggggcggtcatggggaggaaaggggagctaagctgctgggtcgggtctgagcagcaccccaagactggagcccgaggcaaggaggctcacgggagctgcttccaccaagggcagtcaggaaggcggccgccctgcagcccagccctggcccctgctccctcggctccctgctactttttcaaaatcagctggtgctgactgttaaggcaatttcccagcaccaccaaaccgctggcctcggcgccctggctgagggctgggatggaggacagctgggtccttctagccagcccccacccactctctttggctacgtgagtcaaggctgggcgaccaatgaggttgtggcctccggcaaacaatgaccactatttaggccggcaggtgtatagggcatgggggcccagctgccagtgctggagacaagggccgtccgagatgaaccctttctgctgcctgccaagccactgggaggggtaggtctcagcaggattcccagaaaccccgcccctgtccagcctaggccccccacccggtgttagctaacccaacgttagcccccaggttccgtggggttggagggcagggagtcctattcttggggctgctgcttctggggtgtggggaagtgcaactccacggcaccctgggctgactcattcagcttctaaagcttcaggaaacattgtttggggctgggtcaccatgggtgggccagagaggacccctcaatcccctccggagagccaggggagggggaggtgcccttccccatgctatctccgaggcccactgccatgtggctgaaggctgtgcggttctgggaagagggggaggtggcggtggaggctgtttgtctcctaactgggcttaatctgaaacacatgtattggcttgagttgatccgcctcacgtggaggcaagatcacaaaagcttctgtgtttcttgatgtgggcaattgtcagaaaataaggcctgaccttggcccagcagggagggtatctacctctccctgagccctcccccgcctgctaggacgagagcggggcttggatactgccctttggacaggatggcatcattgtctgtggctgcagccagccagcggtcgcctgctcagcccatgagcaaccactgtggacagggtattgcgtgtgtgctgaggggcgtccatgcagacccccacgcttgccctctcactgcccttgtagggttttcaatcatctctcctcttcccttatccagatggcttgaagtggaggattcagacttgccgttaatactctgggtccctgtgtctagctcggggccacctttggacccatgtcccttccctgccaggctccctcacctcacctcagcctacccacattgtgacaatcatctaccacctgatctggggtttgggcttagattctgtaggcaccaagactaaagtcgctccttcaagtccatttgaattgtgactttagtttccttaaatactatgccaggataatggccagggatggtggctcacgcctgtactcctggcactttgggatgctggtggatcacctgagatcaggattccaggccagcctggccaacacggtgaaaccccatctctactaaaacataaaaattaaccaggtgtggtggcgggcacctgtaatcccagctactcaggagactgaggcaggagaattgcttgaacccgggaggtggaagttgcactgagctgagatcgcgccactgcactttagcctgggcgacaagagtgaaactctgtctcaaaaacaaaaaaaactatgccgggatgagcctgtctcctcccttaatttcttacttgggccagaggaactagaactaacaacttctcttctagccttgcctcctgtgtacctcactgaatttttggtctctaataaaccagtctgcagaggctcaggggaggcaggctcctggcagctgggtggggctggccccagccgggtggagaccagctgtaggcctggatggtggtgaggcctctgtcttgcgctgcagaaagcttttcctgttgtctacacgaaagttttctccctgcatgtcagggcagccacgtgcaagagcagctggctgggaacgcagaggtctgcggctcgaggcggggtttagaaagaaaaccaggctgcttcctgctgcccgtcctgccttaagctgagtaaactcaaaggcaatcttctttcatgcctcacgatattgtccagtggattatctgatttaatttgaaggacgagagccaacaatcacacaacgtcctcccaaattttctgatccactttgttctgggaagtcaaaaagtgtgtgtgctgtgtgggtggatgtttgtgtatataaatggataatgaaggatgatgtgttgggggccagggcaggggagacaacgctgttcagattctacatttttttttccttttttttttttttttgagatggagtcttgctctgttgcccagcctggagtgcagtggcgcgatctcagctcactgcaacctccacttcctggattcaagtgattctcctgccttagcctcccaagtagctgggattacaggcatgcgccaccacacccggctaatttttgtatttttagtagagatggggtttctccatgttggccaggatggtctcaaactcctgacctcaggtgatctacccgcctcggcctctcaaagtgctgggattacaggtttgagccactgcgcctggcctttttttttttttttgagatggagttttcactcttgttgcccaggctggagtgcagtggtgcgatcttggctcactgcaacctccacctcccaagttcaagtgattctccagccttagccctccaagtagctgggactacaggtgtgtgccaccatgcctggctattttattttattttattttatttatttatttttgagactaagtcttgctctgttgcccaggctggagtgcagtggcataatcggctcactgcaacctctgcctcccaggttcaagtgattctcctgcctcagcctcctgagtaactgggattacaggggcctgccaccacgcctggctactttttgtatttttagtatagatggggtttcaccatgttggccaggctggtctcgaactcctgacctcaggctatccgcctgcctcagcctcccaaagtgctgggattacaggcatgagccactgtgctcggtagttgttttattttaatagtaggttattttatttccattttacaagagaaaaaatggtgatttaaagagctactaagacacagcactgagaccatgtgtgatggcatgcgcctgcagtcccagctactcacgaggctgaggcaggaggatcacatgaggtcaggagttccaggctgtggagtgctatggttgtgtagtgaatagccactacactccagcctgggcagcacagcaagatcttgtctcccaaaaaaaaaaaaaaaaaaaaatttcaaatgtgaacccaggatctctgaccctaggccctgcactcctaaccatgggaggaagagctcttgaaagggaactgtgggagaagggaatgagctgccttgtgaggccacagaagtccaaagacagcttgagaatttggagggacagcacgtgccggactgggtgcctctatgcttggtatccggtgattccatggaggagacctgggttctgccccattctcctgggaggggttgcccaaagtcttatcaccggagtgggtcagctgcctccaggacaaagctttagcatacacttgtgctgggccatactccacgtggagaagccctgctggggctggggccccactgctctggatctttaaaagctattggttcaggggccaggtgtaatggctcacacctataaccctagcactttgggaggctgaagcaggtggatagcctgaggtcaggagtttgagacaagcctgatgaacgtggtgaaaccccatcgctattaaaatacaaaaaattagccgggcatggtggcaggtgcctgtaattccagctacttgggaggctgaggcgggagaatcgcttgaacccaggaggcggaggttgcagtgagccaagatcgctccactgtactccagcctgggcgacagagccagactctgtttcaaaaaataaaatataaataaataaataaataaataaataaataaaagctttaggcttaaaggagggtcccctgacgcagacagtggaacaaaagcacaagcttatggtatgactgtgggccctgaggcagggggaggggcgggagaaccttgctgggagggatgggccatcaagctgagggtccacttctgggggcctggaggggtgaggggtggtcgctgcagggggtgggggaaagtgactagccctgcccaacccctgggtcctggctggggtggccaggaaggggtagcggggcagtgcagtgtcgggggagagcggcttgctgcctcgttcttttcttgcaggccccaggatgcaggccctggtgctactcctctgcattggagccctcctcgggcacagcagctgccagaaccctgccagccccccggaggaggtcagtaggcaggcggggagggcgtggtcagcattccccgcccctccttggcaggcagcacgggaaacaggacagggaacccggacccaggttccaggccaggcttgggcctttatttctctagggctggagtttctccagcagcaaaacagagagaaaatgtcttgccttgcctttcaggggatggagtagggacatgaataagatcccaaaagagtaaaaatctgaagcacttttaacaagtccagggcaattctcctgcctcagcttcccaagcagctgggattacaggcatgcaccaccaagcccggctcattttgtatttttagtagagacggggtttctccatgttggtcaggctggtctcgaactcccgacctcaagtgattctcctgcctcggcctcccaaagtgccgggatgacaggtgtgagccaccgcacctggccaggatcttttctcattaccttgtcttcctagtgggggctccactgagcaggtcatgttcccggacatttgttcggatactgaccaggctgtggcagggagtgagggtatggagtgacctctctcctgcccagaaagggcgcagctgggttcccaaggcagatacaggcacatggagggaagcctgggccatatgagtgttatggggtgagtgttggcggaggcccacccttgagggacaagagcagctgggcatcttggcgagagccctggactttcgtgaggtcagagtatgaattctgcgtctccctcttcctagctttgtgaccctagacaacccttacctcagtctttgcttccttgcctatgaaatgggataaaaacacccattctacagggccatgtggccactcatttatttctcatctaccaaacacctactcgacaggggctggcaatgggcggaaataaaaactcagttctgccgggtgcggtggctcacacctgtaatcccagcagtgtgggaggcggagcaggatgatcccttgaatccaggagtttgagaccagcataggcaacatagtgagacccctgtctctacaaaaaagcaaaaattaccaggcgtggtggcaagtgcttgtggtactacctacttgggaagctgaggtgggaggatcacttgagcccaggagattaagactgcagtgaggggccgggcgcggtggctcacgcctgtaatcccagcactttgggaggcggaggtgggtggatcacgaggtcaggagatcgagaccatcctggctaacatggtgaaaccccgtctctactaaaaatacaaaaaattagctgggtgtggtggggggcgcctgtagtcccagctactcgggaggctgaggcaggagaatggcgtgaacccgggaggtggaggttgcagtgagctgagctcgcaccactgcactccagcctgggcgacagagtgagactccgtctcaaaaaaaaaaaaaaaagaaagaaagaaaaactgagttcttttttttaactttctttttttagagacagagtctcactccatcacccatgctggagtacagtggtgcgatcttggctcactgcaatcttggcctcctgagttcaaccaattctcatgcctcagcctcccaaatagctgggaccacaggcacgttccaccacgcccagctaattttttgggtatttttagtagagatggggcctcaccatgttgctcaggttggtctgaaactcctgagctcaagtgatccatcttcctcggcctgccaaagtgctgggattataggcataagccactgcacctggctcccaatttttatatttatatttatttttatttacttatttattttttgagacagggtctcactctgtcacccaggctggagtacagtggcactatctcagctcattgcaacctctgcctcctgggttcaagcgaatctcgtgcctcagcctcctgagtagctgggattacaggcatgcaccaccatgccccgttaatttttttgtatttttagtagagacgggtttcaccgtgttgcccaggatggtctcgaactcctgacctcaagtgattcacccacctcagcctcccaaagtgctgggattataggtgtgagccactcggctgatggtttttaaaaagtgggtcatggggctgggcgcggtggctcatgcctgtaatcccagcactttggtagaccgaggcgggtggatcacaaggtcaggagatcgagaccatcctgcctaacacggtgaaaccccgtctctactaaaaatacaaaaaattacccaggcatggtggtgggcgcctgtagtcccagctactcgggaggctgaggcaggagaatggcgtgaacccgggaggcggagcttgcagtgagccgagatcacgccaccgtactccagcctgagcgacagagcgagactccgtctcaaaaaaaaaaaaaaaagtgggtcataggtttcggcttataggtcacaagtgtttaaacctggccatgaggccaggcgcagtggcgcatgcctgtaatcccagccatttgggaggctaaggcaggaaaatcgcttgaaccggggaggtggaggttgcagtgagctgagatcgcgccactgaactctagcctgggtgacacagtaagactctgtctcaaataaaaaaaaaacagctgatctctcttctgcgctgtctctccacagagagctcatgcgtgatcagggagtaaaactcattcccgttttaggccaaacacagaaaaattaggaaggacagccccaaggggccagaaccaccaccctacacaaagccgtgaggagacagtccctgtgcatctctgcgagtccctgaactcaaacccaagacttcctgtctcctgccagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggtgagtgctcagatgcaggaagccccaggcagacctggagaggccccctgtggcctctgcgtaaacgtggctgagtttattgacatttcagttcagcgaggggtgaagtagcaccaggggcctggcctgggggtcccagctgtgtaagcaggagctcaggggctgcacacacacgattccccagctccccgaaaggggctgggcaccactgacatggcgcttggcctcagggttcgcttattgacacagtgacttcaaggcacattcttgcattccttaaccaagctggtgctagcctaggttcctgggatgtaactgcaaacaagcaggtgtgggcttgccctcaccgaggacacagctgggttcacaggggaactaataccagctcactacagaatagtctttttttttttttttttttctttctgagacggagtctcgctttgtcgccaaggctggagtgcagtggtgtgatctcagctcactgcaacctctgcctccctggttcaaggaattctcctgcctcagcctccagagtagctgggattacaggcacctgccatcatgcccagctaatttttgtatttttagtagagacggggtttcaccatgttgcctaggctggtctcaaactcccgggctcaagcgatccacccgccttggcctcccaaagtgctgggattacaggcgtgagccaccgcgcctggccagaataatcttaagggctatgatgggagaagtacagggactggtacctctcactccctcactcccaccttccaggcctgatgcctttaacctacttcaggaaaatctctaaggatgaaaattccttggccacctagattgtcttgaagatcagcctacttgggctctcagcagacaaaaaagatgagtatagtgtctgtgttctgggagggggcttgatttggggccctggtgtgcagttatcaacgtccacatccttgtctctggcaggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagagtgagtcgcctttgcagcccaagttgcctgaggcatgtgggctccatgctgcaggctgggggggtcttttttttttttttttgagacggagtctcgctctgttgcccaggctggagtgcagtggcgtgatctcggctcactgcaacctccacctcccgggttcacaccatcctcctgcctcagcctcccgagtagctgggactgcaggtgcccagctaatcttttttgtatttttagcagagacggggtttcaccgtgtttgccaggatagtctcgatctcctgacctggtgttctgcccgcctcgacctcccaaagtgctgggattacaggtgtgagccaccgcgctcggcccgtttctaaacaatagatcatgtgtgcccaggcctggcctggcactggtgtggaggaagggcccgtgagcccaaagaggctcagaaagaggaagtgggctgcaggagacggtgggaggggcagggagggcagtggcgcgatgtggggaaatctgctgcccccctggccagtgcctggggatgccagcagaagtcctggcaagtcacaggaagatgctggctgggaagtcagggcctgctgagcgctaaaccagaacccgagcctggcaggctctcaaagacgggatgcttgtcgtcgagtctcatacgctaacctctgctccgcctcttctcagagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaagggtgagcgcgtctccaattctttttcatttattttactgtattttaactaattaattaattcgatggagtcttactctgtagtcctaactggagtgcagtggtgcgatctcagctcaatgcaacctccgcctcccaggttcaagcaattcttgtgcctcagcctcccgagtagctgggattacagggatgtaccaccactcccggctaattttttgtatttaatagacatggggtttcaccatgttggccaggctggtctcgaactcctgagctcaggtggtctgcccgcctcagcctcccaaagtgctaggattacaagcttgagccaccacgcccagccctttttatttttaaattaagagacaaggtgttgccatgatgcccaggctggtctcgaactcctgggctcaagtaatcctcccaccttggcctcccaaagtgctgggattacaggcatgagccaccgcgcccggcccttttacatttatttatttattttttgagacagagtcttgctctgtcacccaggctggagtgcagtggcgcgatctcggctcactgcaagctctgccttccaggttcacaccattctcctgcctcgacctcccgagtagctgggactacaggcgcccgccactgcgccctactaattttttgtatttttagtagagacggggtttcaccgtggtctcgatctcctgacctcgtgatccacccgcctcagcctcccaaagtgctgggattacaggcgtgagccactgcgcccggcccttttacatttatttttaaattaagagacagggtgtcactatgatgccgaggctggtctcgaactcctgagctgaagtgatcctcccacctcggcctcccaaaatgctgggattaccatgtccaactttccacttcttgtttgaccaaggatggatggcagacatcagaaggggcttggaaagggaggtgtcaaagaccttgcccagcatggagtctgggtcacagctgggggaggatctgggaactgtgcttgcctgaagcttacctgcttgtcatcaaatccaaggcaaggcgtgaatgtctatagagtgagagacttgtggagacagaagagcagagagggaggaagaatgaacactgggtctgtttggggctttcccagcttttgagtcagacaagatttatttatttatttaagatggagtctcattctgttgcccaggctggagtgcagtggtgccatcttggctcactacagcctccccacctcccaggttcaagtgcttctcctgcctcagcctcccgagtagttgggattacaggcgcccgccaccacacccagctaatttttgtattttcagtagagatggggtttcgccatgctggccaggctgttctcgaaaactcctgacctcagatgatccacccgcctcggcctcccacagtgctgggattacaggcgtgagccactgcgctggccaaatcagacaaggtttaaatcccagctctgcctgtactagctgaggaactctgcacacatttcataacctttctgggcctacgttctcacctttaacgtgaggataatatatctacttcatagacacctttttatgttgtctccaagttttctaacagctctagttctgtacccaagacatggcaggtggccaacgacatccttctaggctgtggtgatgtgtttggagcttgttccacgggtcttgtgtggggccagccctgttcagataaggccttgtggggtggcctggggtagggggaggggttgggcaaactctcccttaaaacgctttgtaaccatctgaggcaccagcaagagcggcccccgagcctggacaaaatccaaacggcttcctacttcaagcactgatgtctagtgagtgaaggaacagctctgggtccaggatattataggtcacattaaactaaaggggcttggccatcagctggcttccagagcgtcagccagttacttcacctctttggctttggcctgttttcagctacaagaggacttaatccagaggacctcagaggtccttcccagctcagaccttctttgactgtctcccagagacactgctgtaggagtgcacaccagtttacttttctttcttttgtttttgagatggagtttcgctctttttgcctaggctggagtgctgtggtgtgatctcagctcactgcaacctctggctcccaggttcaagtgattctcctgtctctgcctcccgagtagctgggattacagacacccaccactgcacccggctagtttttgtattttcagtagagatggggtttcgccatgctggccaggctgttctcgaaaactcctgacctcagatgatccatccgccttggcctcccaaagtgctgagattacagatgtgaggcaccacacccggccatttttgtatttttagtagagacggggttttgccatgttggccacgctggtctcaaactcctgacctcaagtgatctgcccaccttggcctcctgaagggctgggactacaggcgtgagtcaccgtgcccggccatttttgtatttttaggacagcgttttttcatgttggccaggctggtctcaaactcctgacctcaagtgatccacccaccccggcctcccaatatgctgggattccaggtgtgagttaccatgcccggctaccactttacttttcctgcaggctatcacagaacgtgtacaatctagactctaatcaaccaaatcaacgtcttgccatcggagtttgctggtgaagggcacttggggtcctggaaataactgtaggctccaagccacacacactgagataggcctattccctgaggcctcagagcccctgacagctaagctcccttgagtggggcaattttcaacaacgtgctctggggacacagcatggcgccactgtctttctggtctcctggggctcagactatgtcatacacttctttccagggcagtgggtaacaaagtttgactccagaaagacttccctcgaggatttctacttggatgaagagaggaccgtgagggtccccatgatgtcggaccctaaggctgttttacgctatggcttggattcagatctcagctgcaaggtctgtagggataggggcagggtggggggtggatggagggagaggatagagaagcaaaacagggtagtgggaataaaatgacctttgagatccgacagctgtctacatgtcgcctgctgtgtgactttgagcaggttaataacatgtctgagctttcctcctcttaagatggggcaggggatcgttaccaacacttaccctcccagggtttgttgtaaggacgaataaggtaataggaaatgggccctcagactgggcacccacatgtttgttctcttgagactcctatttctagaatttaaagccaaactttgaaaaataatgacaaactccaaatcgttggcatctttttttttttttttgagacagtctcgctctgtcggccaggctggagtgcagtggcacgatctcggctcaccacaacctccgccccgctgggttaaagcgattctcttgcctcagcctcctgagtagctgggattacaggcgtgtgccaccatgcctggctaattttatacagacggggtttctccatgttggtcaggctggtctcaaactcccaaactcaggtgatccgcctgcctcggtctcccaaaacacagggattccaggcatgagccaccacgcttggccaatcgttggcattctaaggctttcagtgtacctgacttcttttagttctaagtctgtaactgttaacctttcttgggccacggctatcacacggatctctctgggaatctgacgacagtgcctcaaacccgagggagcaccgccaggtgtgcacacacgtttctgtcaacgatttcggagactcttgggatccctgacaccatctgttccatggaccttaggttaagagcctctgttcaaaggaggcttttgctcttggtgggtggatggggtgaagtctccaagccctcttacggccccttcggtattcctatccccggttctccctgtcttagtccagtgctctctatttaacaaatgagcagtaaatgttggccgatggactttgggagaaaataaagacctgaaattcaattctagctccttaaaccacaggagaacattctttcagcagacaacttcagttggtattaggccaaggtaagaaaggccaacagcatcctttctgaagaaacctcaggagatggctcactgccagaaagctataacctggaaggggaattgttaaatagatgaggggctggatgaaggacgagaccagggccccgtcacgggagagggaaggcagctcctggctgtgtctgtccccggcttttgggctctgaaggactaaccacatgctttctcacttgtctcagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgagtatgtctgaagaccctttcgctcttggtgggtggatggggtggggcagggtctttgggccttccactgtgctaagcagaacgcaagggctccacaggcttgtaggggggccgtggatgagtccttaatcctcatcgtgccagaagggaaggctgaactgccttctctcatcagactcattcctcagcctcacgagcagacctccctgacaggcgctcacaacactgcctctcaagacgagtctgtctgacctgttttctcatcttgacctaacttgctaaatgctcctgggcaagtcactccaccctcggtcagctcagacctcttcaggcctcagagaaagtcaacagtgctgcgccatcccagcttgcttgcaaagggatcccttggttggggtgttggggaaggcagggttttaacggaaatctctctccatctctacagagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaacttctgttacttcgt

SEQ ID NO: 36133 - DNA, 2803 bp, Homo sapiens
cgggtctgatagtccctacctgtcaggactggtgttaggatgagataatgtttgtgaactgtaaactatataaacgtgtgctactgtgagaactggacaaagaagagagggagtgagagaaattaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgccgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaagtcggcatttgtgaaaagtccctccagatttctatcacattggtctctaatttcccaagacttgtattttttttttatttcaaattataacacttttttttcccccagaagtgggtgtttcatgttgctactctggtgtgtcctaagatatcctaactggccagtgtaaatgctattctttctaaataagattatttggaaacttccttcaaactgcaggagggtgagcttgagggaggaagctaaaactagctgcttttatgaaaaagagtgccagtctttggtcatctctaaacaaggcttatcaccaatggagacagaaaactctagttcaagagctgtacctcctttgaatcccagccctactttgaaataagtggtactatttccatttagcctttgagcaaatcacttaatctcaaagcgttgtggctctaagattaaacgacttt

SEQ ID NO: 36134 - DNA, 13704 bp, Homo sapiens
actgcggccactgaagcggcggcggcggctggcccaggaggaagaagtcgagcccaagctatttccggttccggtgtcagttcgaggcgccgccgccgccgccgcagccgccggagccgcaatgcctaaaggaggtgaggggcgggcgccggtggcccgcaggcctggaggggcggcccaggtccggcttccgctgtcccctcagcccgtgcgcgtctctgagagcagcgcagagggaggctgtccgcaccggctgagagccaggcctgggcctcgacgcccaattgtcccgatggggaaactgaggactgtggtgtcccagagtcactccgtcagtggtctgaggagtttcggaagctctgggtcctcgccggcctagaaagccggatctaggatgcgcttctccgggtctaggggttctggaatttatcccactctttggctggctaggaactgagtcaccgcgtcccgcgcttgtgccgggcccgcctgcctctcgcgtaaaacgtgggctttttctggcttcggttcagccaggcctgcctaggaggacttaaggagatgcccatgagccttccagacctggtttcgactcccccgttcggtagcggctcggtgtgttcctttgagccagtcgctccacctcctgtgtctccgttttctcatttgccaatgggaataacgattgtacctacctcttagtactgttgggaggcttcaactaggtaatccacgtggagtgcgcagtacagtgccaggcagtcgttaaaagtgcccagtgaagcagtaactattcttatttttaaggctttgccagctcttgatcttgtaagtaggttcatgactgcccagtccattgtagcccgtcctctatcttctagcccgttctctatcctgtttccccctttagaatcgatagtccccagtttgaatcccagctatgtcacgtctaattctgtggccctgaacaagttaacctcttcctcatctgaaacactgggctaatccttagcttgttgaattggggccggggtggtaaaattatagcgctcataaagtgcctggccacctcctggcacagaacaaatatatttgtgttggtagctcatgtgttatattggttaatgcactcaacccacagaaacatctgcctgtagcgttttcaaacctaaatcgcttcctgactccagagataattgggcattacagagctaaatgtgtttaaacctagctctctactgatttattctgtggctggaaaagtctctctgctattgttccccagtcccttcatctgtaaaaggaggttgctgaatgagccatcctccctccgaagttttacttaatggatactttgggtaaaggttggaggttacaacgataaaaccttaaatatgaattcatagctaaatggtctttgggcttgtgaaaagctttttggggtagacaaggtttacattttcttgggttaatctgaaaaccacaaaaaaccgtgaaggtgttaaaagtatcaaactccctaagagcaaaggaccaacgcttgtttccattatgttaagtgcaaatcgttttttaaagtcttgaagagtctactataaaattactgtggaccaagctaaggtcagggtcccatagccaagtgcatgagaggagagcctatagtaatcaattttgagttgttactgttgcctggtgtattaagagagcaagaaagggtgttggtttttttcttggcacacttgctctctcacaataggactttaataagcatagacttagacacccctgggaacctaggtagtcattaaaaatgggtggtgtgatctttagcagcccaattatggctttgcagctgctgtaaggaatcagaggaggccagtatctctgctaccgcctctggagtgcagagcaactctggctgattacagagtctctgctcacagagacagactatggaaatcaggtgggcctcagcttcctgtgtggaagttgaggccacagccacccttgcatacttggggaccagcagagggggatgccaccttgctttaaaactggctgatggcttaagcaagggtcagcctggtgttctggctgaagagggtcagactataaaactgacactttaactgctagtcacatttttaacttttagactgtgtagtcaggtttgttttcatctgtactttgccagtcatttcttagtctaagcacaaagtttttgcctgtaggtttgggtttcttttttttcccttaagtattctctttttgccatactactaaggtgaacacaaggtattttattgtgtttccaacatctgcagtaaattgcttatgtgctcagtggtgcttttgttgttgtttttccaccaaatactagattagagggaaaagtaacgaacagcgatttttttatttttttgagacggagtctcgctctgtggcccaggctggagtgcagtggctcaatctcggctactgcaacctctgcctcctgggttcaagcgattctcctttctcagcctcccaagtagctgggattacaaacatgtgacaccatgcccagctaatttttgtatttttagtagtgagggggtttcaccatgttgaccaggctggtcttgaactggcctcaagtgatctgcccgccttggcctcccaaagtgctgggattacaggcatcagccactgtgcctggatattagcgaacatttttgtagtgcttattcagtagcaggcactgttccagcagctttctgtatattgattaattcatctatctttgtgacaaccctgtaaggtagggacacagatgaggaaactgagactgagaggttaaatacctgcccaaagtcatcaagccagtaagcgtagaacctgggagttggactctaaacttcgtggtgtttcgcagtctgctttggtctaagtctcctggtctatgaaatgggaccagctatcacccctgtaccataggtttgttccgaggatcaactgtgcccctggctggctgggcgcggtggctcacacctgtaatcccagcactttgggaggctgaggtgggcagatcacgaggtcaagagatcaagaccattctagccaaccaacatggttaaaccccatctctactaaaaataaataaataagctgggcatagtggtgcacgcctgtagtcccagctactcgggaggctgaggcaggagaatcacttcaaccagggtggtggaggttgcggtgagccgagattgcgccactgcactccagcttgggtgacagagcgagactccgtctcaaaaaaaaaaaaaaaaaagtgcccctggctgtgacagaacatcgtgtaaaaagcccttatagtgacggcagggatgtaagtggtacatgtttctgtggttgcatctgagtccactatgcttggattgtaagggaccaggggatgtagcaagtcattgcagtgcaccgtccgccatgttctcccctccggtcttctgtgtaggagccagcatttagtacacagtttggtgatgcatcagatggtcacgagttgcttcctgcgtgcctttgaacacatgagggtggcggaggtgtcggtttgggtggtgctgggtgaggggtaggtgaggcctccgatgagagtactccaagcaggacacagccctctgggggtcagagcagtcaaggcagctgcttccgctcacctaaactgcgggtctctgcaggaagaaagggaggccacaaaggccgggcgaggcagtatacaagccctgaggagatcgacgcgcagctgcaggctgagaagcagaaggccagggtgagtacgtgcctgtccaggccacgccagtggcccagggtggcgctttgccaatttggttcatagagaggccaggcaaggactacccattcgcagggacaagccagcacgtgggggtcgggcgggcagtgagccccaggtgtgagtctcagaacaaccaatgacagtcagggcgtgggcatcctctgcctggatgggttagaaagaactgtggctgctctgcagcagctgctttagtggggccctgttcttggtcttgtgcacctactttcaggaggatctccctcctgcaggacctgtccattcacagctcgagctcccagcacccctgcttgtctgctgcagccacacaggatgatttgccacactgcacatgacatatgccctgccttcccacacccccagcatcagcatgctctccatccctggagacgttgtttagcctctcctcctctgtgactcatgcctcacctccagccagagctgatttagtagttccctctcctctgctcccatagtacattgtccaggccaccgttaggaaatagaatacattcccatcgtcagcatctgcatcttaccatatcattagattgatgcctggatcaagggcctaagggagcagtcagggccagatgggtacacagctgtgacgtaccccaggagtctcaagaagggaaaggccacatccagctgtggggtctgggaggggtccttgggggagccagcagctgagcaggacatggagaatgtgtgggcaggtgccaagaggtgaagggacatgaggttcctataagggacatttttggtgggaaggcaagaaaggtggagggaagcagccttccgaggtgttgttctggggagctggtgcaggaggtcacctgtgtgggtgggtcggggggatgacttgccatggagtgggagtggagtgcggagaggactcgcctgggaatgccagcatgatttggcagctgcatgtggcaggtgggagctgagtaggatggtggttttcagcctggtggctgagtccttctgaccccaggaaacaagcttctcaccctggctgctgaggtggctgcgttaggaaggggagcagggccttctgtggctgtgtgaggggcttcctggactatgggaatggcctctaagctgtggtgctaagtgcataggctgcctgtgtctggcccaggtcccattccctgggggccagggtcacagtaggacccttgtcatccttggttccagccttccagaggcttgatttctcaagatccacagtctggggggtgatagggtcacagtcttggggatttgttttgcatttttgattctgcaggttgtccatttctgaaacaggaagaagaggagcaaaaagaaggtggagatggggctgcaggtgaccccaaaaaggagaagaaatctctagactcagatgagagtgaggatgaagaagatgactaccaggtactgagttcttttgagggcctagagcctggactcattcattcaacaaacaaacgttgagtgaccgtttagtactagtcccaaaggtagatgcagacaacgtccttgctcttgagggtttacactacgggagatacaacaaagaagtaaacagacagtgtcatttcaagtaatgagaagtgttactaacaaaacagactgtgattgaggggacttggaaaagtgttgtggtggtgaagcaacttataaactgagatctgaaaaaacaagatgcagccagctatgtgaaaattggcgtgcagagcaattgagaaactggattagcaagtgcaaaggtcctgtggtgggaataagcttggcatgttcaaggaccagaagggggccagtgtagctgtgagttagtgggtaaggagcggagtggtccagatgcaggaggagaattggcaagggcacctcctgtgtagctgttgaaggggttggcatttcttttcttttcttttcttttttttttttttttttgagatgaagtgtcgctttgtcactgaggctggagtgcagtggcacgatctcagctcactgcaacttccgcctcccaggttcaagcgcttctgccccagcctcctgagtagctgggactacaggcgcctgccaccacgccgggctaattttttgtatttttagtagagacagggtttcactgtgttagccagaatggtctccatctcctgacctcgtgatccacccgcatcagcctcccaaagtactgggattataagcgtgagccactagcccagccccctttttttttttttttttttttttttgagacagggtctcgttctgtcacccaggctggagtggagtgaagctgcagtgaagcaccgcagcctcagccttccaagtagctgggaccaaaggcacacgccaccacatctacctaatttttaaattttttgtagagatagggatctcactatattgcccaggtggtctccaactcctgggctcaagtaatcctcccacttcaccctcctgaggtgttgagattgcagcagcatgagccaccatgcctggcatggggtttctttatggtaggtagtggcagctgggggaggccttgaagggattgagagacatgaccagatatgcttttttttttttttttttttgggagatggagtctctctgtcgcccaggctggagtgcagtggtgcgatctcggctcactgcaagctccgcctcccgggttcaggccattcttctgcctcagccttccgaatagctgggactaccgtagaggtagcgtttcaccatgtcagccaggatggtctcaatctcctgacctcgtgatctgcctgccttggcctctcaaagggctgggattacaggcgtgagccactgcgcccagcctccagatatgcttttaaaagattattttactttgggaagccaaggtgggtggatcacaaggtcaggagatcgagaccatcctggctaacacagtgaaaccccgtctctactaaaaatacaaaaattagccaggtgtggtggcaggcgcctgtagtcccagctacttgggaggctgaggcaggagaatggcgtgaacccgggaggcggagtgcagtgagccaagactatgccactgcactccagcctgggcgacagagtgagactccgtctcaaaaaaaaaaaaaaaagattattttagcttcttcatggagagtgaatgataggatgttgagagtaagagcagtgttcagatcagaaatcctgggccgggtgtggtggctcacacctgtaatcccagcactttgggaggccaaggcgggcggatcacctgaggtcgagatttcgagaccagcctgaccaacatggagaaaacctgtctctactaaaaatacaaaattagtcgggggtggtggttcatgcctgtaatcccaaatactcaggctgaggcaggagaattgcttgaacccaggagaccgaggttgtggtgagccgagattgtgccattgccctccagcctgggcaagaagagggaaactctgtctcaaaagaaaaaaaatcgtggcttgccctaggatggtgacaatggcagtggagaagagtggacaaatttaagctgtatttgggggttgctgaaggaacgacgaatcaaggatatgcttaggattgcagggagggtccggttgggtaaaggatgaatctcgagttctgtcttggacatgttaagtttacagtgccaggcatctgagtggaggtgtaagtgtgcagctggactggaagtgtgtggagggagctctgtggagtggaagctgtctccctgcccccttaaggagaattgatggaattgacagggcctgaaactttgaccaaacctgctgcattgagaacacacccccttcttctggaacttctgcaggggaggtggaaggtgcagattccaggtttttgggccagcgtcccaaacctgtagagtgtgtgatccagtagcttattcttgggttacaagtccagtccatcagctaaggtgggtgggaattggaattagtcatgacagcacacacttggcccaccctgccctggggattccagcccagcgctttttgcaagaagaatcaggcatgggattccatggaaaactgcttttggaagccgagcttgaagtaggggagtagtgctgtgtgagtgcttgcaagtcggggtagggcgcacctctcatctaccacctacttcctggttgacttgggcaagttattcgaccccgagcagccgttctgtgggctcttcccaggctgatgaagatgctccagagagctatacccactgtgagacttgggctgagcactacgtgggctggggtggagcaggagtttgtcctcatccagatgggctgttgagagatggcaggagtggccctcaggggctccacaggacctgaactccaacaaccagcttcttgccctgttctagcaaaagcgcaaaggcgttgaagggctcatcgacatcgagaaccccaaccgggtggcacagacaaccaaaaaggtcacacaactggatctggacgggccaaaggagctttcgaggagagaacggtaacatcactggctgggccttgtgtcacggggaatacaggccagcagttggcctgtgggatgctaaggtccccagctggctgggagctgtggctgtttatttctgtctcattccccaatggccctccagtagcctttaaaaagccacacagaatttgttttcaccaattgatacatgatatcaggggaaataggacaacaggctcagacctgagcataacacttgaggtaatggtgcaggatacagagggttgccctccattcccctcttccagagcaccacaccctggggagacttcccttaccccactgatctgaccattcctgacctgcatccatctgtaatgtcgtggccatggggactggaagggggctgcgagcctgtgccggccagaaggcagtccagcccagcgcagctcagccagctgtcccaggcctctgcaagtcctgtgtgaaaatgaagctgtaaatatcttcctcaagagtcgtatgaggatcaagatcatgtactgaagtgcctggcacaggatcagtccttgactggtgccctgacttttggcagccaccaggtgacctcaagggccttacaagaggttgaagcctgctagtttctctcctgactgggaatttaggataatggctgaggggtgtgtctgtgaaagcctcgtggggaaggccatgagcttgggtgtgattgcagctgctaaggacccttctgtcccccttcagtagcttcctcttggcattgacttcaaaaacccagcaacctgggtgttctgccactgtggtattctgccattggcagctgtgcagccttcgataaggctgtgcctttctgggcatcagtgtcctctccagtaaaagggatcctgttgctccctccttctgtcctttggggttgcagagacaccctgcctggcattttgctttcactgaagggccctgcagagtctttgggctgccttagtcatcattcctgaggctcagcttagaggcttctgagtgtggcacatccctcctgagctaggatctgcggttcgccaggtattatctcctcagctctgtagtgaggcatctgctcttcccactcgggagtccctctccctcccctctagctagctcccatgcctggtttctcattactccccagttctgtgtaccttgaaggcctctgggaggccgagtctctctcccagcctcctgccaggcagggccctcccctcctccagcacttggctcttccaggaacccagtgcaaataggccctccgatctcatcctgaagggcatccactccagttcagaatctcaagcttgggaagatcctcaaaaggaagctaatgaccctcaccactgactctacttagggggttcattcctgacactttgtcccatgggagcccagcaattattcccatctccctactgatgggggctgtccccttggggggcagcaccgtgcacatctgagctgctctaagaatgggccatgtggtgttgacctgagactgggtgtgtctgtttcccactgtggtcctcatcctatgccctgtggctgcttcctccacttcttcattcctttttttgtttgtattttttagagataggatttcactctgtcacccaggctggagtgcagtggtgcaattgtagctcactgcagccttgaacttctgggctcaagcaatccgcctgcctcagcctcccatgtagctgggagccatgctgccttagccatgtgtgccaccacacctggctaatttttaaattttctattttgtacagagtcttgctatattgcccaggcaggtctcaaacttacagcctcaagtgatcctcttgtcttggcctcccagagtgctgggattacaggcctgagccaccatgcccagcccttccttccttgtaggatgtggtccccactgctttcatcctcctggtcatcttctctggaacactcttggcctggtcccccttctctccatggccgccagagcctgatcatgaagccctcaggcatcttcccctccctgctgtagctggacattgtcccctttccctctgaggctttctggacatcgcagatgttttctccctgggcctctccctcctgctcacttgcttggtgaacgtccaccaagcagggggttcatggaggcagggactcacagccagggcaccccttccacctcggccctaggccgaatccttggcctttattctgactcccgtccagtttggcaaacagtggtaggaaagatgtccccatgacaccattttatccacacagagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaaggtaagggctgggctgcgcacgcagggacaggccccaactctggtcctgggccagccacaaagcactgaactcgtgtccctgtccgcgaggtgacaatgaggtgaggagtgactgctgcctaggaggtcgttcaggagagggccaccctccctgtgcctgccactccctcggggaccaggagggtccagcgacatcatggggtcggatgtaggttgaagtctcagcagagcaccgtccacagtaggtggacagtcactcctgctcccaacagcgggaggtcacaggaaaccatgcccctagtacagaccttgcctgaggctcacaggtcccactaaggtctctggtgccttgggaacccaggagagatgcctgaggtcaccgctgtccatctgcagggcttgggagggtgagctggatacacagcagtgcagactggcttgacatccagcccaggcatcccttttcctgtgctctcccctccaggcaggccagagatggtggaggttcctctaggccagagtggctatgggagttggtccagtttataggagcattcaacttgcaacattccatctcccgggggtctgtgagagcccctacatgtccatctgtcctgcctcctcaccagaccatgaggaagcaggcctggaaaggggaaaccaattgctcagggacattgtcacccgcaccagaaatccagtgatcccaacttcccattcaaccctgcttcacaaaccccaagcaggaaaggacttcacatgtaactgttggaatgtttaaattttagacttcagaacccgtggagggaggttagaattacagggttctgctgggaggtggggtgagaagtttccgtttgcccacaagagtgtgtgttggtggggctttgtggaaggaacagctttctataaggtggtctggccactgaagcgtgtcgggaatgtcggggggcccggggttacagctgcagcagaaatcctctcccacgcctcggctcttctctgttgcacagaatgttttctgcagcctttcagacctaaagttctagggttctggcacgtgtgttgggagggggtggggggttgctttgttttaacccctgcccttctcccacccctcagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaactccaagacagaacctcagtttacagcacacgaaaaaaatatcttgccaacattgtaatgacaaaataaattcccgtgaagttccacaaccaggccgggcatggtggctcatgcctgtaatcccagcactttgggaggtgaggtgggtggatcatctgaggtcaggagttcaagaccagcctggccaacatggagaaactccgtctctactaaaaatacaaaaattaaccaggcttggtggtgtatgcctgtaatcccagctacttgggaggctgaggcaggagaatcgcttgatcccaggaaggcagaggtggcagtgagctgagaacgcacaactgcactccagcctgggtgacgagcaaaactccatctcaaaacaaaagttccacaaccagcctggagtgtgtagcccctttgtccaggaatttgactagtcaatcagtgacacctggtactggcagttttgggagtggcagcccaggatggacagcagtggggagggaaccatttggcataaggccgttgggcttcaggatcaattttgttggcaagcagtaaaaataagctatctaccta

SEQ ID NO: 36135 - DNA, 4002 bp, Homo sapiens
tggttcttataaaaacctcacagccttccactaacatcccgtaggagcctctctccctactgctgctacacaagaccctgagactgacctgcaggacgaaaccatgaagagcctgatccttcttgccatcctggccgccttagcggtagtaactttgtgttatggtgagaaacttttctcccatttctctgtgtttacttttctgcctctgactttggcttacttctatttttcctctccctcctcctcttcttccccctttctctgttataatcttaaagtaccattactttcacatttcccagtctccgcagaaactgatctgttctattaagtcttttttatatcctaaatatccagagtcttatgcaacttaacaggcaaacccgttcagtggtaagtctctgtatatctagaaactcatatttcagaaagaagataccaaattcccagccccctgcatcctcatttttaaggatatttatttagactttggtatcaatgggttaagggtattgtttaaaccacttgcctttgagaaaatccatttttatgtgaagtattaagtatagccctttctagggactggacaatctcatgaacttactatgtttgttcagttaattaattttaaaataaagttttacatcaaaagaattttagaaaagaatcattttcataactcctgttgtcagaaaataaattttgcctgttttctatatgtcattaaatatacctgcatttgttcaaagcttataaaaggaaatctgaagcaaagttatttacttatttcagtcttttgtttcaattacctagatattttcattgttttaaaatttaaattacattaacaaccataaagattatgcttctcactcttgtattcacaaattttctgtattagaggatttgatttcttcacctcctttttaagttttgaagaaaattcacttgctggcaaatattaatagaagcttcttattccaaaatttatctgctgtgctcaggagagtggcagaaagaagaaaacttcggctttgatatcgtttcagttctctctctgaactggcatcgtgcccagggtgagctgtcagctggagctagtggtttctgtggctgccaatttaacacaggttcttaagaggctttcggaaccctcttagaaacctgccctagtaagcccagcagagcaactgccctgtagttctcttgcctggagaaacctggctgtcttctggatccttcttaatcctctttgaccctgttctcaaacaggctctgaataaatcagagaagaaggttctctggagacttctgtacagcacttaaagtgtcttattttgcttgtctgaagacgtcatagcccttgggaaattttagctgaaaatggccactccctccttcaacatcagagaaactaaaatatagagatatccacagcaaggccagagctagagaaaaacctcataaatcctaaattcctgaaatttctaataaccacactgctaaatatattcttcatgtttttagactctttcctcttcttccatccctgtatttaaactatcacagtgtctaaattgataaataataacataatgaatcatggataaatattgatataatgaatcttttttttttaatttcagaatcacatgaaagcatggaatcttatgaacttagtaagtgaatatttaacttctttattcaaatcccttgcattaaagaacctcttcttatttttaaataaacaagatggaaagatatataacagggagggaaaagggggcctcttttggaaaactaaagtaaatttttaaatctaatgactataaaaattgccaaaggagcaattttttaagtttgaagtagtgcaatatgggatttaagctacaggcgacatatttagaagccataaaatctcatttggaaattttaaattggcaccacgtcaactgcacagatggaaaacgaggagtaatgacaaatggtaaagcacagagctggacgccaagtcagctgggagaccacaggcgccacgttaagctgagtgctgttttggtttttttgtgtttttctttcttgtttttttttttgagacagtgtctcactctgtcgcccaggctagagtgcagtggtgtgatctcggctcgccgcaacctccacctcccaggttcaggcaattctcatgcctcagcctcctgagtagctgggattacaggcccatgacatcatgcctggctaatttttgtatttttagtagagatggggtttcaccatgttgtccaggctggtctcgaactcctggcctcaagtgatccacccaccacagcctcccaaagtgccgggattacaggcatgagccaccacacccagccagctgattgctgttgaatagctggatttataaagactgagcataggaggaaatggcacatcactctcatttttaatttattcattatttttatagtgtttaaactgttcatgtatcggcaatctagttatgcttcataaatcctcaggacagagaatttctcctcaaaaggaatttaaaatctaccaagtagaaatacagaaattaagaaaggcaaagtgatcgtccaaactcaaaaccaacaaagcctatatgacaagtctctaagacacatggattgattactgatttcatttgatcaggaagttaatgaaatctactttatactctcctttaatttttgccaatctccgtttatatgagttgcataagttaaggcactttcaaatatatttgtgtcaaggaatattcacggaaatatttccagctatgtgtcgctaaaactgcatttatttattttctgttctaagatcccttcattaacaggagaaatgcaaataccttcatatcccctcagcagagatggagagctaaagtccaagagaggtcagtaacaaaacttcatgaggagtggtcatttttcccagtgtagatcacagatctgaattggagtgggaaacagctttttcatcatatacattatttctaattgtatctttaaaatcaaaaaacttaaaagcaatattcagaaaacaactgaattattagaaaattatttggggaaagatccggaaaggagaaggaaggaggagagaaaggaggacagaaagaaaacttctattttcattaaaaaaaaaaaaaaaatctcctgttctgccttccctccctggttttttttttggttggttggttggtttttctgagacagagtctcactctgttgcccagactggattatagtggcactatctcgtgcctcagcctcccaagtagctgggattacaggcacgtgctaccatgtccagctatttttgcattttttgtagagacggggttttgtcatgttggccaggctagtcttgaactcctgacctcaagtgatccacccacctcagcctcccaaagtgctgggattacaggcctgagccaccgcacccagcctctccctgttctttaaatatctcttaatataggggggcatggagagaaagtctctccaatattttcttcttcttttccatttttgtatttttccactttatccttctcaattttggcctcttcttccactttctaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatacttt

SEQ ID NO: 36136 - DNA, 11917 bp, Homo sapiens
cggagcggaagtgctcgctgcagcttcccggagccggagcgcagcgcctgcggccgcccgtgccccgccgtcctccttcccgcggccgtgagggagaccgcggctcggccgtagcggagctgcgaggtgccaggaagggctgcgtggcgcgggaacggccgggcagcgccgcctccgcttcttccgggctgtcaaggccgcgggcgggcggggccgcgctgagggccgggcggggagggccgtcggggcccgggtggccgcggggaccgtgttcccgacccgcggccctgaggggtacgggtcgcgcctcggggtcgggcccgggacggggtgctggggggtgcggcggagccctggggcctgcgagggtcgggggagcgggagaggggccgggcgggggctgcagccctcgagccacccgggccgcatctcgtccgcatcccctgcttggcatctgggggaagcgggcagtcgcggcccccacagcgctgcgagttgggctgtattccagagtaatgtgccctgtccccatcctgcgtccaggtcagcgcttatctgtaggatttagtgttaagctctggggtgaaggcgttactgacgggctgaagggaaactagttacatcggttttgatcgtattctaaataggcaataaaatcataaattctccaggctgacttagtactggtctgtggccccactgataaaggtatcgttcgtttctctgccaggtgtctcacagcacagagggctgctttcagcctaagtaccttcagtgggcttttgcccttttccctttatgaagagtagagactggccgctagtcctggaagcactttatttttagttgagttgacatttcccaggaagatgcagttatccccgtaagtggataaagggttctcagtaattcagactctcacatggcttctgccgtatgcctgaggtgacggcgacggcggtaacagtgtgtcagagccaggtggagatataagatggtcaggcccagaggagcggggagcccaggctggaatgtggccttgggaaggaggaagagacggggtctgggagggcatttcagaggactgaacaacaccagaggcgtgaagcttggtgcacggcagccgggggctttcttagtcccggaggaattggggatggggacgtgaagagaaaggtgggagccagactgtcaatgctcccggacgccaggcagaggacttcatcctttccacgtgcagagtgatggaccacagatgtggatgaatgtgacgggcctggaacaaggcacatagagagtcttacactttctggcacgtcctcatggtctctgcttggactggttttatctccctttctgttttgtttgtgaccaggcataaagcagtcaccttcaacaggtaattgatgggctgtctactatgtaatggacttccaggtggcagggcccagccccgaaccagacaagggacccctcaaggagcttcattctagcaggagaaaattgagaagtaaaccagaaaggtatcaggaaacagttgtacacaaaataaaaatagggtgatgtgatgtaagggactgggggtcagtgtgggcggtaacggaggcctgtgaagaggaggtgggcttcaaactgagcagagaagaggactgcagagggggcagctggtgtgagggctggccctgatccaggaacagggctggcactgccttgcccggctccaagggtgctccacgggctgcccactgattcctcacgagagccttgtggagaaggcatgagaggtgctgttgtcccatttcacagactggaacctgaggcatcctggaatagcctgtcctagtcacactggcagagagtggtagagccaggatctgaaagcaggctgttggagtccaaagttcacgttcttgctcctgccgccctgcctcaggctattcctggcaatgcgttcagtcagggtgcaagctgtgtttggtatacgtgtgtgtttggtatacgtgttgtgtgtgtcagacaagcaggattggctgatggcgttttgagtaggttttctacatgttcagttggagagtgagaagttctgagctttgcctagagaacaccctttggcgggagagctgggtattttctccctgacattactctcatcacctccagtccagtaaaagtgctttaatgggaaacagtctgagtaaaacggggaaacttacaaggagctataggacgaacaatgtgacgggtggctttcagatggcctggctttggcctaaatagggtggccattccaggtgacacattttagtgtagcctctatttaaatatggagttctttcagtggagagtaaaggtgctcctcctctgtgtctggtttacacggctccgcgagaccaaagggcccctcggtctccttgagcagcctggcactctgcacagaggatccaggaacggtgtcatggagccacattctgcacagacttgatgatgtggagggagctgcctggatcacttcagcgcatcagttgtgatgggagagccaaggcacttgagggcgggattgcgtctggccacctgttgccttccacctgaagggaagatttccccagtgctcacagtgaggatgggactggaaaagcgttggtttcaggaaggtgcaggttctggctcctgcccactgcgaacatgctgatgggccagggcaactctttagtctttgtgagcttcagttttcttatctgtaaatgagaacaataagactgaccccaactgttgctgaggaatgatgtctttgctttcatgtctggtatttcttagagcctcattttacagatgaggaaactgaggctggctgcgtgctcagagggtttgctgaaggcctcacagccgcttagcacaggtgggactttaagccaaacttgagaccagagtctgtttctcctcactgccctgccgagggagcagatggggggtggtgggggaggtgaacgtcacccctggcgtcttctctagctcaggggccaggaggcctctcatctttaaagtaggaatgacaaccggcaggccctgggtactgagctgtgctttaccgaagagcggcaggtcctgacgccgtctcctctcaggagtggggtggcggcgtgctcagctgaggagccaggtggcagtcaggcttggcttggcctgcccagaagcagggctgtggcaggaccttggacacgtggcttccactgtttgagacttggtgaaatgggggtcatgatgcccttcacttgagcatctgggaattaagtgggtgaacaatgtgacctctggcacctgggttctcaggtgaattcctcatggcatcacagcagtgttgaaataggagcagatacgttacctccgcttgccagataagaaactgggacgcagatggatggactacctgagagttgtagataacattttcctgttcatggggtggaggacctggccctgagaggacaggatccctcctgctcctgccagaccagagacccaggacagggcgtggagcagacaaggtgcctgggcgggggaaccctgagggatccacagagggtgcggtccttggagggaggacatgcagtgccacgtgccatggaccagccagtggaccccatggccagcaaggctgctcctggggccagtggggtggacagtcccgcccacgcaggtgactgaggtgccagtgtgggaatgaaaatgcggcctgtgctcctgggcccatgcgtctcacgctgcccttcctctccagggaagcctgtgtacctgctactttttcccgaacaattcatggtaaaaacacaaatggtatatggacaaaatactgaatgtggaagaaacctacttgacagtgttggtgaaaatagggccaggatttcacacccgtgaatgctttttactgaaaagtattttgtgtttttctcccagttacagaatgtctgaaggggacagtgtgggagaatccgtccatgggaaaccttcggtggtgtacagatttttcacaagacttggacaggttggtgggttttttagtagatgagtataaatatttgaaaaagaaacgggactcccagcattttcgggaaggatctgtttgctggtgttcctgatggagaagttacttcgcctcaggctcaaacttcctgaagacagcgttctcttcactgtgaagggccagctgtggagagatcgggctctggggccacacgtggtctatcaaacatatgcgttttctgtttctgttttccttttaccaagctttaaaaatataaaacccagtctcagctcccaggcaggacagatgcggccgtggctgccgttctgctcttgctgtccctctcccagccacccacgtccccggtgctggtagccccacctgccccgtgtcagctcggcggttctgtccttgagggtgagaggctcttgtgtgggctgcgtgtgcattgcttggtgagtgagggacctagagctgcctttgaacgctggagtccgaacctctgtcaggaaaagcttgggtcaccggcagttccaggtgctgaggatccggctcaaataaaaattcatcaccttaattaaatcacatatgaaaagcgattggcgattaatgaagttgggtgacaggcatatgtaagcttctataatctttttacttttgtgaatttggaaatttctcacaatttgaaaattaaatttctaaattaaaataaaaaaccatacatatgtatatttgtaaaaataaatacataaaactaagggctccttcggtcatgtccacagccgcctggacgcacacacatgtgggtgtggctgctggggctcaggctgtggccagtgggcctgggagcggggcaaggctggctgctggctgctgcagatgggggagctgacttgagatgtgacgataagggctgtgctgtagggtggggactttgagatgcacagtcctctctttggggtgaggctgggtcttccccatagtgatcccttggggccagcacaatgtcacagtctcctaggagattgttttgtaatagtcttgcttaagagatgaacctgcttcaggaattattgaaaataaactttggattaattgtagtcacttctttgtgctgatacatagatgatctcttgctattttaactcactcttttagctgttttaaaaattgaaagccaaccctagcagaaggtacattttgtggcagggtcagtacagaagttacaggacctgcttcatgcttttggactcttgtctttctagatttatcagtcctggctagacaagtccacaccctacacggctgtgcgatgggtcgtgacactgggcctgagctttgtctacatgattcgagtttacctgctgcaggtaggtgtgggctgaagtgacgagacttggctctgtccacgttacctgggcgtgatgtttgtggggatgttgttgatccagtctgtcttgcaggaagtggtctctagtaatcaattttcagctaaacgccaaatgtcagaaagatctcagtgactgtctttaacgaacagggttgtttatgattcacccggagtcgcctcgccaggcttctcagtatacccaggccgtcctgagcccagcctggccctgccctgggcacgtccaggcctggacagtggagccgctggtgtccctccgaccctgctgcatgatgctcaggacaaggttgcgctctgtggctgcctcattccttgggtgaagagtccatgccttgggtgtcatgaatgactcggcgtccaaagggtttatgtagcttttcctgagctctcccttgtgtgaggccaaagcacagtgcaggttgagacgccgagtcaagtaagagagacagtgaccgaagggggtcttgagggtttccttcgtgtgttttcgggcacccctaggtcaggtgatgtcgtctcagacttcacctgggtgctcctttacttgctggtaaacacggggtttctaggagcaaacctgtaagatgggaattcttcgtcggtctttagaggaggttacataatcttatgtgcagagcagggcatgttgaaagccttgtctgggctattttctcctctggggactgtagaagatacttccttgtttaaagcacacaccttaatttatttatttatttttgtttttaaattggaactgggtccattctctgatggaaagaatgacctagaaatcttgaatcagggacttcaggcaggagcagggggcgggaagagtgcagcacccacaggtcagttttattgcgttcgaaaccaagctcgtgcctcatttggcgtctcttcaggtgtggccctgcagccgaggatggacacacagacatcagttagccctcacatccggcgttcagccgaggatggacacacagacatcagttagccctcacatccggcgttcagccagggatggacacacagacatcagttagccctcacatctggcgttcagccgtctgactggaaaagcttttaggcagaaagacttcttgtttgtataagaaagttaaagcatttatatttttatttattgttttgagatggggtctcactctgtcgcccaggctggagtgcagtggcctgatcttggctcactgcaacctccacctcctgggttcaagtgattctcttacttcagcttcccgagcagctgggatcacaggcatgtgccaccatgcctggctaatttttgtatttttagtagagacgaggtttcaccatgttggccaggctggtcttgaactcctgacctcaggtgatccacccgccttggcctcccaaagtgctgggattgcaggcgtgagccaccacacccgacagaaatttaaggcttttgaaattgagaatgcggttctggcttttaacgggatatgcttaatcattttaaaaaatgaattagttgcaaataagtgtgctgcactcaggcatcttgccaaaattctccccacttttcatctcttgaggaaggcttggcataagcacacttttctggatttcccagttgtggatttcttctgggcaaaggtttaaccctcctggcagagtgtttttggcaatgtgaattgtctgttggaggaacatcagccagcacgcctccagtcacagttgagagtctgtcttctgtttctgatgaagctgctcctgggtggggctctgggccagcatcgctcaggtgcccgggccacccgagcctgtggtgtagcttgagcatgtgcttcttgagaaaagcctccttttctgctgcgctccttgtggggcgtctgtggcttcagggatcacatgtgtctaactggacccttgaagagctttgctcatttgggcccttgcttgtccgctttgtctctgttcccacagagtataatttgagataaattgttaccatgggatttcactgtatttccttgtccttgctatgagtaagttttgtgttaaaacaaagttagatcagttaacaaagttgagagtgaaccggagtgcaaacgtgaactggctcaggctgatggacggtcagagtgcaccactgactctctttccttctctttcagggttggtacattgtgacctatgccttggggatctaccatctaaatcttttcatagcttttctttctcccaaagtggatccttccttaatggaagactcaggtagggtagcggctgtgcactgggctgtgtgggcaggttgggcctttcttttctgatgggattgcccagtgttctctggaaacacccgagactcttctcttggggttgaaatgtacttgtaatgttgggtgatcaggatatgtttgtagaatgactcttcaaaccctcctgacagccacgaagtgggtgttcattctgttttcccactttgcagatgaggaaactgaggcatacagggttaggtaacgtgttcgaggtcacatggcaccacagacagtaggggtctgaggtggacagtccgactccagcccccgtcccaccccagtcagtggtccctctcagaatcagcggaggcagccatgacgaggttaccttttcccgtagccagagggttccacaggcagctcactgtggtgcacagagaccgccgggactctaatgccagcatcgggtcgggtcaggctttgggcggccttctctggtttctgaggagctgtgagctgaagtgttcctggtgcttcgtgctccactattggaagacttacgcagctcctgggcctgcctgggccaggtaggggccctgagttcatgcctgactggccagccccaggcgaggaacaaacaactgcattccaggacgtggtggccattgagggaaaacccacacgcagctccctgccaggaccctcctcgttctgggggaacctgctgtcagggagtagggtatgctctcactgtgtggccagaagcctgtgagtcttctgtgtaggatatgtgatgaaaagattgctgggaacacagcccctctctgttgttgctgtttggaggagactagaaaataacaaagagcccctttcctgtaggcctcagttttcccatctgtaaatggggagcggcacccatcccagtgggggaggcggggtgagagtgggcttggcacagctgctggtgggacaggcctggcgcccgggttccacggtcagcgcatcctcggccccgccctgttctctgccgcttgctttttatgttaatttgcctttgttttcttctgtgcctttacgtggtgcagctgacgtgttcctggatgtttatatgtggttgaattcttcgtgcattgaaaacgtgtggaagtctaaaaacattctgatagcaccttctgaaagcagtgaattggatgtgtcagttgaccacagacccccgttttctcgttttctctggttaaatgacatgaatctcggtttagatttgtgaggcctgctagtccaaagccttgaggggaaaaggtagaactgtgatgggaatgaaaagaggtgccctccctgatggttgctctgccttacagatgacggtccttcgctacccaccaaacagaacgaggaattccgccccttcattcgaaggctcccagagtttaaattttggtgagctaattcttcacggtatttgaagagaattgtgctcaagggtggctgagactgagactacactgatttttgttcaagtcacctgaaagatgactgctgtgctgggctgggcacggggaatcgcaggggctctctgtagaaggccactcactaccttgccgcattctcttggtttcaagtcagcaccagtgccctggaggttgagtctgggatggagtgcgcaccggcttctgtggttgtggcctggggagggcaggccctctgtcctccctcctcctccctcctcctcccttcctccctccttcctccctccttcctccctcctccaccctccctcctccctcctccttcctccctccttcctgccgcctcctccctccttcctgcctcctcctccctccttctccctccttcctccctcctcctccctccttcctccctcctcctccctcctcctccctcctcctccctccttcctccttcctctctcccatccccagccttgtggctccttttggctggcagagggactagccttctcctggagtcatttttgagaggggtttgagccgaggtgtccgtgtctgcacgggtaggcagaggtgggtggtgcagccgtcagagggacgggagcgtgtgcatccgtttgtcttgtccctcataccccactctgggagcacaggaggaacccaagtctgttagatcagtaaactgaaggagcctgctgagctcgtggggctccacgccttgactttgcagccgcagatggagtgtggtacagaaagatcaggggccctggaagccaccagaagcttggactaggaagggagagctgagcctccagggccgtggcatctgttggccatgtgctgggacgggagggagcactggtggccatgccacagtgacaaggtgaaggccctggatggtccacaagacacagcctgggtttctctccagatcgcaggcccagccagcaggcatggggcccccagcctcagtactgatgctttatactttgtgtagttttaagaagaattgtgtctttcaagggagtaagagaaggatgtttctgtggttagggcagtacatgtctgtgagctacatgcaaagggtcctgctgctgctgtgcccagggtagacccctcctttccacagggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaaggtaaagcagaggcgctgccgccacgccggccgcaatcgctgttctgttacccgcagcattgggggagctgtgctgggctgtggtgggtggtggcagagtctgcctggtgtgaatgtggagctaagtggcaccgtcttgtgtgtgacgaggacactgctccgttcccagcacggccggctaactaaacggggagcgcagctgtgggagcgggcgggctcttggtggaaactttgtggaagccgggtgggagagccccggcgagtgcagtgtcccggtggctcctcttagggtgcccagtgccccgcgccagcctgcccgaggaggagggtgttagggggaagttagccgagactgcggactgtgcccttgacggtgtggccttcgtgctgcgggcctcactctgtgcccggggtgttggctgcagagagggccctgggccacctcacatcccccttgcccttcctccacgggaggctcacgaagcactgggattgatggggtttcaaacctaggcctcgtgggctgtggaaggtcttgctgtgttgatgtgggcgcaggaagccactggggctccgattccacttgtctgatgtatagaaaagatgggggacctttggccgctcagatttggggacagtgtgactgactggagagcggttgtgcagtaactgagtctgtgtttctctccccagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatatttt

SEQ ID NO: 36137 - DNA, 11917 bp, Homo sapiens; identical to SEQ ID NO: 36136

SEQ ID NO: 36138 - DNA, 25257 bp, Homo sapiens
agcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgcgtcagggcgggcagggcttgaagctgcgccgggtggcgcgagtagggggcgcgcaggtgtctccctggcctttgtctcccccacgggcgccagctccgtgctgtgctcgcgcgggacttcccggtgtctctgagctcggtgtcccgagcctcaccgagcctccctggttcccgcgctagcgtctcgggccgcgcgcttgtgggtgagggctcctgggccgggccggggtcccttggcggctccgggccgggacacgtgcgcctctacgcgtcccaggccgggtgccgcccgaccggtgactctccagccctgtgatggccacggctgaagctggggacccaggcgtcgccgaagctccgccccagccccagccgtgacgtaattgcgaggttactcacggtcattccctccggcccgagagttcagctcggcgtcggagctcttgcgcatgcgcatgggcgctgcctcgcgcccttcccccgcctcgtgtcgggttctcccggtctgcgacgggcacagcctccgcactcattcactgacatccaccgaatgccaggccccgtcttaggcaccgagggtttacagacagacctgggtaccccctcttttagggaacacaaaaatctcccgggaaaccaaacgggtatttagttgtaccttgggtggagcgaggctgggggagggcagggatgtggctactttgggtagagcggtcagggacttctaagctgagacctgagggtcacccccaggaccagcaaggaaagatgttttccaggccacggcaagggaagggcaaaggcctcgaggcagggcctaagtgtgaggagttagaggcttgcaaaggagtgaggtcagggaggaggaggacgcaaaccgacttggtcggccagggaaagggcggagcagaacagtggcaccggcttccatctttggagcatcaccctggctgtgatgagaaggggtttggggccaatggtggcaccaagtgccaattaggaggcccgttgcttccattttgtagatagagcaaacggaagcccctagcaaattgcctgcatggtttctgtgcaggagttttagcagcactagctaagttgcacttggttgatgaggaaactgaggccaaggtcgcaggaacaagatgcctagactcacagcctgaatggacatgtccatggaacccgtggccaccctggggttggcaaaacagatatatctatgccaccaccactcctgccctactgcagccttgcagatgagcccagctggttgccagccccagaagcttcccagccctccctccttccccctggggctgggctaggggaggaccccagaggagaggccctgattgtgaggcttttccaaaacagcctcccctatccctggcacgaggggttgtccttcactgccctctggagtgatgaaccctgaaatcccaagccctagggagatctgggcctgactcaactaccagttccacatcactgggcccagtgagtgtagtcccaagaggcaacgtgaccaagccaggaggacatgcgctttggggtcagaacttgaacctggacactcctcacttcctttgtcatcctgctcaagccctctcaccctctaaaccttagtttccacctccagaaaaatgatgcaaaccctcccttcatgggcaagttggacaacagaacccgttctgggccacaggtctgatacagacctttgtttgtttgtttgtttgttttctgcagtggcgcaattttggctcactgcaagctcctcctcctgggttcacgccattctcctgccttagtctcccaagtagctgggactacaggcgccagccaccacgcctggctaattttttgtatttttagtagagacggggtttcactgtgctagccaggatggtctcgatctcctgaccttgtgatccgcccgcctcagcctcccaaagtgctgggattacaggtgtgagccaccgctcccagcccagacctttcttactgacagaatctggtctgggccagaggtctgatacagacctttcttactgactcatggataaaaacattgtctctccagaaccaaaggccaggcatgggcagccatgtggcccaaggtctagtctatgagagagtgggggcagtcccagccccttgaagactgggggcagccccttctcactaggcagggctcagctttacccacttcagtagaggatttttcagtttttattcaaacttcctgtttttcttcccaattacacacatcttttttcattgtagaaaacttagaaaatgcaagtgagcaaaaagaagaaaataaaatctttagacctggggtggtggctcacacctataatcccagcacttgggaggtcgaagcaagaggatgacttgtgtccaggagtttgagaccagcctgggcaacatgacaaaatcctgtctctacaaaaataaaaaattagctgggtgtgggtgacatgtgcctgtagtctcagctactctggaggctgaagtgggaggattgcttgagcctggacttagaggctgcagtgagctataaccatgccgttgcactcagcctggatgacagagtgagattctgtttcaaaaaaaactttaaacctaccacccagagataagccctgctaattatgtgaaagagcttttcttctctctctctctctctctctgtgtgtttatatgtgtttggggatgggtgcacactcttcataaacttttttttttttgagacagggtctcgctcttttgcccatgctgtagtccagtggcatgatctcagctcactgcaaactctgcctctcaggttcaagagattctccagctcccaagtagctgggattacagtcatgcaccgccacgcctggttaaattttgtatttttagtagagatggccatgttggccaggctggtctcgaactcctgagctcaggtgatctgcccacctcagcctctcaaaagtgctgggattacagggcatgaaccaccatgcccggccttcatcaattttttaaaaacgactttattgaggtatactttatgtatcacaaaatttacccatttttagtatatcattcaatgatttttagttaactttttgagttgtgtgacaattactagctgtcgaacatttttatcacacagtgagatcccttatacttctttagtcagttcctgttcctgctcccagccccgggcagctgtggatctgtatgtgtgtgtgtatatatatatatatatatatatatttttttttttttttttttttttttttttttgagacggagtcttgctctgtcgcccaggctggagtgcagtggtgcgatcttggctcactgcaagctccgcctcccaggttcaaacagttctgcctcagcctcccgagtagctgggattacaggcacctgccaccacgcccggctaatttttttgtatttttagtagagatggggtttcaccatgttagccaggatggtctcgatctcctgaccttgtgatctgcccacctcggcctcccaacgttctggaattacaggcgtgagccaccgcgcccggctggatctgtatttttataaattaaaatagggtccattggttcacagctgattggaatctgcttggttccatgtcaacagccagacgacagtaaggtttcctcttattacccacctgattccctgtcgatggacacctaggttgttttatctttataaactgctgcagtggacactgaggccggtttttttctttgtttttttttttttgtttgtttgtttttgagacagagtcttgctctgtcacccaggctggagtgcagtggcgcgatctcggctcactgcaaactccgcctcccgggttcacaccattctcctgcctcagcctcccgagtagcttgggactataggtgcgtgccaccatgcctggctaattttttgtatttttagtagagacggggtttcaccgtgttagccaggatggtctcgatctcctgacctcatgatctgcccgcctcggcctcccaaagtgctgggattacaggcgtgagccactgtgcctggccactgaggccagtctttgcccggatcctcactgtgttcctaggatgaggttctgggaggggaattgctggtcagaggtcgagcctgcttttgaagcttcttctaccaggagtggagctgagcaggtttgataaggtctgaagatttgggggtggaaatgccaggtcccttgagagacatgagggataagagggggccaggctggccttgagtgccagagtgcagagctgggctagatgtgaggacagtcgggggtcagagcaggggcacaccgagcttcagttccctctggctgcttggatggaggatcgtaatgtgaacagaaaacactaattgagtacttactgtgtttcagacagtgtgttgataatcccacttaatcccctgacaaccccaagtaggtagacatatgatgaagatgacggccttgaggaccagagaggttaagtgatttgcctgagatcacacagccagatgatggcaaagccagaattcaaacccaggctgtgggctccagagcctagctcttaagctcttaagcactgggctcctaagaatggggatgaggggttgagggaggctcctccacaggggctactctgggggcctggaagtgggtcacagaggggtcagaggctatgtggctacctccccatcccagtccagagcagtgtttgagtcattagactgggaaccagccctggtgagccagccaagggccttgggccccatccggtcctgctgcctgccacagccaaactcttgtcatgtgaatggatttggggatggagctgcctccatgagtccttgcatctgtgggtgaaggcactgccctggctatagtgtccctgggtttgagtcctgcatctgcaccaagacctcaggtgagcctgtctccttctgggcctcagagtaccttgcagctgtcgggggaggatggatcaggagatggccctgtacctgtgttggggattattgttaagcccgtggcagtcttcacctccctgctgaggattaatttatccaattttgcacaagcttatgagtgcagaagaggcagacggaaacagagttctggccaagagcctggaacagggcctcggggtctctttcctatgcctggaccccgtcatgtctgctctttgtctgtcggaccccagatgtctgccaagccccgtcagaggctgcttcccagaaagcccttctgggtgtcaccttgccccgagcagtgcgttctcagagttctcccgccctgatgtccctcccagcatgcccagcccagccacaacagggccttgcttctagtcatgtgtctggctgtttgctgggtccaggccagccctggtagggcacaatgggggcccgctctgccaccccatacctctccccaggatatctcatgccccagttctctccctagttccaccaagcactggcactccttagaaaacacagctctagactagttactgccctagcttacagcacagaactcccctggtctccaaccattcatggctccctagtgctccaagataaagttcccttgtctcagccgggttgggagttaccttctgcccaacattcacctagctggacacaaacatcctgagtgacccggtcagctccaggcaggagtcactgccagcagaggcctgggatctggactttgcctgctgacaggtggagcccaggccggccagaggaagtgcctctgaccttgtctcctagcagccacgggccatgtggacatgccttttgaccctgggcactgacagtgtgtgacagcctgcaccatgtgctccacaggggcggctgtgtgtgtcgggggtgaggtggggaaagccttaactggctcaggggtgagaggtcagggagccattgagactggctccaggtgtgggtcccctgctgggttggggcttgtgggaggtgggacggggctgggggtccatccccctagggggaatttgtggcctaccccgaaccctgtttgagctcctttcctaactgactccccgtccctgcacctgtctcccagcaggccttgcctctgcatgctgcccctgccaggctctggggtccctgtgctccctgcagctagaaggctgggatcaggggtcttaacaagcagccctactgtatgaccttggacaagtccaagaaccttcaggttcttaacaatgtaaagggagcagtactaaaagcagcttcttggaattgtggggatccgatgagtgaaggcttaagcagtgcatggcacatagtaggccctgaaccaatgccagttagtgttattattatcaccatttagccagatgcagtggctcacgcctataatcttattgactttagaggctgaggttggaggattgcttgagaccaggagttcaagaccagcctgggcaacatagcaaggccctgtttgttttagagaaaacaaacaaatcaccatttagagcacctaaccagtacctggcacgcgataggtttagctcaacaaatgttagcagcaattacccaaggagcctgtgctggaagtttctaggatgtaccaggctatggttccaagttctgagcatctaccatgtggtggtctggagttggtgagagacaggatggggctgactaggccagtggggagcaccccccgccatggggaacaagcaccctatccttggcttccatggaagataattgatgctgggcacagtggctcacgcctgtaatcccagcactttgggaggctgaggcagggggatcgcttgagtctgggagttcaagaccagcctgggcaacattgtgagacccaaactaaaaaaattagcttggcatggtggagtgtgcctgtcgtcccagctactcaggaggctgaggctaaagctggaggattgcttgagcccaggaggttgaggctgcagtgagccatgatcataccactacactccagcctgggcaacatagtgaggccctgtctcaaaacaaacaaacaaaaagaacctgctgaggaagcagtgtttctggctgggggaggacgggcagagtggccatctggccacagatggcggtttctgtgcaaaacacatcaaggcagccttggaaatgtgagtgaaagcaccttcaaagttctggtcacagccttgggactaagcaaagccaccaaaagtacataaaagacaatgaccatcacccagtgccggtgatgctagaaggaaagggaatacgttgtagggaaggttgtaaagggctttatcttttccagactggagcctggcagctcgaaaacatcttgctgccttcatatgagctttaaaacaagctgcagagaaacaactcaagagggagaaatatatatatatatgtgtgtgtgtgtgtatgtgtgagtgtgtgtgtgtgtgtgtatacatatatatatatatatatatatatatatatttttttttttttttaagatggagtctcgttctgtcaccaggctggagtgcagtggtacaatctcggctcactgcaacctccgcctcctgggttcaaatgattctcctgcgtcagcctcccaagcagctgggactataggcacataccaccacgcccagctaatttttgtatttttagtagaggctggatttcaccatgttggccaggatggttttgatctcctgacctcgtgatctgcctgccttagcctcccaaagtgttgggattacaggcgtgagccagtttgtttttagagacggggtcttgctctgtcacccaggctggaataccatggcacaatcacagctcgctgcaatgttgaactcccgggttcaagggatcctcccacctcagcctccagagtaatggagactacaggctcatgccaccatgcccagctatttttaaaactttgtagagatggggccttgctacattgcccaggctggtcttgaactcctgggctcaagtgatctgcctgcctttgcctcccaaagtgctgttattacaggtgtgagcccctgcgcctaaccttagcactgccattttgactgaaaacaggtgcccagcagcaggggctactcccagaattgccactgcatcaggcccgtgggttgttttcagctgccagtgataagtatgtgccctgggccacctctcggacaaggtgtctgaattggtgccgaccagcatcacatgtaattgccatctcgcaggtgctgctgagggtaattccgcacacctgtagctccgggaagagcctagtggggaggaggaaacgtggctctgaggtttatagggtcagacggtcagtatgttgggagctggcatgtggaggggcacagacaagggaagaatgggaggtggcatcagagcaagttttgatggaggaataggaattcaccaggtggaaagggcattcctggtggagggaacagcctggccttcaatagcttgtggtgttcagaaagcaggcagggaaagggaggcccagggagacaccagttaggggatgggggtggaggcagacgagggtggaggaagccatggctggagtctgcacggcctctgactggggtccctgctgtggtcagccctgtgctgggtgaggctggggtcacagctggttcaggccctgacaggaggggcccccagctgaggcccagcctctaatttggcagggcaggtggataggtctgggggggtggtggttaggaagcctccaggaggaggcagtgccggagctgagccttaaagagcttcgtgttgtcctctctgtctttgcactctgcacacactcactgaactgcgacaaatgaggatagctggtcagggcagaggcaggccggagttggggctcactgctgtcccccacaggctggggctgaagggcaggctctggggccgcagaatggggtttgtgtaccagattcttcatatggcagctgtgggactttgggcacgaggcctccgtctgagccttagtttcctcaagaggacctgcgcccaggtgcacctggggctccagccatgggtgcgtcccattccgggaagagctggcacacacttgtgcccccggggcagccatgagtgcacaaagggcagcctgtgccactgctggatacacgaccagctgagaacacgaggaccgccgactccagttaggaggatcaaggaagtgcctggtgggagcagaacagcaggtggggtgcagcccagctccctggagggatggtgggcacccatcctcaccctgctgcctccattagcaggccgagagggtgtgctctggaatcccatgagcacctgtgccacatcctcccctgtggctgacccttcttcacagttggtgcagctttgtggtctgtagtgcagggatcaattggcaaatccctttcccacccattccctggagaattggggtccttggctcagatgacagaccaacctgagttggaatcccagctccttggtggccgtcctggcctccaccccctcactgcctccgctcctcctatcctgcccacgcccactgcagggcctttgcacacactgtttcttctgccctcccttccggcccactccctcatatcattcagtcctcctttcagatgtcacctcctaagatgggctgccctgaccacctcatctataatggccccagtgcctggcacaggattggcacacagtagatattgtcagagatggatctgggttctgtggacaaggctgtgggggcaggtgaagagctccctcttccaggaggttgtttggggttcaaggccttgtttgggttgtaggcttctgtgctggtcagcgttgggccctacaagcgcatgccatgaggcctgcccaggatttccctcatggcctcacagaatacatcggccagagtcattaaagggcgcctgcatctgccttcagagagaggtttgaaggtagaactggggagggatgccaggtgggggttcaggtttcctgttgggtcctgatagaatcagggcaggagaggaagaagaagagggaagaggaggaacccaggcttggggaggggtggcagggcttcacaagcctggggaaggtgaactagggagcagttggggccaccatggcccagagtctatgcctcctcttccttcctgtgttcagagtgtgtgtgggaaccacaagggccttctcagtgttcatagggaagcccggttcacccatgggtgggccgcaatttgggtgccacagtgagcccctagagaccagctctcccagcttccaggacagggactaggggaggcaagagaggctcttccttaaattgtgcacccaaggtgcctcagctgccttactctagactggccccgttaactccccttaaaaaaaaaaaaaaaaagactcagtcgaatggtaatggagctccaacgtgaatactgcaagtatcaggcaactcactacctgactttccagttctaaaccattctaattgctgtagagagaactaacctttgttgagactgttgagtgatggatgttttacacacttgctttcccagaattcccacctctggagatcgtaggtgtgggagctcagagggtggggagtggactgtccccatcacacagcaagggaggggctaaaggaagagcagggcctggcatgcagccccagatagcccacttgggtgtgtctctgagggaggctgcagggctggctctagagtttcctttttcagtcttaacctggtgaccagcttccacagaaattggcacggtgactcatgcctgtaatcgcaacacattgggaggccgaggtgggaggatcacctgaggtcaggagttcgagaccagcctggccaacgtggtgaaaccctgtctctactaaaaatacaaaaattacatttcattacaggtgtggtggcgcacacctgtaatcccagctactcaggaggctgaggcaggagagtcacttgaacccgggaggtagaggttgcagtgagctgagatcgtgtcactgcactccagcctgggtgacagagccagactctgtctcaaaaaaaaaaaaaaaaaaaaaagaaattggccagtagatcagccccaggggagagtgagccagggtttggccaggccttgagtttcagaggctggccatggccagtggcacccaggcccttcccccttcctcggggcatcttagcttagtctgtgccctctgcccaagggccagccctctgttcccaggtcacaccccctcctcttggaaggccccccccgccccacccccatcagagtctttaatgactctgctgcccctggggctcagagagcaaccgccctctcccatcgcgcttcctcagtgggatgggagggggttagagcaggaagatgagacaaataaagacacaataagaggcaggaatatgtggtaaagccaagatgggtaaggggaggggacaggcttgactgttcacagtggccctggccctgctgtctcaggctagtatctgcttgttggtctcaccacattctaggctcagaaactggggagcaaagtaatgaaagaaccaggctgggaggccatggggaactcatgcctggagttcagctctcagtgtgcttttgggtcaaggacgcttccctgtcttaagtcactcatgtcagagcctttgccaagagcaatgctgtgttttgttttgggggtgagggaacacccgcgggctgaggggagggttgggccatgctagagaggccgtctgttgtccttgaacctcccaaagctgggaaataagggcctgggctggacggcggtggcgaggacaggttgcgagagagacatggctgggttttcttgcttagggtcctgaatagagagcaaggttgaggccgcagggaccccagcccccaatggactgctgagtcgctgggtctgcccagggttcaggcaccctctcaggttgcagccaactggggtgtggaccaggcagaggcgctggcctgcagtttggggcagaggcaggctttgctggtggtctacttggctgcaaaatcaactggccaggctctgatcactttgtgtgtgtgtgtgtgtgtaacttttacctttgacaaaagagggaagacaggcccaggcacctcctcaaaagaaccctagagcctgtcaccccttccttacccatcttctgtcctagggactgcagcccttcctggcttcccagggccctacaatgaatagtgggtcgggactcacttggtgactgctgggttgtgaggccttgagggggaggggcagacttcacccatctggcagagggacatcggtgctggcagtcaggaaacccttatttccaggcctcagtttcccggaagtgacctgttttcaggagtggcctcatcccagaccatcagccccgctgtggtgaggggtggccccttcctggggctgccctagaagggggaggtccctgcacccaccgcagctgccactcggcagcccttggccttaattaaacgcttcttgcgtactaagtgctgcacccatattatctcccttctaccattcgacgccagggagataatgactgtcctgttttctggaggagtaaacggagggttggagcggttaaggctcgctcagggtgccagcgaaccagtgatttcgaacacagagttctggtgtgttgggccaggacttctctgctttgaccctttaacgaagggggcgggagctgagggccagtgaccgccagtaaccccggcagacgctggcaccgagcgggttaaaggcggacgtccgctagtaaccccaaccccattcagcgccgcggggtgaaactcgagcccccgccgccgtggggaggtggggcgggggccggggccgggccctagcgaggcggcagcgcggccgctgattggccgcgcgcgctcaccccatgcccggcccgcagccccgaagggcggggcggggcgggacctgcaggcggggcggggctggggcggggctgggggcggggcggggcggggcgggcgcgccgcagcgctcaacggcttcaaaaatccgccgcgccttgacaggtgaagtcggcgcggggaggggtagggccaacggcctggacgccccaagggcgggcgcagatcgcggagccatggattgcactttcgaaggtatttttggaggcctccccaccagccctttatacaatgcctccgtctcctgcaggttctcctggggtgggcgggcatgcgggctacgcaacttgagcaggaaagagccccttcccgagggagaaggtgtgacagttaccagctcgctggggaagtggagggctacctccaaccaaattagtgtcccctgcaactcaagggggaagggtttgcttagagacccaaaagcagcatcccgacctaagagggtttggagggagagggtggtcttctctacattctctgcacccgctttgggacaggaccaggaggaagcagggaggagggcccgttgtccctctgccacagcgtctgccctattcagcacccctgcctattgtgggcatcttagacttttcaggaagacagtgggagccctagattgtcaaaattgtcagtttttctttcaggcctcagtttcccccatctatcgaagaggctcacacggactggggtaaagggatgggaaaccctgcagttgaaagtccattatgacttgatgacttgtgacctggggggtccacaaaccaggagagtttctacttgagaagccaggaagactggggctgccaccccatcctgttctgccaactgctctaggaaattcccctcctgcagtagcttccctgcctgggtacctgtcagtaggcaatgttgggtctccactcggtgccagctgcctgccaagcaaagcctcgggcagccgtaccaaaaggggtttagtcttttctgttgtacagatgaggaaactggggccagtgagaggaggctgttggtccaggctccacttcaagctggtggtgggcagggctgggagctcaggctggggatcctgagagcactggaggcccccatgggtcctgtagagcattctgacccagtgggtgccaccacgagtgggttagagggccctgggctgagccagataggctgctagtcaccagctgggggagagggcccttggccaggtggggctgaggtgggagtgtgtcccagtctgtatgaggaggaaggagtcaggacagacagcacttgcttttacagagatgaaatcaaagccctgagtggccaggcctgggtcttgaggctacttggctgcaggcaaagcctggacttgagcccagaactctacacagagacacactggttggccatgtggccagcagctggcttggccctaagccttggtctgttccactgagtaatgggttggtgatggcagcctggctcttggcttcttagtggggcaagaaaaggcagagagacaatagatttgggattttgtagacctgggtttgaaccccactgcatgctcttgggctgcttgtggtcctccctgagcctcagtgtcttttcttgtctccaagatgaggtgagctaatcttttgaggtagtctagggtagtggccagtggttggggcattggagtcaaaatagggtctggactcagttgagtctctgactctataagaacttaggccagtaagtcacctctctacagctcagtttcttcacgtgtagaatggggccaatgatcacatcaccctctcagctgtgggtgaggattaggggtctagcctggccccatcaatgtgggtagccccacagcgggcctggcttttggaccagacccacccttctgacatgggcccccacccttagagtccttctagtgtggatgaggaccctgctctgatctggggtcctcttgggggacttccctgtctgccattctctttggggatcctgcgctgccctaggaagagtgggcccaggctgcacagttggtccttggtcacagaggatcccaccacttcttcagggcctcaaggcaatcctgcctctctctgcacccctcttccccctgtaaactgaggggaggggaaaatcacccactcctcagcagtttctaagttgctttgtcaaattcagtgcccagaggatcctgctgggggtgcgttttaggatgagaccaggagtggccaatggtggggtgtggggcccatcgctcctatatgaagaccccctctgccctagactgctcctccctccccatccccatctccatcccaaagactggagctgctggatctgtggatggaggcgtgccccccgtttcacacattgagaaacaggccccaagtggagccagggaaggctgcacctgggcctctggattccttttgttctgtgtggggttgggggtgatggactgtggagagggcaggagagctgtctggaagggttggtcacctcatgggcaaatgcttggaagctggtctgagtccacggtgcagtgtgtatgtgtgtgtgtgtgtgtgtgtgtatgtgtgtggactcagaggtggatgtcttgtagaatgcatgccccatgaagacaggagtaaaagtttaccaccatccacatcaagctacaggacactcccagctccccagaaagttgcttagttctaggcagggatttcccttattcacagccgggagcagtgcctggcatagtgtgggcactcagcactcagcacatgctcactggatgagtgaatgaatgtgagcctgctgtttgctgtggactaaggatgtttctagatgtttgggcaaataccggatggtgggaagagctcaggctctgaagtctgcagtcttgggcccgaccctgggctcagccccagcctagctgtggggcaagattgtgagccttgtggtgcccaccttgtccaggtattgtgatgcactcgcagcagcaggcattgctttagacagcacaggtgctcgcaaaatggctgtatgtccgggaacaccagctcctgtgggtggctttctgtcctggtggcattgcccacacatacagctgtgtgccaacaagggttgtgcaaataaggttgtgtttggatgtgtgtgatgccctgtttgggggtcagtctctgcctcactcacgcaccctcttctccttttcacagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggtaagggggatgtgtggcgggaggggacacccggggtggggcttccaggagcacaggaagaagcttctgctgtgatgtgagtagaggtctgtgcaggctttagaaactggggctccactcggctgcttgagatgccctgttactagcagtcctggtgtgcttgttgccggggtaggcgcaacctcgcactggaggcctggcttgaagccagtgcatttgcatcagagcccaggcagggactgtccataggaagccacatggggcaatgactcatccaaggccagtcggtgatagagacctgaagagcaggttgaaagtgggagagggaggtctgtgtctgcagccccatgctttatttctgcaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtgagggggtctggccaggggttggggagggggcagccccagcccagacacacagcttacagccaagcctctcccaccctcaggtcctgctgcagccccacttcatcaaggcagactcgctgcttctgacagccatgaagacagacggagccactgtgaaggcggcaggtctcagtcccctggtctctggcaccactgtgcagacagggcctttgccggtgggtgacgtgggcagggcataagggagtggggtctacacacacacacacatgcccacctggtaacatgtgcctggccctgcagaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaaggtgtggagaggcctgcaggggcacagaccggggtgtccctaggaaggaacagatcaggggcaactggaaggaagagagggagtgagactgagcctggacaagcagggaattggaattcagcctccccaggcctggccagcctcgtttatttagttaaactggtttgcaggcctcttcaataaaggtggggctgtgctaggcattggggatgcagcaatgaacaagacagacaaaaattgtccctcaaagaagagccgaccttctggtgggggagatggacagtaggcaggatgaataagtgctcgagaccaccacgtttggctcgttgcagagaaagcaggaagaggatggtgagggtcccctggtggtagccagggaaggcctccctgagatggcggcaggcacagcagcagctagccagaccctgctgtctgcatcttacattctaaccctatgcccggcctgggaggtgggtgctactaggcgaggaacggttcaggtagaaggaacaagtgcaaaggtcctgaggcagtaatgttgcaaagcagctccgcacccccttgctagggctctccaaccccacaacccccgacctgacaggccacctgtgcgctccccctccctcccacaccgtgcagctgaataaatctgctgtcttgcgcaaggccatcgactacattcgctttctgcaacacagcaaccagaaactcaagcaggagaacctaagtctgcgcactgctgtccacaaaagcagtgagtcctggctttattgagctccagtctggcctcttctctagccttgctccacctcccggccccaccccatccctagccccaccccacccttggttctggcccaccctctgccctgcccacctcacccttggctgtagccctgcattcagctctagtcccttggttacctctggtcctgaaagagacctggtgcctccctttggccctaacccagccccatcaaagcgtcctgggctagctttaggagctacagtagtccctaggcctccaagggcctaggctctgatttggggtcacatatccagcctttactcctggctctgttcctttcggcccacagaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggttgggccctgccacggtgcccccttccccactcccagccatatcctctgagcctcatgacagggccgggaagaccctaacagatcctacctcccatttcatagacagaataactgaggcctggagccacgtggggtcccacagtaaggtgggcagaatcctgaccccccccttcccagccccatgctctctggggtccctccgattctgccctcaccaccctgcccaaccccaccaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagaggtgggaccggccagcctgggcatctttgggagggacactcggggtgagcccccaggcttgtgaacttggggctctggatttcctgggagctgtgtccccagctttccctctgtccatagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccgggtaaggggctggccccggcagagtgggcagggcagggaccccaggctgtgaaggtgctgggtgtcaacccttgttcctgctccctgtgcacaccatgaatctgtcccgtcctccctgtgcctagccacgcatccgcagacccccaccacccctccagagcctgctgtggacggctcttctgagctttggggcagctgctctgacctcacttttctcacctggaaaaccctcatccacagggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatgggtaggactgagcgtggggcgggctccgaggtgctccctgctgcctgtgctccacccacagcctcatgcctgcttgccttccagggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacagtgagtgggttggggggctgggggcttatccctgcagctctctccagaggctccctgggtaagagctacacgggatgtggcagtggttaccagggggactccaggccaagctgggactcggcccggggtctggccccaggctgtgtccactgtgacagcccagtaccctcccctacagcgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccaggtgctctcttaccccttccctgtcccctctcctgtccctcatcctcattcctgtcctgtcccttgtcgcctgaatctctggctgtctctggccaccccagtccttctccctgccatgggttgttgctgtgggggttgcaggaagggaaaggcctgggtgcctctcgttcccattggggctttcagaagcacatgcagggattgatgggcagatggctaattggagaagtgaccccaggcagtgccgctgtggagtaaggaagcggagccaacaatggcatcttctcaagtcggttttcctttggaagcagtgtagggcaggcctcagtgttgtctcctggccaaggctggtgctggtgatagttatgtccacccgctttcccctgtccttggcaggggctgcacccaggggcatgccggcacttcccagtggccctaggtgtggccccagcccacccaggaaaaagcccttagcttggagaggagggtggggccctgctccccaccccactcacctcctcctctccacagtggaccccctggcccaggtgactcagctattccgggaacatctcttagagcgagcactgaactgtgtgacccagcccaaccccagccctgggtcagctgatggggacaagtaagtgtcgttgtgccctcctccaggcaaggcccctccggcgggattctgagaatagctctggcctcaaccctgtggagagagcccagagctgggctaccgtgcgtgccatgcacgcttcattcctctctgagtttcctctccccaccagcctgtgggaggagacagtggcactttgcagagccaggggccaggctgtactctggagggcaggtggggagcaccctcctaggacccctgccatctgttccgacagccagctctctccttccacagggaattctcggatgccctcgggtacctgcagctgctgaacagctgttctgatgctgcgggggctcctgcctacagcttctccatcagttccagcatggccaccaccaccggtgagtccccggcccctgtcctggctcccttctcagctcccccgtgcagcgtgactgagggttcaggggaccctccctcttctgcaggcgtagacccggtggccaagtggtgggcctctctgacagctgtggtgatccactggctgcggcgggatgaggaggcggctgagcggctgtgcccgctggtggagcacctgccccgggtgctgcaggagtctgagtgagtgcacggcaggttcctcctgcctggtcccgggctcagccttcctcatcccctgggcactgtgcctcactcagcctttgttctgtgcaggaggagtcaccaccttttttcctcagggaactcgagccagggaagtggggggcactcagccagggcttgtggactggtctgactggcactcttctgccctggtcccaacaggagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggtgaggggtggggtcaggggcctggcagggctgggggattcagctttccattccctggttcctctccccagcccccaggggctgcagaagaccatggggttagcccaagcagcacaggatagggggtccagcagaccctgctttttggctaaggcttctgtccagaggagaggggttgcccctatctggcctcagtttccccatccctgggaggaggggggtggatggtgtggtaggatccctttggaggccctgcatcaggagggctggacagctgctcccgggccggtggcgggtgtgggggccgagagaggcgggcggccccgcggtgcattgctgttgcattgcacgtgtgtgaggcgggtgcagtgcctcggcagtgcagcccggagccggcccctggcaccacgggcccccatcctgcccctcccagagctggagccctggtgacccctgccctgcctgccacccccaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgagtgcccgatggccctgtcctcaagacggggagtcaggcagtggtggagatggagagccctgagcctccactctcctggcccccaggtgttcctacatgaggccacggcccggctgatggcgggggccagccccacacggacacaccagctcctcgaccgcagtctgaggcggcgggcaggccccggtggcaaaggaggtgagggggcagctgctgaccagggatgtgctgtctgctcagcagggaagggcgcacatgggatgtgataccaagggaggctgtgtgtgtgtcagacgggacagacaggcctggcgcagtggctcacacctagcactttgggaggctcagttgggaggacagcttgagcccaggagttggaggccgcagtgagcctgagtgacagggagagtccctgtctcaaaaaaaaaaaaagaccaagcatcttcttgatggttacctgatgacaattcctttcacaaggaatcagtggggtgactgtcatttgtgggatacatgactgcacgtgcgtgactcagtctgtggactttgtgtgtgggctgagactagggtggggagaggggaacccgccaggcccccgccaggtacctgtgtgccaggtacaggcggctggtgccgtggcttgtgtgtgggcagggctcccgcgggggcgtggccagcttgagacccatccctgacacatcctcgtgtgcgcaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgggttttgtgtcttcagctgatggatgtgctgactagtgagagtgcttgggccctcccccagcacctagggaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactga

SEQ ID NO: 36139 - DNA, 148252 bp, Homo sapiens
tttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgaggtgaggaggttgggggacaccttgagggattagttggcaactcgttagcgctttggacagggatggtattgcgccagtgctgtctggcctttgggcttggagaaggaacggagatgatattttccaagaataacgtgactccccgatagggtctctggttttgttctcctttattctgttgccttctttcttcattctgaactccatttgcttctttccgagtgttcttttagggtatgaacaagaggagagagcatcttgaggtgtttattcttttcttcagggtatgcgaacaagaagggcgagatttacatgaagttaaagtgtgtgtgtgtctgtgtcttcaggaatttaaagaacaattttggatggaatgagaatgtatggtgggtgaatatttttaaagaaagcatttgaaattccagatatgtgtggttattgcactgtataagcttgattaaacatatatttttgcttgaggggtggtttacagacagattctttgatatttaacaaaatatgtatcttctccacagtttagagaattccagttatattctggtacttaatagaccactaatgacttctggcattcttctgttacattctatcttttcctacttcttgaatctttcaaacttgtgttttgctgtagcagagactgaacgggaagcaagtggaagcaaatgactttctaaactctctcctgttctcatttcttaaaggagttatacagatctacttcttgatgttttaaagattgtttaataaattaggttgttgtaaaaaaaaaaacaaccaaaaagcagtggcaattagggtacaaggaatttcctatgattctactgccttttctcttcctttttgcaaattaggagcttccctttcaggacccctactggccataccctctttagcctacctccacatttcttcactggttcatcatgtaaacttccctacagtattaggaaagcagtcatccatcaagttgattgtactacaagacttccatgctccagttttagctacagagtacttagtgtgtttacttagggactgaaattctcctgggataggacacgcagtggtgtgttaagggtcaggtaggaaaggaagcaaatgattttgttgattgtgatacttggatacttggtttggaaaatcaggactgcccattcggcgttactttgtttttttcgaatacagcagaaatgtaatcttaagtgaagagaatattacacagtttctttcattcggtaggaaatctccttagaatcgctttattttatgtgggtttttttttgtttgtttgtttttttgagacggagtcttgctctgtcgcccaggctgcagtgcagtggcgcgatctcgtctcactgcaagctccgcctcccgggttcacaccattctcctgcctcagccccctgagtagctgggactacaggcgcccgctaccacgcccggctattttttgtatttttagtagagatggggtttcaccatgttggccaggatggtctccatctcttgacctcgtgatgcacccgcctcagcctcccaaagtgctgggattacaggcgtgagccaccgcgcctggcctgttttatgtggttttttaaaagtttctctacctcccccgtttttcattaatgttaattctagtgagtaatttctcttaaggcagagatactgtttttttttttttttttttttttttgaggcggagtctcgctctgtcgcccaggctggagtgcagtggcgctatctcagctcactgcaagctctgcctcccgggttcacgccattctcctgcctcagactccggagtagctgggactacaagcgcccgccaccactcccggctagttttttgtatttttttgtgtttttagtagagacggggtttcactgtgttagccaggatggtctcgatttcctgaccttgtgatctgcccgcctcggcctcccaaagtgctgggattacaggcgtgagccaccgtgaccggccagagatagtttttttatttttttttattttttatttattttattttattttttttgagacggagcctcgctctgttgcccaggctagagtgcagtggcgcgatctcagctcactgcaaagctccgcttcccgggttcacgccattctcctgcctcagcctcccgagtagctgggactacaggcgcccgccaccacgcccggctaattttttgtgtttttagtagagacggggtttcaccgtgttagcccaggatggtctcaatctcctgacctcgtgatccgcccgcctcggccttccaaagtgctgggattacaggtgtgagccaccgcgcccggccgaggtagttttttagtagtcctttactcctataaattactttttttttttttttttgatgatctgttaatagtccttggtttagaggcttttgcatacttgagttttcaccaaaaaattcttttcaaaccagtgaggcattacagaccagtgaagatattgtataatctaaaatgtgtctcttcactttcatcagtccttgaggaaggtgtaacttttttttgtgaccatatgaggaacacatgtaacctttgtggaagaaatagaataaacttttttcaaggtcaacagaatattaaaataaatgaaaaaaattaaattcactaatacaggatcaatgtaaaattatcttcaacaaattagttgtccagaacacaaagggctggttcaataactgttaattttactctcagcagaacctagaacaaataatattcgtttgtttttaatttaaaaaatcttttttttttttgtagagacgggggtcttgccatgtttcccaggatggtctcaaactcctgacctcaagcgatcctcccacttcagcctcccaaagtgggagccagacaaatagttattttgggaaaaatatctttgaagtttttctttttaattcaattaaaaatttttgaggttaggtaagcagttctcatgagacatttccaaagcttttgcctttgtattgttactctgtagttgaaaacttgtgtcagatatggtaggtgacattgatttgattacaaaataatacacttatattattgaaacttcaagcttatatttcagggttaaaacaggcaaggcggtgatcttttaatctaatttaggaaattaggtaaggcagagtttcatattttaacaaaatgaaaatgtatgattatacagtccgtgaaaaaggctggtataaccagactggtagctttaggaacttttaaattatgtgcactttttggtccctgtcatagatcacctagaattcttgtgctttttaaatttttttgtgagacagagtttcgctcttgttgcccaggctggagtgcaatggcgcgatcttggctcattgcaacctctgcctcccgggttcaagcgattttcctgcgtcagcctcccaagtagctggaattacaggcatgcgccaccatacccggctaattttgtatttttagtagcgacggggtttctccatgttggtcaggctggtcttgaactcctgacctcaggtgatctgcctgcctcggcctcccaaagtgctgggattacaggcatgagccactgtgcccggtagtcttgtgcttttaagtagagtactttaacttcactgttgtttgttatttatatagtgtattacagtgagttcattgccctatagttcactgcctataggttcattgcagaaccatgactaagttcattctcttcaggaacctacattccaaggcatcattatttacattatattaattctataatctactcatgtgttgtttttcgtatctcaaggtggtgctgtgagtaggtggtgtgtttatttttgagatagggtctggctctatcgcccagtctggaatgcaatggcatgatcttggctcactgcaacctctgcctcctgggctcaagtgatcctcccacctcagcctcccaagctgagactacaggctcatgccaccacacctggccaatttttgtatttttttctagagacagggtttcaccatgttgcccaggctggtctcaaactcctgggctcaagtgatccacccgccttggcctcccaaagtgctgagattacaggcatgagccaccatgcccagccaagtaggtgttttaaactgtttttcgacaatggtaatgagattgcataagtgatttttctctcctaactcttctttatgacctagttcatctgcaagatggttggctgggattccgggtgtggtcaagattttagaaagtgttggccgggcgcagtggcccacgcctgtaatcccagcgctttgggaggccgaggtgggtggatcacctgagttcgggagttcaagaccagcctgtccaacatggagaaaccccatctctactaaaaatacaaaattagctgggcgtggtggcacatgcctgtgatccgaggtactcaggaggctgaggcaggagaattgcttgaacccgggaggcggaggttgcagtgggccgagatcacaccactacactccagcctgggcaacaagagtgaaactccatctcaaaaaaaaaaaaaaaagatttagaaagtgttttaagtattcctttccaaatgcagaatatgtgaccttggactttttagcaaggttctgtaagtggaagaaaattgacattaaacaacagccttaggagcctcttctgtgccaggcacttgatagctgtttctcattagagaaaacattataatcaagcaggtactgttttcctaattttacaagtcaggaaactgggattcaggttaagtaacttgtccatagcgacctggcttagaagtgatggggttggaattcaaacccagtgctctggactcgaaagtcctctttattctactgctcaacaactgacataaattcaccacagcttttgtatcaacatcctacgtaacactgacccactctgttttgatatacatagtttttctgtagaagtgctgttttgcatgaatgcattcatgatgtgatcagggcttttggtactggtcctcccactcccaattttttttttaaatgcctgtcgcgttaaaaatttgggagttggggccgggcgcggtggctcacgcctgtaatcccagcacttcgggaggtcgaggcaggcggatcacgtgaaaccccgtctctactaaaaatacaaaaatttgctgggtgtgatggtacgcacctgtaatcccagctactcaggaggctgaagtaggagaattgcttaaactcaggagacagaggttgcagtgagccgagattgcgccactgtactctagcctgggaggcagagcaagactccatcaaaaaaacaaacaaacaaaaaaacacacacacagaaaaacaaacaaaaaagcaattataattaaatttgagtagaggagatagataggaatccaacagttatagaatagtgccaggtgctatggtggaggtatgcacaactcacttaagaaacatgagaagggaccccgggagaggcagggtcttagtgaagactttcaagaaaaagtgatacttaacgctgagtagcagttgccctgggaactggctcgaaattggggagctcaagaaacagcagcaagtagtgtgactggagaggtgggttttacctcgggtgtgtggcaggtacctgatcttggagggctgtcagaaacgtttaggagtttgaactttctttttgttgttgttttttgggacagaatctctctctgttgcccaggctggagtgaagtggcatgatctcggctcactgcagcctctggttcccgggttcaagtgattctcctgcctcagcctcccaagtagctgggattacaggtgcatgccaccatgccctgctgatttttttttttttttgtatttttagtaaagatggggttttaccatgttgactaggctggtttcaaactcctgacctcaagtggcccacctgcctctgcctgccaaagtgctgggattacaggcgtgagccactgcacgtggctgagtttgaactttctctgtaaaatgccttttagggattttaagagattagaaagatgggtggcaagggagtaaagggtagtttgggagaaggtggctgcagactgcaagacatattaggaggctgttgttgctgtataggagcgaggcagtggagtccaagggaactaaggcattgcctgtgggaatggaggggagcagacagacaccaaaaataccaaggactgtgattaacccagttttgatgatcagttagctgtgaaggaggggaggggaggagagatggagaaatgacaccttggtttctagctatggagaaggatagataagggttgaataaggaattccagagaagcagcagattttggagaaagcacatgtttctttttttttttttcgtcttttgagacagggtctccctctgtcgcccaggctggagtgcagtggcgcaacctcagctcactgcaacctctgccccctgggttcaagtgattctcctgcctcagccttccaagtagctgccagccatgcccagctaattttttaatttttagtagagacggtgtttcaccatattggccaggctggtcttgaactccagaccttggtgatccgcctgccatggcctcccaaagtgctgggattacaggtgtcagctaccacgccaggcctccggctaatttttgtatattttgtagagacagggtcttgccatgttgcccaggctggtctcaaactcctgggctcaagtgatctgcccacctcagcctcccagagtgctgagattgcaagtttaattttggaccaccaaaaagatgagtccacatgtagacccccactctggccttggtgctctaacatctccatttctttcttcttttttctttttttttttttgagatggagtttcgctcttgttgcccaggctggagtgcaatggcgcgatctcagctcgctgcaacctctgcctcccaggttcaagcgattctcctgcctcagcctcccgagtagctgggattacaagcatgtaccaccatgcctggctaatttttttgtatttttattagagacgggatttctccatgttggcttggcgggtctcaaactcttgaccttaggtgatctgcctgcctcagcctcccaaagtgctgggattaccggcgtgagccaccgcacccagcctaacatccccacctctttgaccatttcttcccttgtaacaggcctgaggacctgaggtcccttttttcctcagaagatagttgctaccattcactttataaccaggactctttcttaagcctgggaggacagtgggatgtatcctgccaggccctttcctctccttttgttcattgtagacaagagacagagaatgataataaggatataaacttgcttcacaaggttggcatccttatcccctgttttacagataagaaaatggaggctaatagaaattaatttattgaaaggcacacaactagtaagtggtagaacctggactctaatccaggttctgactccagagttttctatcgctttactacctctaaaacaagacttaacctcagccaactgtaacctttttggcattcttttttttttttttttttgatggagtttcgctctcgtcactcaggcttgagtgcaatggcctgatctcggctcactgcaacctctgcctcctgggttcaagcaattctcctgcctaagcctcccaagtagctttgattacaggctcccgccagcatgcccagctaatttttgtatttttagtagagatggggtttctccaagttggccaggctggtctcgaacttctgacctcaggcgatccccccgcctcggccttccaaagtgctgggattacaagcgtgaacgactgtgcccggccacatttatagcattcttacggtcccttctgagataggaagtggaagccccagtggactttttgtttgtttgtttgttttttaagacagagcctcgctgtgtccccatgctggagtgcagtggcacgatctctgctcactgcaacctccgcctcccgagttcaagtgattctcctgcctcagcctcccgagtagctggggttacaggcacatgccactactgcccggctaatttttgtatttttagtagaggggtttcaccatgttggccaggctggtctcaaactcctgacctcaaatgatccacccacctcagcctcccaaagttgtgggattacaggcatgatgctggagtgcagtggtgctatcttggctcactacaacctctgactcctgaattcaagcgattctcctgggtcagcccctcgagtatctgggattacaggcgcccgccgccaggcccagccctccagtggactttcattcccgtttgttattgctgagagtggagctcatcaagtagccccaagctcttgtagggaaagaaggcagaaagacttctctgtgcaaagtgcattttctcacacggcacttgtagtatctagtggaaatgtcttcctgtaaacggttcattcaacagcgcttacagttgactagctgcatccctgataacagacaaacgttgctgtatggagcttcgtcctagtgggaggagagggataaaaaacaagcatggccgggcgtggtggctcacgcctgtaatcccagcactttgggatgctgaggcgggtggatcacgaggtcaggagttcgagaccagcctgaccaacatggtgaaaccctgtctctactaaaaatacaaaaattagccgggcgtggtggtgcacgcctgtaatcctagcaactcaggaggctgaggcaggagaatagcttgaacccgggaggcaggggttacagtgagctgagattgcaccactgcactctagcctgggcgacagagtgagactgtgtctcaaaagcaaagaaacaaacaaacaaacatgttcacataaggtgtcatttgatgagaagtgctgtgaagagaaatacttagggatggagtattgttacagagtatttctgtggcctacaggtacagagaacaatcagatatgtgtaacgtgtgcactttgaggaggtggtcttgaaaagaatttcagggatggctgggagcttgctcggggaagaatgttcccaggtaaagggaacagcaggttcagaaggccttgaggtaaactcattcttgagctgttccaggaatagcaaggatgccaagcatggttagagccttctgtgcaaggggcacagtggcaggaggtaaagtcattcattctttttttttttttttaattttttgagacagagttttactctgtcactcaggctggactgcagtggctcaatgtcagctcactgcaacctccgcctcgggggttcaagcaattctcctgtctcagcttcccaagtagctgggattacaggcatgcaccaccatgcccggctaattttgtattcttagcacagttggagttttaccatgttgaccaggctggtcttgaactcctgacctcaggtgatctgccggcctcagcctcccaaagtgccgggattacaggtgtgagccaccgcacccggccaactttcagtaaaaacttactgagatctcaactgtttttcaatcatttctgagatgtactctcctcccccttgttttcatcacattttaatatctttgaaattgagatgctgcttttttttttttttttttttttgagatggagtctcactcttgtcacccaggctggagtgcagtggcgcgatctcggctcactgcaagctccgccacctgggttcacaccattttcctgcctcagcctcccaagtagctgggactacaggcgcccaccaccaagcctgactaattttttttgtatttttagtagagacggggtttcaccgtgttagccaggatggtctcgagctcctgacctcgtgatccacccgcctcagcctcccaaagtgctgggattacaggcgtgatccaacgcgctgggccgggatgcttcttataaatagatggtgtaatcaccgttggccaggtggcagttgtgacatagttgtcatttcctgtttaggtgtgaacctggttatacctgttcatgtaatcaccccttcagttgagtgctacagtgttaaaattagttgccattttaaatgccttccaaacaattacacttagattcagcaatgaaagcaagtgttactttgtatacagagaggaatggaaacaggaggtggggtgtccatttgctgtttctaaagaaaatgtttgttgttgggggagtgaccacaattccacgtttcttttcttttcttttttttttggagacagagtcttgctctgttactcacgctggagtgcagtggcaggatctcagctcactgcaacctccacctgccaggtgccaggttcaagcgattctcgtgtctcagcctcccgagtagctgggattataggtgtataggtgcgtgccaccatgcccggctaatttttgtatttttagcggagacggggttttactcttgttgtccaggctgatcttgaactcctgacctcaaatgatcggcttgcctcggcctcccaaagtgctaggattacaggtgggagccaccgcgcctggcccagttccatatttaattgccaaacaccaccaagtgaattagggcagtggtccccaacctttttggcaccagggactggtttcgtagaagacactttttccatgggtggtggtggtgggaggggaagggatggttttgagatgattcaagcatattacatttgttgtgctccttccttccttacccttccttccttactcttccttccttccttccttccctccctctctccttccctccttccaccgcccgcctgtctcgctttgtcacccaggctagagtacagtggcatgatctcagctcactgtaactccaccgcttgggctcaagcgatcctcccacctcagcctcctgagtacttgggaccataggcgcacgccatcatgcccggctaattttttgtatttttgatagagatagagttttactatgttggccaggctgttcttgaactcctgagctcaagcagtccacccacctcagcctctcaaagtgctgggattacaggcatgagccaccgcgcctggcctgtgccctttatttctattattattatattgtaatatagaatgaaataattttacaacccaccataatgtagaatcagtgggagccctgaccttgtttttctgtaagtagacggtccatctaggggtgatgggagaaagtgacagatcatcaggcattggattctcctaaggagggtgcaatgtagatccctcgcgtgcagaactcaatgtagggttcatgctcccattcgaatctaatgccactgctgatcttgcaggaggcggagctcaggtagtaatgcgagtgatggggagtggctgcaaatacagatggagcttcactccctcactcgcgtgcttgcttggtactggtctgtggcccaggggttggggacccccgcattagggagcttcagagaggccgaaatccataagtgtgtgaagccatgtcacattttgtaactgaacatacagttaggaggattgcatttcacactcaggcaatgcaaccttaggtcagagacactccacattcctcagaaagaaatttcagggctatgagagcctggtgtaactgatgacaactctgtccttgtctgttgttcaggcattttgttgtggtttaatgtgccatattttgtttctcttggtggtgaaaaataatggtacagtctacagtctgacatatttgatgaaatatggtctatgtccagcattgttctagaccatgagggtacacctgtggacaaaacagaaatctctgccctcctgggcattctggctgctgtgaagagaatagataaggaggaaagagcaaaagcagagagaaaggcggccatcgaaggagtcccagggagagatgatgtgggggccaccaactggggttagtggttgagagggggagaaagggtcaaacactagatggtcagatacattttgtgggtagagccaataggattgggtagtgagttgcatgtggagtatgaaagagtggagtccaaggtgcagggatgagttaggttatcatcgagttgattgttgtaacagagagacatgaagtggcagctgcttaagccagatagatgtttatttctctctaaatagaagtctgggtaggaggccggggctggtatggcagctctgcgctcattaggagcccaggtgccttctgtcttgtacctactttcctaccatatggcttccatcttttggcccttgtatgtctgcattctggccagagaggggaggggaggtcatgtgcctcttcatggcacagcttgaaagttgcacagatcactcctgtttacctctcactggctggaacccaagtcacatggccacagctacttgctgggaaggctgagaaatagtttttcttgggcagccatgtgttcagctatacgttctctcacatcagaaagggagagcagtctatgcctttctttccaaacccttctcccgagggagacaaccccggatcaacttcagagtccagaatccctgggtgatgtacattccaggaatctttagtttaaaacaaagttatcaggggctctgctgtcccccatacagtggtggagaggttaggataatggaagtagaaagtcctgtttggaaaagggaagaatggggagtaatactctgcgctggtccatagccattgtcagctcctgccaggctgagctgtgagcgcttcctcccctggcagtactgtgaggttctgacctcgcctttctggcaaccttgattctggtctcttgaaggagctcccttgtgcctggccctctgtagcctctgactttattttctggagagtttttctgtgtttcttttcctctggggtcagatctgaagtggacattggaggctatcctttttgtagggctaaacagtttctccagcttgcttcttgtggatattgaaggagtaggctttttcaaccctacttagccccaaattaccagactctgaaaactttgattgtagaccgcggacattcctcaggcagactgtattccctttcatctttgcatgcgaattggcaagctttggcttgagtctgcttcatgtttgcaggacttcttagccagtaagcaccaaattttgtattgttcgaccagttcccctagaattacaggccatgttggcatgcaggctgttttctaagatatcacgggttttgccaaatgttttattgtgatctctgagggttgccattcttccatcctacagtatctgtgcccatgctgacccctaagccaatgctgcatatttgtattgttaaggttgattacttccagcttccagattctgtgtattagttaggatattgatttgactgctgtggcagaggtcggaaataataatggcttgaacaagatgttgatttttttctatttcaagtgaaaatctgggtaggtggctgagagctggcttagtaactccatgcctgctagggggccagactcatgctgttttgtgcactgtcatcctctagcttataggccaggagggctgctccagcttctttgaggaaatctgcatcccagtccttaggaagggactcaagtgggaggagagggcatgttctatcccataagagcatggccagaaagcttcatatatctttttttttttttttttttttttgagatggagtctcactctttgcccaggctggagtgtagtggcgtgatctcggctcaccgcaagctccgcctcccaggttcacgccattctcctgcctcagcctcccgagtagctgggactgcaggtgcccgccaccacacctggctaattttttctatttttagtagagatggggtttcaccacgttagctaggatggtctcgatctcctgacctcatgacccacccgcctcggcctcccagagtgctgggattacaggcttgagccaccgcccttggcccatatgtcattacttacatctccttggctagagcttagtctcctggccacactcaaatgcaaacatggttgaatgcattttatttattttacttttttagagacaaggtattttttgtcacccaggctagagtacagtgcagcctctaactcctgggttcaagtgatccttctgccttagtctcctgagtaactgggaggtgtgtgccactgtgcccagctaatttttaaatttttattagagacgagggtctccctgtgttgcctaggctggtcttgaactcctgacttcaaacaatcctccttccttggcttcccaaggccctgggattataagcatgagccactgcatccgtcctgaatgcgttttgggaggcaactagcttttctaccacagggataccaggaattttggcttaagcagctcaaaaaatggaattgtcatttactgagatggggaaaattgaaagagaagattgggagggagacgttatcatctggtttgaacatattatgaatatgctgcctgttctttgtccatatggagatgtgaaataggttgtataggagtttgcagttcttgggggaggttggggttagggatactaatctggaagttgtcattgtatttaaaatcatgagaatggacagattttacctagagagtgagcataaatgcggaagacaagaggactgagcctccatccattccagcaattaaaggttgggagatcaggaggactcagaaaaggagactgataaggaacagccactgaggttggaggacagtctagagagcatggaatctggtgtccaggggaagaaagtatttcatgatgtgggggaatgctcaactgtgtctaatgttgataaaattagaggaggaccaagacgtgactatgggatttggcgacatggaggcccttggttaccttgacaagactgatttcattgctgactggagcaagttcaagagagaatgggaggagaggggagggagctcaggagtgaggcgtaggctccaggggtgcactgggaagccatctgtagttggcagaagccatgggttttagaggtgacaggaaaatgtggtgagcttatctttttctgttttaacttttcccattctctgctataatcactactttctttattcattcaacactctgtttctctctctttccccaagggaggaagtaaagaggtagagatatatttgtatatcattcctagcatgaggttttgggcctgaagagttccaaataataaattttgagacataatatggggaacattggatcatattatagtttttagagcttaaaaaaatagttgagtggcaaatatttcagagtaggagacttgaatattatttaatttgtttgcttaatttcaacaaatatttttgggctttgtgccaggtactgagggctgactatgtggagatgctgctcgaatatgacgaagacctggtctttaccttcagtgacctcaggctgcagctggggacacaggaacgcaaccagctagacttcaagtgctaaatagacatttcagtaaagggggtacggttgatggggcagttaattctgatggggaatgtagggaggggactgggaagatttgaattagtctttaaagatgactaggattttgacaattagaacactgtagccagacgcaatgatgcatgcctgcaatccctgctacttgggaggccaaggcaggaggatcacttgagcccaggagtttgagggcagcctgggcaatatcataagaccttttctctaaaaaaaaaaaaaatttttttaaattaggaaacaatgttggctgggcatagtgtctcatgcctgtaaccccagcaatttgggaggccaaggtgggcagatcacttgagtccaggagtttgagaccaacttggacaacatagggagaccccatatgtccaaaatggctgggtgtggtggcatgcacctgtggtcccagctactcgggaggctgagatgggagaatcacttgagcccggcaggtccagggtgcagtgagccatgatccatgtcactgccctctagtctgggcgagagagcaaaagaccctgtctcaaaaaaaaaaaaaaaaagttagaaaaataagtctgtggtgaagagaaatgtttcatttacttcttactctgggcaaattctgttacattcattcttttgaaattgatgatagaaatatgagaacattggagaaaaactgaagatggcaaatatgggatattggtagctgcttgctgatctgaaaggctggttttttttgagacagagtcttgctcttgtcacccaggctggagtgcagtggcgctcttggctcactgcaacctccacttctggggttcaagcaattctcctgcctcagcctcccgagtagctgggattacaggcatgcaccaccacacttggctaattttcgtatgtttagtagagaccaggttttgccatgttggtcaggctggtcttgaactcctgacctcaggtgatccgcctgccttggcctcccaaagtgttgggattacaggtgtgagccagtgtgcctggcctgatctgaaaggttttgagatatatcaggcatagccaaatgtgtgaccccaagctctccaaaaccactaagggtctgcagcagctgaaggagtaggtgatagggagaagttggaggaacgggaaaggggtttcattaaaatcacttctctcctaacattaaccacactgcattgaattatttattcacttggtgtagctcctactgggatatgaactcctggctattcttgtttactgctttttatccaagttctggcacagggcttggcacagagtggctcagaacaaatacttgttcaatgcatgaatgaatgcagtgatacaacatgtcttttcaggactcctattctttttttttttttttttatagaggtggagtttcactatgttgccatgttgcccaggctggtttccaactcctggcctcaagccatcttccctcctcggcctcccaaagtgttgagattataggcgtgagccaccacaaccggcctgcctcccaattctagtattgcaatagtttatttgtttgctgcattaagttgtgttaattaggttaaggtaggcacttgatgaaaaaagcctcattatcagagttctaattcagagtcagacatacttgcaggcttttttggttgtttgctttttgttttgagacaggacttgctctatggcccaggctggagtgcagtggcattatcatagctcactgcagcctcaaactcctgggctcagatgattttcccgcctcagcctcctgaatagctgggactacaggcatgccactgttcctggctcttacctggattttatttggagcaacaaattggatgattctggggaaagtacttaatctttctgagcctcagtttcctcacttataaaatgggggtatggaataccatctcgtagcactgttcttcagattaattggagtgatgtgaagtgtgcatggtgtagtgacctggccgagtggattcttgggacaagttagttctcaaagtaagattgaattgtgtataattggagttttagttggtgtccatataacatctaacaaatcttttgcatataataatgccaacagcataaatagtggtatcttactagttaaggtagcaaatagaccgtggcttatgtgaaaggttgggttggaatcctctcccccgacccattagttccaaaaatctcttctcacccaggggccatcttttgtattgagccacactgctaccactttttctaaaacgtggagtgattggtggcctgaatgtactaagagggtgaaggtggagtgtagagctttgaaagggaaagaagagtgtgcagaaaggggactcgaggagtcccaggagaaatgttctgcatatcaggactaaagaatacagcctgaggtgacacactttactcccatcagatgacttatttttgtcttctgaaagaattgtacccctcccagcagggggagaaaatctctgaattggatgtcattgtattaactactcaacagctgctaaatctttggcatcttgtccagttctttggcagcagtgtcaagactgggaaaagaggtatcttttgggtcctagattgagaagtgactttacctttctaattaaacatgacacattcaatgcatattgcttctttgttccctgtcagtgcttggtataaattctagatgtctaatagtgtcatttttttttttttttgagacggggtcttgctctgtcacccaggctggagtgtagtggtgccatcttggctcactgcaacctccgcctcctgggttcaagcaatccttccacctcagcctcccgagtagctgggactataggtgcatgccaccatacctggctgattttttaatttttttttttgtagagacagggtctcactatgttgcccaggctggtcttgaactcctgggctcaaatgatcctccggccttagcctcccaaaatgctgggattataggcatgagccactgggcctggtcagtggtgatttaattagttagattttctgactagatgaggtagcacactgctttaatggacgtttttgggaattgaacttctaagatgtccgggtagatcatattgagcacccatcgtgccaggcactcctcaggaatcatgtctgtgatcatggtcttttgttagacctgtgtctatacttgtcaccagggccagcttcacaggcatgtgactgcaggcagaggtgccccacgcttggtttaatgctctgctgttgctgtcttgaaattcttaatacatttgaacaaggtagcctgcatattcatttgtcatggggccctgaacattctgtagctggtcttggttgtcattgactttttctgtgtgggtggatatatgcctgggtagatgtcgtagttcatttggactattataacaaaatgccataaagtgggtggcttgtacacagcagcaatttgttattcaccgttctgcattctggaggctgagaagttccaagatcaaggtgctaagagatttagtttcttgagagccaacttcttggttcatagatacctgttttctcactgtgtcctcacttggaggaaggagcaaaggagccccctgggctttcttttataagggcattaatccgcaggtcatcaggggttccgccctcaggacctcatcacatcccaaaggccccatctcctaatttcatcagcgaccctcccacctcagcctcccgagtaactgggaccacaggtgtttacaaccgtgcatggcttttatttatttatttatttatttattttgagtcggagtctctctctgttgcccaggctggagtgcagtggcgcgatctcggctcgctgcaagctccacctcccaggttcacgccattctcctgcctcagcctcccaagtagctgggactacaggcatgcaccaccatgcccggctaatttttttgtatttttagtagagacggggtttcactgtggtagccagggtagtctcgatctcctgacctcgtgatccacccgcctcagcctcccaaagtcctgggattacaggcgtgagccactgcgcctggcctatttattttttatttaatttttttgagatggaattttgctcgtcgcccaggctggagtgcagtggcacaatcaagttctggggtatatgggctggatgtgtaagtttgttacataggtaagcgtgtaccgtggtggtttgctgcacctatcaacccatcacttagtaactgagtccagcatgcattagctatttttcttaatgctctccctacccgctgcatggctgattttgaaaactttttttttttgagacaaggtcttgctatgtcacccaggctagagtgcaggagtgcagtggcgtgatcacggctcacttgcagcctcgacctttcgggctcaagtgatcctcccacctcagccttctaagtatctgtgaccacaggtgttgccaccatgcctggctaattcttttattatttgtagacaaggcctcgctatgttgcccaggctggtcttgaattcctgggttcaagtgatcctcctgccttggcctcccaaagtgctgggattacaggtgtgaaccaccatgtccatctgatattgaatctttagataactcattttccttcatcaaatctttttttgttgttggggtagtaattagaaatattagattttttttaaaaaaaaagacaggatttttgacacataaacatttatttccatattctttttttaatttttatttttgtaagctattttatttcttccatgatgatttagagggactatcttcaaaccaatacaaatattttgtaagtaatatctggctgttttctaaccaattgagtaatttgttgcacagtaagccacctcacatctttcagcaagaaatacattaaatttgaatagtaaagacatggcataatgaattaggacacaattaaaatttgctttaaatagttctttgggcgaggggacaccacacttctactcaatgaagagaaacattttgacagttcagaggtcttttatttttttcacacctcttatgccatgaattcataggtaataggttccagcagctcaggcttcttcccattggttctcacacagtgtgcttctctggtacctttctctttggctttcttctttttctgatcattttccttcatgagttttaggaaatgatgctggcctttagagcgcttaatgtgctcaatatgcatattaattctcttggcaagactgttgccattgttcatttactacaatgccagcagcatgctgggtaacattgtagactcttccagtctagccatggtaacacttgcggggcattttttttggaacagtacccattcccttggtgtctgtaatattatctttctcctttttttttttttttttttgagatggagttttgctcttgttgcccaggctggagtgcagtggtgtaatcttggctcactgcaagctccacctcccgggttcaagcgattctcctgcctcagcctcccgagtagctgggattacaggcatgcaccaccatgcccagctaatttttgtatttttaatagagatggggtttctccatgttggtcaggctgggcttgaactccggacctcaggggatccacctgcctcggcctcccaaagtgctgagattacaggtgtgagccaccgcacccggcgtgtttttactttgaacagatgtccttgtgccaaaaggtttggtgatttctagtttagggaaacatgaataaagcatcttttggcttgaaatgttatgattagaatgggttgtgagtgggagaattttaatgaatgccaattggaacaaatgcttgtgaaaatgtctcgtaggccaccttttcatcattttttcttttcttttcttttcttttctttccttctttttcttttctttcctttctttattctgagacaagatctcactgtttcccaggctggagtgcactggcagcatcatagctcactgtagccttgaactcctgggctccggtgatcctcctgtcttagcctcctgagtagctaggactacaggcgtgtgctgccacacccagctaatttaaaaaattttttttgtagcgatggggtctcgttatgttgcccaagctggtttccaactcctggcttcaagccttcctccaccacacccagccaacatggggcaaaagttaccagaatcagttttatggaatagtgttagaagtagtgaatgctggccaggcgcagtggctcatgcctgtaatcccagcactttgggaggccaaggtgggcagatcacttgagatgaggagtttgagaccagcctggtcaacatggtgaaaccctgtctttactaaaaatacaaaaattagctgggtgtggtagcacgtgcccgtagtcccagctacttgggaggctgaggcaggagaatcacttgaagctggggatggaggttgcagtgagctgagattgcatcactgcattccagcctggatgacagagtaagactctgtctcaaaaaaacaaaacaaaacaaaacaaaaccagaagtagaagtagtagatgcttagtcatctacgttaatcttgtctgttgaaccaagtaggatcaaagatgagaatggagaccataccatccacttctatcccctgggatgtttttggttataaagggcataaagtttctgcagcaggaaaccttctttaaataacagaatgcagttaaaattattctacactcagcatgtttctctgccatgtaatgtttggcagttttaggctcttgatctttttggtttctcttgctcctaatttcacaattagatgacacgtgagatgctttttagtgcttttgtacacactcgtattatttagataaagcagaaccctacacaaaggggaaactgagcctaagaggaagattaaaagagcaaagggatggagaaaactgctaggctgaaattatttttttaaaaaagactatttactgtgtgtcaagtaaacacttttcatttgttcagcaaatatttaccgagtgctctctgggagttaggtactgtcatagttgctgggaatacagcggtgaataaactagaccaaatccctgctctcttggagcttgtattgtactgggtggggataaactataagctgataaatacatactaattctagttgtttgttatattacctttatttctgatgactattttataagataagaaatattttgtcactttcttataaatggggaaatcgaggctcagagagataacccagctggaaacaggtgcagctgggatcctggccagcgctagctacgcgattgctcattgtgtagagggcttgagaagatggggcctggggtagcacttcactcacccattgcacatggtctggtctctgtttcactttcaggtggactgcttcattcatttattcatgagacaaggcctcactctgccacccaggctggagtgcagtggcacattcatggctcactgcagcctcagcctccccagcccacctcagcctcctgagtagctgggactacaggcatgtgccaccacacctggctcatttttgtatttttttttttctgtagagatggggttttgccacactgatcttgaattcctgggctctggtgattggcccgcctcagccttccaaaatgctgggattacaggtgtgagccaccacacctggccccttattattctaatttgaagtaataatattaatattttaagtattatgggtgacttaagaaaacactttaattaggcagttttatgcctttggtccttagttctcaccagctggcagaatggggttaggcgtgtttaacgttcttcatgttatcaattagatgcaaaaaacacaattaacaatttttgttacagtttataaaattccttgtattttaaaaaagatataattactgcctggctttggagaattaaagggtcgcaaccttttttttctccctgagaaaataccatttacagtcttttctcttttttttttttttttttgagacagagtgtctgttgcccaggctggagtgcagtggcgtgatcatgactcactgcagccccaaactactgcactcaagcgcttctcctgcctgagcctcctgagtaggcacacaccaccatgccaggctaattttttgatttttttttagagatggagtcttgctgtgttccccaggctggtttctaactgctgagctcaagcagtcctccccagggaggttgaggctgcagtgagttgaaatcgtgttactgtactccaacctggctgacagaacaagaccctgtctcacagaaaaaaaaaaaaaagaaagaaaaaagaaaaatgtattttgctagtaattgctagaagttggcctttgtaagtattttgtgctttatttttgagatatttactcacctgggaaagttctcaaggaggaggaaggtgacttgccttgcctgcattccggtggcagggaagcaagcatgggaggcagtggagggtatgtaggtaaagagaggagaaggaacagctggactgtcggatgtggggtgaccttctcaggtcatgtccacacaaggactcttgtgagagtaaaagggtctctgttacaattaaagtgggagtgccaggagtaccctgggctgaggccaggagccgacatggatgatccccttctagaggtgacgtgtttgagctgtagcggagtgcttgggtaaaagcactagatactttagggttttgatttgggagtaagtcctggacatagtcatgatattctttggagaagaaatgtggttaatcaatcaagctttttgtaactgttgagtaaacattttttgagttggataagtaacctggaaagtgaagcagaaaatgattggaaaaatgagattgcagggtgaccgtgccattctacccccgtctgtttccactctgtcatattcatcctgtaacatttctctattgcttggaagccttggtactttacttgttagtgcagacttagggaagctggcctcactgagctgttaggtttatatgtgttaaaacttgtgctggagaaagtgcacaggagccaggcagtgaggcatggggtgctgggtggtgggccaggggcactagaagctgggcatggggtacagagctgggggagtggtgtgcactgggagccaggcagtggggactctggaatcacagtgaccacagtcagtgctgcatcctgagcccaccagctgccgcctgcaggtgggcaagggtgcctggcacctggagaagcacttcagcggctggtgtgacactgacctgagccttctgggaggcactgagaaatgctggctgtgattttgacatctgtgtcacctcagggcggaagacagcaatgccgaccccctggacagtattggatgccactgaccagatgtggctcccagtagtgatgacttggtgcacctcctggagtggcactataagggtctgactggcctcaacaaagcagaagctgttgtcaagaaccatgagggccagataaagatctgcatgccggctgggcgcggtagcttgtgcctgtaatcccagcactttgggaggccggggcgggcggatcacggatcacctggccaacatggtgaaaccccctctctactaaaatgcaaaaagttagccaggtgtggcggtgggcgcctgtagtcccagctacttgggaggctgaggcaggagaatggcgtgaacatgggaggtggagcttgtggtgagccaagattgcgccattgcattccagccctgggggacagagcgagactccgtcttaaaaacaacagcaacaacaaaaagatcttgatgcctctgatggagctgaacatttattatacagcaacagcagcaaggattgctggtgggcagactacactgtagggcacctgctcttctgtaagagtctgaaggacactattgtcagagctctgcccttttggaatgaagaaataattccccagatccaggaggggaaacaggtgttggttgaggctcctggcagcagcttttctggcacagtcgagccttgggaggctctcccggaaggggccatcatggagctgagcctgcccactggtattcccattgtctatgaattgaacaggaggagcttgaagcccattgagctcatgcagttcccaggagacgaagaggctgtgcataaagccatggaagcgtggctgcttagggcaaggccgaggcgtgaagggcggcagccgatccctatcctgacaacaccctcccagtctgccccattcctctatgcctctcacctccacgtgtcacagtgaccacagctgtaggcatccgaagttgttgagcgtatctggaggctcccattttaattttaggcatttttttttccactcctttcacacaatcagaatggcacctctggggcataggtcttcagcccaagccaagggaaggcttcttctacccaggagagctgaggggtggcaactctggggtctttgctagtgctttgtttacttgtttactaagaccctgcttgagtaggggatgtggaggaaccatgctaaggcatgaccaatgaggagaagcaagagagcctgtttgtattcctgggagccagtcctgttctattcagtcgtcaggtccctgtgtgtgtgtggagggggttgggaaaggttgggggtagatgaatgtaacctacatggtgatttaaaacaagcaactacagtcatgcatcacttaatgacagggatacgttctgagaaacgcatcattatgtgaacactatagggtatagttacacaaacttagatggcatagcctattccacacgtaggctctatagtataactccttggatacttacggtatggcctaggtattgctcctgggctacaaacctgtactgcatgtaactatactgaatcctgtgggcagttgtacaataacagtgagtttttgtgtatctaaacatagaaaaggaacagtaaaaatatggtattataatcttaccggaccaccagtaagatctggtgatctgacattgactgaaatgtcgttatgcagcccatgactgtatttcctctctgacttccccaggagagctggttccagaaggttcggatgagtcctgaatgtttatgtatggcattttcctttaccaaaacaaaacaaaagaaaataaaaacctttctggggttctagtagccattgaagtactcctaagtgtggtcatcagaaaataagccattctttaacaccttgacttctaacggtagaggttcattttgctgtgtattttagaatccctagtgagctagtgagattctggacaatttttttttttttggagccagtctcactctgttgcctaggctagagtgcagtggtgcaattgtagctcactaggctcaagtgatcctcctgcctcagcctcctgagtagttacgactacaggcacgtgccaccatgcccagctaatttttaaaatttttttgtagagaagtcatcttactatgctgctcaggccggtcttgagctcctggcctcaaatgatcctcccaccttggcttcccaaaatgctaggattacaggtgtaagccaccgcaagagtttgtttccaccttctgttttctgtttttttttttatctcaaaagacaacaagatataaatgagatgcattaatgcagcatactgcaaacctacggcatacttacttgtagaatttgtagtactggaatccaccctttaataacgaggtgtaaaagggagctatcagaagagaggaacagacaactggccacatttctgtaattgtgcaaaacaagtttgtttgtttttttgtgagacagagtccctgtcacccaggctggagtgcaagtggcatgattttggcccactacaacctccgtttcctgggtttaagcaattctcctgcctcagcctaccaagtagctgggattacaggcatgcaccaccacgcccagctaatcttttatattttttattagagacggggtttcaccatcttgaccagactagtctggaactcctggcctcaggtaatccgcctgcttcccaaagtgctggtattacaggggtgagccaccgcacttggccctgagcaagtttttatggaggattgagtgaagggcattgcctgggagagtcatcttttaagattttttggggtaagggatctccttgaaaatcttgagggaattgaaggtcctcctggccttcatgggtcccaggatttggacccctgccccaggtattctcaactctacccagaaatcaagccgcaccagcaaagctgatgcttggatctcttcatttgggctactctcaaactttttcctttgaatcttgttttgccattaagcatctgctgatgttgaggagtgttgtcagttacttactgtgttgctatacgtgtgtagtgtgtgctgatctcactcctggctttatcttcttttttcttttttttttttttttgagacgaggtctcgctctgttgccaggctggagtgcagtggcgcgatcttggctcactgcaacctccgcctcctgggttaaagcttttcttctgcctcagcttcctgagtatctgggattacaggcgggcaccaccacacccagctaatttttgtatttttagtagagacggtgtttcaccatgttggccaggatggtctcgatttcttgacctcgtgatccacccacctcggcctcccaaagtgttgggattacaggcctgagccaccacacccggccctattttttctaccatcattttgcttgtgtcctaatttccttatctctttgaattaaacttgttaatttaattaagttaaattaaaaatacattcgatgtgtgtttttttgtttgtttcttttgaggtggagtctcgctctgtcgcccaggctggagtgccatggcacgatcctggctcactgcaaccttcacctcctgggtttaagggatttttcttcctcagcctcccgagtagctgggattataggcatgagccaccatacccagctaatttttgtatttttagtagagacgaggttttgccattttggcgaggctggtctcgaactcctgacctcaggaggtctgcccaccttggctcccaaagtgttggggctgcaggcgtaagccgctgtaccggccgccttaatgcattttttgttaatcactttaaatctttcctagaacaagaaaataatgatagtgaggccaggtgcggtggctcacgcctgtaatcccagcattttgggtgagtgaggcaagtggatcacctgaggtcaggagttcaagaccagcctgaccaacatggccaaaccccatctttactaaaaatacaaaattagccgggtgtggtggcacatgcctgtaatcccagcgactcgggaggctgaggcaggagaatggcttgtacctgggaggcggaggttgcagtgatccgagattgcaccattgcactccagcctgggaaacaagagtgaaactccgtctcaaaaaaaaaaaaaaagaaaaagaaaatagtgatggcgaataaaacagatgttggggctgggcatactttgggaggccaaggcagggggatcacctgaggtcaggaattcgaaaccagcctggccaacatggtgaaaccccgtctctaataaaaatacaaaaattagctgggtgtggtggcgcatgcctgtagtcccagccactggggaggctgaggcaggaggatcgcttgaacccaggaggcagaggttgcagtgagctgaaaccgtgcctctgcactcccgcctgggtgatagagagtgagaccctatctcaaaaaaacaaaaacaaaacagatgtcggcaacctgtaggacatttttggttgggtattcttccaggtacctcacactcagtaatctaatcataacccatcttcttaaaatctccttctgtattttcaattttagggtattttaccattcatttaggtatccaggcctgaaatctagattattcttcttcctcactttttacttccaaataacagccaagttctgttgggaacacagatcaagtatctccagagctgtccctttcctatgcccattgcgcaggcttgcttgtggcctgcctccattcgttctccacacagtagctagagtgatttgttttaaaaggtacatctgggccgggtgaggtggctaatgcctgtaattccaacactttgggaggccaagtcaggcggatcacttgaggtcgtcaggagtttgagaccagcctggccaacatggtgaaaccccgtctctactaaaaatacaaaaattagctgggtgtggtggcgggtgcctgtaatcccagccactcaggaggctgaggcaggagaatcgcttgaaccagggaggcagaggttgcaatgagccgagaccatgccattgcacttcagcctgggcaacaaaaatgaaactgtctcaatgaaaaaaaaaaaaaagaaaagtacatcttacctggttattcccctgcttaaatccttcaaaagatgtctttcttgccttcacgaacaagttcagtgtcttaggatggtattcacagctcgtcatgagcttgttgcagcttgtctttcttgtctgtgcctcaccatgtccatacacactcattcttaccaactactcagcgttccctaaacagtgtgtgtgctcacaaagcctcccaatctctgccggcgctcctttgttcctcgtctgcctaacccctacctgtcctgaaaaagaaacttaagtcaagtagtaagcacatagcatttgtatgtggttcgattttcaaaattgctctctgggatgattcagttattacatgaatatacagttagtgtaaatgaatttgaatcctgaaaacctaatataagatggtgaaaaaaaggtgatactctatgcacaagcaaactgctgatcgcatctccgaggaattgtagtatttctatgcatacgtgcagtaagtaatagaacatcttattgagcttaagccaaaaatgggatttattttaaggatacaggagtcttctttctgaacctagggatagaaagatagctgggtcacaggaagagactggaatcaagaatccaggtgctgccagggcttcctgtgtctgcatcattatcattacccttcagttccactctctatcacctcgtctctttgtcacttccttttcctctctcaacagccctggctagtccatctctgtgcctactgtgtactgctgtacatggctagagaaaaaaacaaaagccatgctggtgggtctaacttttccctcaactttctattctggacttttttttttttttttagatagagtctcactgtgttgcccaggctggagtgcaatggtgcaatctctgctcactgcagcctccacctcccgggttcaagcaattctcctgcctcagcctcctgagtagctggggttacaggtgcccgctgccatgcccagctaatttttgtatttttgatagaggtgaggtttcaccatgttgaccagactggtcttgaactcctgacctcaagtgatccacccgcctggcctcccaaagtgctgggattaaaggtgtgagccaccgcgcctggccctaaaaatttttaaatctgcagaaaatttgaatgactcacctagattcatcagtttattttttgttacattcactttgtctgtatataaatgtgtgtatatacatctatacacccacacatacttgttggttttggctgaactatttgaaagtatggagaaccactaaagcagatgggaactaggaggaaggaagggaaggcttcattgagaaggtaacatttgagcaaagatccaggtcagggagcaggatatagagcagttatggggcaagtggcgggaggagcatgcgggggaggaaggcacagctccacaataagcaaccaccagtgcccagctgtgtgttgaaggaagaggagaccgctgtacttcactgtattgttgtccacatattcaccacccctgtctggggaaggttctatttccccacgctgcaggggtagtttcggccctgtgactgttttggccagttaaatgtgaacacaattgaatgtgtcaccgctgggccagtgtggagtttgctctgcctcttgccctttgcctgggcgattgctagtgttcccattagaggctgctctttcaccctgggtcttggagtgaagacgttatggagcagggctacactttcatctgaatgttttcccacggtagatgtagtgggaaataataatggttttcattcttttcatcagaaattctgtgaaagaagaaagatgaggaaaaatggaaatttactgtgtcattgccatttgcatttatgtataatttgcactaataataatgttcattataatgtaaatctacatccttttaaaaaataaatggaatcattatgtgtacccttttgcaaccggctttttcaattcaattttttaaaaaatggaaaatacacataacataaaaatatgcctcattttaaaagcagtagatatcgaagtgaatataacatatatcattgttcccctccctccctccccccctccttccctcccccactccttccctctctccctctctaccttcgtacctccctccctttgtacctccctccctctctcccttcctaccttccttcccttttgtttctatttagaggcagggtctcactctgacaccccggctggagtgcagtggtataatcatagctcgcttcagccttgacctcctgcctcagtctccctagtagctggcactacacatcgtgtgtgccaccatgcccagctaattttttattttttgtgggattggggggggagggggtcttgccatgttccccaggctggttttgaacttgtgggctcaagtgatccccctgcctcagcctcccagagtgctgagattacaggtgtgagccaccacatctgaccatgaattttttttttaaggaaactgatgaattttagatcacagagctgtgatgtttggatgtaaatgcattttttggagaaacattgttgggcttagattaggcctactgtgaaattgtcatagcatttaataagtttcaaacatggccagctgtgaaaaaagaaaataaaaccaataataatactaggagttattggccaggcaggtggctcacgcttgtaatcccagcactttgggaggctgaggcaggtagataacctgaggtcaggagtttgagaccagcctgaccaacaaggtgaaacctcgactctactaaaaatacaaaaattagccaggcattttggcaggcgcctgtagtcccagctactcgggaggctgagacaggagaatggcatgaacccgggaggcagaggttgcagtgagccaagatcacgctaccgcactccaacctgggtgacagagcaagactccgtctcaaaaaaaaaccaaaacagaactaggagttattgtcatctttccaaggagactaccccaaagagaaagtatttccaattatttttctttatattggaattcacttttttttaaagtagaaaagtaagacacttttgtagaatgactgtttattaaacttataacagtgttttgtgggtgtttttccccacaaactgctaaaaataagaggaacagtttggcccatcctgtcttagcttctgcctgcaatcacaatggccttcactgttttgaatctatttttagttcatcaggaacgtgagggtgggaagtgctgcgtcatataacagattaggagaaagccctattttaatgtcgtttgtgaaataagaactgaaacagacaagaaaaactctaggaatgagatttcatgattagtatgtgtggctttgagttgtggtttaggacacaaattgaggaattggaagttctttatacttttttttttctctgtgagataggggaaaacaaaattctcttaaaaaaggacttttgtttaacttaaaggagattatgccagtcctttgggttaatgttaaaaaagtcaagtaaacaatgagaaaaatgtttaatcatattttggtgtgttgtgactattttttggtgtgtatctcatatgttctgtttgtgataaaaagtgaggttgcatctcttagtagtcaaattaattagatacacttttttttttttttgagacccggctctcaccgggttgcacagactggattttatggctctctgcagccttgaccttcccagactcaggtgatcctcccatctcagtatttgttgttgttgttgttgagatggagtctcactctatggcccaggctggagtgcaatggcgtgatctcagctcactgcaagctccgcctcctgggttcacgccattctcctgcctcagcttcccgagtagcttggactacaggtggccaccaccatgcctggctaatttttttgtatttttagtagagacagggtttcaccgtgttaaccaggatggtctcgatctcctgaccttgtgatccgcccacctcagcctcccaaagtgctgggattacaggggtgagccatcatgcctggccagtttttttttttttttttaagatggagtcttgctctgttgcccaggttggagtgcagtggcacaatcttggctcactgcaacctccgcctcctgggttcaagtgattctcctgcctcagcctcccaagtacctgggattacaggtgcctaccaccacacctggctaatttttgtatttttagtagagatgaggtttcagtatgctggccaggccggtctcaaactcctgacatgaagtgatcccacctaccttggcctcccaaaatgctgggattacgagcatgagccactgcacctggcacagttttcttttcttttttctttttcttttttttttttgagcaggagtctcgctctgttgcccaggctggagtgcagtggtgcgatctcagctcactgtgacctcctcctcccgggttgaagtgattctcctgccgcggcctcctcagtagctgggattatgggcgcgtgccaccatacctggctaatttttggtatttttagtagagatggggtttccccgtgttagtcgggctggtctcgaactcctgacctcgggccatctgcctgccttggcctcccaaagtgctgggattacaggcatgagccactgtgcccggccagtttttgtatttttagtagagccggtgtttctccatgttgcccaggctggaggtaaacctttatacctgtgattgcacaaagccattctcttgtgagtcccctatccagatattcccagggcctcaggttgctaaaccagttcaaagttaacaccagtgtagaaggcattcagaccacccaagggcattatcctctactgagagccctgctgtgggcagcccagaacgctgccccctgcatggctcttcctaaattttccagcggatctttaagatggggcaaaatgtattctcccaatcttctcctactccttctgtcatgtatggacctgcctctgtctcttaactctttcttcctgcttaatagtctgcaacatgcttcacaaagtcttgattcttcaaccttttttgaaaccttagaatcctttctttcttcaaccgcatattatagtgagtcagaacatttattctctgtttatatcactgagtagaacatctgaatttaacatcttgggctgaacttggcattgaggtttaaggtgacttcatattttttccaacaatagtgggtatgctcttccaatgataatgataacgtcaactaataaattagtcaattttatgttcagtgcatttttctagtatttctcatttattcagcagatatttagagagtacctaccatgtgtcagacactgttctaggcactggtgcaacggaagttcttgcttttaagaaacttcaattagggggatggtaactaagcaatacacaaataaatatatcacacatgtcatagggcagatcagagccacggagaaaaaataagtagggaaagggacagggtggtggttttctcacaaccctgtaaggaagatactggtttttttcttatttttttgagacggagtctcacttcatcgcccaggctggagtgcagcggtgcgatattggctcactgcaacctccgcctcccaggttcaagcgattctcctgcctcagcctcccaagtagctgggattgcaggtgtgtggcaccatgcctggctgatctttgtatttttagtagagacagggttttgccgtgttggccaggctggtctcgaactccagacctcaaatgatccaccgcctcggactcccctcggccgatgatttcatccccattgtacagatgtgcagtgtacggatgtccattgtgcagaaactgaagcagagagctgttaagtgacttatctggataggctccagataagtaaagtagtcagtaataaaggttgaatttgaattagaaatcaagcatgaactcctaaatttagctgtctgtaagataatgaaacttggcccggcatggtggctcacacttgtaatcccagcactttggggggccgaggtggaaggattgtttgagcccaggaatttgagaccagcctgggcaacatggtgagatgccatgtctacaaaaaattaaaaattaggtgggtgtggtggtgcatgcctgtagtcccagctacttgggaggctgagacaggagaatcgcatgaacctgggagggggaggttgcagtgagccgagatggtgccattgtactccagcctgggtgacaagagcgaaactccgtctcagaaaaaaaaaaaaattacatgctacacagaagactatatttaacatataaactatgaagaagaataagatgaatacccatgaactgattactcatagttgtaagtatacaacccagtgagttttcataaagtggacatagctgtgacattagtatccagttaaaattaaaaaaaaaaaaaaaaaaccattaccagatccctagaatctcactcctgcctctcccgagctgcttcctgcccctttcccaccaaggataaccattatccaaactaatggtatagtttagtttttcttattttcaaattttatagaaatggaatcatccactctgttttttttacatctggcttcttttgctcaggggacatgggtaaatctgttaggaagcttttggagatgccctgctgttagtaggagttcaacaaacacattttgaatgaatggattaatttttctctttcaataagatgttgctctttaattatatgttaaaaggaagaagtggcagattgtatttttattgaatcaagtaaaaaaagaaaatctgatcattttgctcctacaagtgatggttaaatttgtgtcttagtgtaacttttgtttctcattgttttagtgaattaaattggctatttattcattaatttattttggaggtggagtctccctctgttgcccaggctagagtgcagtggtgccatctcagctcactgcaattgccctccacctcccgagttcaagtgattctcctgcctcagtagctgggattacaggcacgcatcaccacacctggctaatttttgtatttttagtagagacaggatttcaccatgttggtcaggctgttctcgaactcctgacctcgtgatcctcctgcctcagcctcccagagtgctgggattacaggcgtgagccaccacacctggccaattggctatttatttttaaatcttacctatttgaaatgaccaagttaggtcattttattaaaataacaacaagctttagtgtgttacaagcataggctgggcatggtgcttcatgcccataatcctagtactctgggaggccaaggtgggaggatcacttggggccaggaggttgagaccagcctgggcaacatagtgagacctcgtctctgtcaaaaattaaaaaaaattaattagctggacatggtggtttgcacctgtagtgttagatacttaggaggccgaggtgggaagattacttgagcccaggagttcaaggctgcagtgagctatgattgaaatactgcactccagcttgggtgacagagagactctctctaaaatgaagtgtaatatgcttaccgtaaattcgccatgtcagccaaggaggtgtgataaacagagatggtaagggaactaacatacagtatatacgtatttatgtatgtatttatgtatgtatgaattagaggtgggttgtcactgctttgctcaggctggtcttgaactcctaggctcaagcgattacccccacctcaccctcccaagtagctgagactataggcaggcaccgctgaacctggccaaaatacagttgttaaaaactcaagtgatagagcttgtaggaatactggtagagcgagttattctctcagaagagtacttttgctgaaggcatattgagttgttaaactctggtttggttatgaataatgtcattctctggcagaattgtgtttctgctgattagttatagaatgcccttttcccctcatgttgtagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggtaagcccaagcttcatacctgggactcttttgtaattcttcttagctttttgttaagctgatggttgtgatgtttccagaacagattaaaatgaagcagacatcagctctttaaaatcctccaagcagtagtttaaatatcattgcaatgtgttgtgttatcgcttttttttttattgcaatctgttaaaccaattgcttttctttccataacttccatctttttttttttcaaacaggtttaggtattatctctgatgacaagatgattaagactgaatttggttctgctgattttatgaatttggttgatggttttaagataaaataatctgaaaatgcaagattaaaataatggtcaaaatgaacacctctaattgcagatttcctcgtcttcattctgcattggcacagaactttttctttaacttttcagaggataaaactacctgataggatgtttagaactatctcattaaaaagtaaaagtttatttctttataataaatgagctgatgcttgatatccaggactgtctttgttgggaaatgatatttctcatactgtgtatttgaaaatatctctcttttgtctgtgaacttttctatcaaatatagtattattgtcatataataataattactattttataattaggattctagttgcgtaaagggggtgctaagagaactgcattgatcataatatcatctaataatttgatagccttctgaatcatctgtcttcttgatctagaatcgtgtcaattaaaagtatttgcagagtttttgttgctgtacttctcgttaggtatcagtgtagactatagatatatataaatgtttatacctaatgtggttcaaccaaaacatctgttagtaataaagaagatccttgcctataatgtttcctctgtatgtctctgagaagctctgatggtcttctggtaggattgatgggttcaggattccaaatgtgattttccttggacacagtactgacaacagtgctctttgcctcaccctggtcaggccatacctggaatgctggaatctgtcctggagagaacctctctcactttgtcttacttgcttatttaaaccaggatcttggttaaatcccattccccacctacactggaataaggctatagaaaaactcagaaccatttgaactaattgaaaacttttgaaatgtctgtctcatttcgaattcatgattacatggctgggtgtggttgctcatgcctgtaatcccagcactttgggaagccaaggtgggtggatcagttgaggtcaggagtttgagatcagcctagccaacatggtgaaagcccgtctcacaaaaaaaatacaaaaagccgggtgtggtgctacctgcctgtaattccaactacaagagaggctgaggcatgagaattgcttaaacccgggaggtggaggttgcaatgagccaagattgcgctactgcactccaacctggtgatggcgtgagattctgtctcaaaaacaacaacaacaacaacaacaacatcaaattcatgatcacaaactcgggtagacccttgatactggcaggctgttgcaccatgcttcccagttcactcactctgctgatctgtttcataccttctcgagtgtgcagtacctcattctccatgctcactctctcagctagtggcctggcttcccatttctttctttctattttttttttttttttttttttttggagatgaggtctcactgggttgcccaggctggagcatggtggctgttcataggcgtgatcctagtgcactacagcttaaaactcccaggctcagatgatccgtctgcttcagtctctcatgtagctgggactataggcatgtgccaccacacctaactctggcctcatatttcattgagaaaacagatgcaggcagaacctaggcagggaacctccatcagcctcagtcatcacatccatctgcctacctgtatgtgcgcctggttcttgttatgcacaaattgtccctgctgctgttgaagcttggaccctagatcccatctcccttcagttactcagccttcactccagcagttcctttctctctcttgcttcatcagattttccatctcatatggcctttttttttttaacagcctatataatgccattacttttcccatcatgggaatgaacaaaaggaactctcttgatctaattccccctgccagcttctcccccacatctctgcaccaaaacctttgcagcagaacttccggaatgagttgcctgtcctctccatccccttctgcccttgcactctttgctgaatcaactgcagtcaggcgagggttcccgtggttgctctgtggttgctctgagtcactgtctggtctgacccatcagcctcattagacatggctttcacccacttctcctggaaacacgtttttcttttggcttccagaacagcacattctcctggttttcatgcattctctgtatctgttccttcttcactctttgcctggttccttttcatttccctgacttctaaatgttaggattcaagggctcaatatttaacctcttgtcctttccatccagctttattctcttactgttgtcatccagtgtcctggctttaattaccctcatttgatgattcctaagcttttatctccaacgtggacctgctccttgaacctcagattgacacatccagcgctttacctgacatctctgcttggatgtctaacaggcatgtcacagctagcatgccccaaatcaagctttgctgttgcctcacattttatcttctcccaggtttccatctcaataaatgacaattcatgttttctagacctggattggcaaactctttctgttaagggccagatagtaaatatttttggctttggaggctgtgaggttagaactgtttatctctgcttctgtagcacaaaagcagccatagaacatatgtaaatgagcaagtgtaactgtgttccagtaaaacttcacttacaaaaacaggcagtagcccagatttggcctgtggactagagcttgcttggccctgctctagacctgtcagaaaactagaagcagaccagattctcaccacctgtttcttctcatcacctccaccgctattacccaggtccaaggcaccagcatctcttgcctggatttctggaacagcctcctaactggtcatctcatgcccacccttgcttcacttgagtctgttctcagtgtagagccagaggggccccactaaagcataagtgcaacactgtgtaacagcccatatgctgttatcacaaactaacagaaaggcttgggcattccctaaacggttagttcttgcccgggtacctctatgctaagtagtcctgattatgtttctcacatagtcatcattattcataatcacaaacagttggatattattagccatactttggtgggttgaataaacagattttcatgatttcctaaataagtgaaaaaacaaacagaaaatctctcttaagacaggttacatctattctctgttcaggccaggtgcagtggctcatgcctgtaatcataatactttgggaagccaaggtgggaggatcccttgagcctaggagttcgagaccagcctgggcgacatagcaaaaccccgtctctacaaaaaattagcggggcgtgatggtgcacacatgtagtcccagttactcgggaggctgaggtgggacgattgcttgagcccaggaggtggaggttgccgtgagctgtgatcacaccactgcattccagcctgggcaacagagcaagaccctgtctcaaaaaagagaaaaagaaatttcaagaaaatatgatagctgtccgttaaagagtttaaaaagctggcatgaggaaggtgatggcttgtgtttattttctgtggtcctggaagttagacataggtctaatgggtagatttattatccaccgaatgtgattgagagatttttgttccagactcaaaaagtgcttctttctttctttctttttttttttttttttgagacagtctcactctgttgcctaggctggagtgcaatgacgtgatcttggctcactgtaacctttgtctcctggttttaagcaactctcctgcctcagcctcctaagtagctggattacaggtgcccaccaccatgcctagctaatttttgtatttttagtagagatggggtttcgccatgttggccaggctggtctcgaactcctgacctcaggtgatccacctgcctcggcctcccaaaatgctgagattacacacgtgagctaccacgcctggccaagaagtgctaacagagacaaacactgggtggggtgccacccatggtaaaaagtccttcatccaggagtgcttggcagcagtcatttggtggccctcttagttgggctgttttcagttgcaagtaactaaagcaaggattgagaagctgtagggggtccttccacttccagttgcttctcccatctgcagtcccagccttttttttttttttttttttttgagatggagtttcgctcttgtcacccaggctggagtgcaatggcatgatctcgactctctgtaacctccaccttctggtttcaagctattctcctacctcagcctcccgattagctgggattacaggcgcctgccaccacgcctggctaatttttgtatttttagtatagactgggtttcaccacgttggccaggctggtctcgaactcctgacctcatgatcctcccgcctcagcctcccaaagtgttgggattacaggtgtgagctgccacacccagcctagtcccagcttcttgcagtgccatctgcttctgtagtttcctagggctgctgtaacaacctatcaaaaacttttgaaggcttacagcagcagtattattttctcacagttctagaggctagaagtccaaagccaaggtgttggtagggcgatgcctcccaataaggggagaatcctttcttctgccttccgatagttgctggcagtccttggcatttcttggcttgtggcaacataactccagtcttcacgtccgtcttcacatggccatcttcgttctgtgtgtgtctgtgtccaaatttccctcttatgacagccactggattagggaccaccgtaattgagtatgagcttattttaacttgcttacgtctgctaagaccctccttgcaaacaggagtattatttctttgtttttgatctgcatctcctcttccctttgaatgtaaggttaggcaggagccttgccagtgttgctcatccccttacccccagcaccgtgcttagcacatggcaagcagtctggaaatgccaagtgttatgtggctaaatgaatgaaagaaatatttcttgttggaaatgttagaagcgaagtaagatttgagttcttttgaaaaacagctggctgacattgttcctctcaccacaaccagctggattgtctgtttttcctgatgtgctgagtgctgagcagaattttaaaaatcctcagtctattcattttcttctaaaattagaaaaaaagttattatataaaatatttcaaatgtacatgataacataactagtgcctatggaaccaagtccacaggtcattgctgttccagacttgccattccagatatttcttcatgttttactgcattgttatgtggcactgctcttggctctcttagaactttatatatatgggtgatgcttttcctacagatgaatgccacttttttatagttaacactgattatgctagtttttttttttttgagacggagtctctctctgtcacccaatctggaatgcagtggcacgatcttggctcactgcaacctccgtcacccgggttcaagtgattctcccacctcagcctccgagtagctggggttacaggtgcgtgccaccacacctggctaatttttgtatttttagtagagacagggtttcaccatgttggccaggctggtctcaaactcctgacctcaggtgatccacctgtctcagcctcccaaagtgctgggattacagatgtgagccaccgtgcctggctgattatgctacttttatatttaaaatgtagggcttactgcaggtcagacacagtacttggtcatgggaatgcaaagatgagtgagactcagtttctttccttaaagagcttttagcctagttggggaggaaatgttctttcatttcctgtttaatatctgtgtttattaaattctttggaggacagtctagttttcttagtttcttcccctatctttagatgatttgtgattgcttaatcttcagaacttcttaactgtctcgggttattttattttacagccttgttttggaattatgcttgtcttctctttgatgtttgcctatcaaacatcttgagtatatccaacgaaggccttaaccttcctcgctgttgtgacctctgaagaggaggtcatgattgctcaagagtcccccaacagatcctttatcaaccattttcatcttgacaggattattaggtctagtggaataggtcttccagtggaataggtctgcctgtatactctctagagctggcaggtttcatttttgtttttctaagacaaagtcaggctggagtacagtggtgcgaccatagctcattgcggccacaaactcctgagcttaagtggtcctcctgcttcagcctcagaagtagctgagactacaggtgcgcgccaccatgcctggctaattttttaattttttttgtagagatgaagttttactgtgttgcctaggctggttttgaactcctggcctcaagcgatcttcctgcctcaatctctcaaagtattgggattacaggcatggagttctccattgttttcattccatggttccctttggcaaactggggaagcctttgattggcttctcaaaatatacttttattattattttttgagatggagtcccgctctgtcgcccaggctggagggcagtgacgtagtctgcctcccgggctcaagtgattttcctgcctcaacctcctgagtagctgggattacaggcatgcgccaccacgcccggctaattttttgtatttttagtagagacggagtttcaccatgttgaccaggctggtcttgaacttctgacctcaagtgatcctcctccattggcctcccaaagtgctgggattacaggtgtgagccaccgcacccgacctcaaaatttacttttaaatgtgtataataaaataggattacacaattatataggaatataattatcaacatatttttaaagattgtaatacagttatttatatgcttctttattaatgatttaaatgaaagacttagcaactagtcaaactgcttcagccccttgacatctgtttccatctgtggaccacaggtaaagatcctctgctctgggagcagaaatgaacagtggggcctctttggaactagtgagaagccagatgatatatttggcctctgggctagttctggggtctggatcagaaacagaatttgtttcttttctttggctgctagtttttaacctacttaatgattatttaacttaaaattattctttaacatgttgactcaaatggtcttcatcctgcttccattcatgcacttgaatagttaataaatggcttctgtctgttgggcactgtattgagagctagggatgcaggatggataagtctcaggggcctccaggggctcactgtttagcatgagggcatgaacttgtgaagaggtgcagatgctggtgtcctgtacttgacagagaacagccacaaatagtcactttctcaggctcccggctatgcattgtagatttttttggagcattttcacacaggcatttatctgattgaaaattctactggctgggtgtggtggctcacgcctgtaatcccagcactttgggaggccgagatggagggatcatgaggtcaggagattgagaccagcctggccaacatggtgaaaccctgtctctactaaaaatacaaaaattagctgggcatggtggcgggtgcctgtaatcctagctactctggaagctgaggcaggagaatcgcttgaacccaggaggcagaggttgcagtgagccaagatcccaccactgcactccagtgtggtgagagtgagaatccatctcaaaaaaaaaaaaagaaagaaagaaagaaagaaaattctatgttggtgagagtgtaaatttatatagccattttacaaaacaatatggaggtccctcagaaaactaaaaacagagctaccatatgatctggcagtcccactgagtatatatccaaagaaattaagattcatatgctgaagagatacctctactcatgttcattgcagcattattccaaatagccaagatatggaagcaacctaaataatccatcttcagatgaatgggaaaagaaactgtggtatgtatccacaatggaatattattcagccttcaaaaagaaagaaattctgtcatttgtggcaacatggatgaacttggaagacaccatgctaagtgaaataagccaggcacagaaaggcaaatattgcatgttttcactcatacgtgggagcttaaaaagttgaactcatacaaatagacagtagatggtggttaccagaggctggggaatgggggtggatgaagaaggagatgttgatcgaagggtacaaaatttcagttagatcagaggaaaaagctttagtgatctattgtacaggatgttgactgtcataaataataacgttttatatattttttaaaattctactttttaaaaacaacaatattattattattattgagacgaagtttcgctcttgttgcccaggctggcatacaatggcacgatcttggctcaccgcaacctctacctcctgggttcaaacgattctcctgcctcagcctcctgagtagctgggattacaggcctgtgccaccatgcctggctaattttatttttggtagagacaggctttctctatgttggtcaggctggtctccaactcccgatgtcagatgatctgcccacctcggtctcccaaagtgctgggattacaggtgtgagccaccatgcctggcaaaacaacagtattattactttatataatatagggaacaacatccttccatatcctattataattggtttttttatgttttattttgagatggtcccactctgtcacccaggctggagtgcagcaatggaatctcgaatcactgctgcctcaacctcccaggctcaagtgatccttttacctcagcctcccaagtagctgggactcctggcacgtgccaccatgcctggctaattttttttttgtttgagttggagtttcgctcttgtcacctaggctggagtgtaatggcgtaatcttggctcgctgcaacctccgcctcctggattcaagcaattctcctgcctcagcctcccaagtagctgggattacaggcactggccaccacgcccaattaatttttgtatttttagtagagacgaggtttcaccatgttggccaggctggtctcgaactcctgacctcaggtgggctgcccgcttcggcctcccaaagtgctgggattgccaccatgcccatcctaatttttaaattatttgtgcagacaagttctcactatgttacccagtttggttttgaactcctgggctcaagtgatcttcccaccttggcctcccaatgtgttgggactacaggcgtgagccactgttcctggcctattcttatccctccaaatttgcttgatatgttttatctattttatatgtttgtttatgttggttgttacattgatttattgaatgctctaaattcacgtaggcttcacttaatacatatttatttaaatctccctatgcagtaggttctgttgtaggctatgtggcttatattttagtgagagaaaacaatttaaatacccagctgggcatggtggctcatgcccgtcatcctagtgctttgggaggtctaggtgggaggatcgcttgaacccaggggtttaagactagcctggacaacatagcgagacgttacctctacaaaaaaaatacacaaattagccaggcatggtagtgcgcacctgtaggcccagctactggggaggctgaggcatgagaatcacttgaacctgggaagtagaggtagcagtgagccgaaattgtgccatgcactccagcctggacaacagagtgagactctgtctcaaaaaacaaaaacaaacaaaaccacaaaatctttcagatgatggtaattatagaggaaaagagagcagtatgttggcataagtaccactgggggtgtgtacataatcactgtaggtcctattaagaaggcgactttttttttttttttttttttttttactttaagttctgggatacatgtgcagaacgtgcaggtttgttacataggtacacatgtgccatggtggtttgctgcacctatcaactcatcatctagattttaagcctctcatgcattaggtatttgtcctaatgctctccctccccttgaccccaccctccccctattaggccccagtgtgttgctcccctccctgtgtccctgtgttctcattgttcaactcccatttatgagtgagaatgtgcagtgtttggttttctgtttctgtgttagtttactgaggatggtggcttccaccttcatccatgtccctgcaaaggacatgatctcattcttttttacggctgcatagtattgcatggtgtatatgtaccacactttttttaatctatcatcgatgggcatttgggttggttccatgtctttgctattgtaaatagtgctatcgtgtacatgtgtctttatggtagaatgatttatattcctttgggtgtatatacccagtaatgagattgctgggtcaaatggtatttctggttctagaagaatgtgacatttttagcagaggcctgaatgaagtgagtaagcaaaccaagtggatatctgtggggcaatctttgcagacagaaggaaaacagatgcaaaggtcctggggcaagaatggacttgccagtgattgatgcaaggcagggctagagcagtcatcttcaatttcccctcattttccttctccaattttgagtctttaatgaacattatgattgcttattagtacatctgtaggaatgtcaacaagatcaaagccattcttttatggtaagttgtctttggctaagaatgctatccacaatgacaatgaaattctaactttggtcctatcattgattgctatattaaaatccttttttctttttttcctcttctacttggtccagagcttgggagaaagaattcgagggtggttaagcagctggctagaggcagaggctcagacagaagccccaaggcctgagggctgcagcaggaaccctaaaaggctactgagttcaggaggctcctagaagaggttgaaatcctttgctttttgcttattcattttaattatgagttggaacaggtgtgtcctatgctggcatgggtacttcctcgaattggactggccttcgggcccccaaaggggtatgttttattagttctgggctttatcttacagcattattcctagggtcatactaattactttgtgaatctggttaaagtgctcatgatatcttgttcttgagacgtgtgcagtgctgggaatcaatacacttcctgttttgacttggggttgattcttgcacttttccctatccgcagcccccaccccctgccccatttttgctaacctggtcctgcaacctctgctgtgcttgtagttttaccaactgcctgcttctgactccaaactgcccagtagcactctccccacacagtgggatgtgaactgtgccacggtactgcatggcctttgtcatgtgcccaagcctagcaaaggcacaggggcaaatactgtgtgtgagagtgatttctataccatgtgttcctgtcccttaaggatcttatggcttagtaggagagataatacatgtcactcacctgcttgaaagccttcctcgtctccttatttccaattataatctaatccgagggcttgcaaggtgctgtatcatcatgttccaccctcttcatgtaattcactatcttgattttcagagcatgttccctgttgctgtcccagtcaacatattcaccccaaaaggcctataaccagtagagatcgtgccacacaaaccactcttagttttgggtgcatttgtctggtcttccaaactagattgaaagctctgaaaaaaaaaactatcttgtgtttctatctgttgagctcatagtaggtatccaggaagtagtagggttgactgcattgatttgggactacactgggagttttcttcgccatctccctttagttttcctttttttctttctttcttttcttttttttctttttttttttgagatgtcgtcttgctcagtcccccaggctggagtgcagtggtgcgatcttggctcactgtagcctccacctcccaggttcaagcaattctactgccttagcctcccgagtagctgggattacaagcacccgccaccattcctggctaatttttttttttgtatttttagttgagacagggtttcaccatgttggtgatgctggtctcagactcctggggcctagcgatccccctgcctcagcctcccagagtgttaggattacaggcatgagccactgtacccggcctctctccagtttccagttggaatccaagggaagtaagtttaagataaagttacgattttgaaatctttggattcagaagaatttgtcacctttaacacctagagttgaacgttcatacctggagagccttaacattaagccctagccagcctccagcaagtggacattggtcaggtttggcaggattcgtcccctgaagtggactgagagccacaccctggcctgtcaccatacccatcccctatccttagtgaagcaaaactcctttgttcccttctccttctcctagtgacaggaaatattgtgatcctaaagaatgaaaatagcttgtcacctcgtggcctcaggcctcttgacttcaggcggttctgtttaatcaagtgacatcttcccgaggctccctgaatgtggcagatgaaagagactagttcaaccctgacctgaggggaaagcctttgtgaagggtcaggagatgttcaccagccaaggttgtgtggttcagtttctcttttgttgataagatttgtcactgttttgataggggatgcataatggagtatttggatttgttattgtaaactatgcagcatggttttcaaaaaacaacaacacatctttataactttaatgcaactgtaaagggttataggtttttttttaacatcagttctatcattttacagagaaactgaggtagtaagaacaagtacagagttcactaacagcgtgcatttgatgcagccaccataaattcagaaaatatcctcaaagccctcctgtattcagtgacttttttttttctttgagacagagtctcgccctgttccccaggctggagtacagtggcgcgattttgcctcactgcaacgtctgcctcctggattcaagcaattctcctgcctcagcctcctgagtagctgggattacaggcacccaccaccacgcccagctaattttttttattttttattttttatttcttttttgagacagagtctcgctctgtctcccaggctggagtgcagtggcacaatctccgcttactgcaagctccacctccctggttcacgccattctcctgcttcagcctcccgagtagctgggactacaggcgcccgccaccacgccaggctaattttttgtatttttagtagagatggggtttcaccgtgttagccaggatggtctcgatctcctgacctcgtgatctatctgcctcggcctcccaaagtgctgggattacaggcatgagccactgcgcctggccaattttttgtattttttagcagagacagggtttcgccatgttggtcaggcttgtgttgaactcctgacctcaggtgatccacccgccttggcctcccaaagtgttcagtgactattaaatatgcactgtgaaatgtattcttagttatcagggaggggttgcaggggagaggaagtgaccttggatgtagagataaatgaggtatggggggactcaaaatcccgttatatgcatatatcctttttagctacaagagttaggtggattataatttacatttgtttgttcattgtgagttgtttttaacaagtaatgtcaatatagaagcgtcagtggatccataggaattacacttgtgtgattatttgaaatgataggttgagagagaaaagtcattcaacagtggtgggataaggttccctctctcttttctcttttttttttgagatgtagtctcactgtcacccaggatggagtgcagtggcatgatctcactgcagcctctgcctcccaggttcaagcaattctcgtgcctcagcctcccaagtagctgggactataggcatgtgccaccacgcccggctaatttttgtaattttagtagacacagggtttcaccatgttggccaggctggtgtcaaactcctgatctcggcctcccaaagtgctgggattataggcttgagccaccgcgcctggcctccccgtctcttttttagtacttaggtatgctaaaagtggacaagaccagagcagatgttgtggtaacaaggcaaatctgttctttacagtggagtttgccctgatttctcattctgttctcgtctgacgcatacaggtgtatctatagaacttgtaaacacgttcacattggtttttttcattggctcctcaaagtagaactatgaagtaggctgcacagatgccagtattaccagagcataggtaaaaatattaagtaagaagacttaagatcacaaaactagaaatgatggaactgggttccagtcctagtttctttgtaaaatgaacatttattttggactaactttcaatgtacagaaaagttatgaagatagtatacaggattcctgtgtacccttcatccagtctcccctaatgttaatgtctggttcatttgtcaaaactaagggattagcctggatatgattttgactaaactaaacatgagtctccttagtctccattggtctacaacagtatctcagttctgttttcatgatcttcacagttttgaagaatactagtcattactttgtagaatgtcccttaatttggctttgtctggtgttttgctcatgataagactggggttgtgggttttggggaagattatgtcacacaggtgaagtgcccttcccatcacatcgtatcaggggtatataatatccacatgatgtccctggtgctgttaaacatcatcacatgcttgagttagtgctggccgtgtttctccacttaaacttagtatttttccctttccatattcagttctttggtatcgagttcctaagtccatcccacacttaaggggtgggaattaaacttcacctactggagtggggaagtacatatgtaatctggaattctatgaggaaaacttgtcccttctcccctgctatgtatttaatctcttagatcagtatgaactcacacacatttattttatactttgggttatgatttcagtagcaacattacttattttacaggaattattccagctttgaccatgggagctctttcaagttggatccttggtccatttgacatgcctcttcttttatatttttgagcactgtctttctagcaccgtatgatgctctagacttatcttggatttttcctgccccagccctagaaatcagccagttctccaaggagcagtcctggtctactgactccagatgtatgattctatgcatgattctgccttttgacactaaggagaggaatattctgtcttgtaaatatgaagatcaaagtgattttctaattccggctgttggttttcttatcccagtatttaagataccattgttgttcttcacagacttgaaatgtcattttattttatttgttttttaaatttattttatttttttttgagatggagtctcactctgttgcccaggctggcgtgcagtggcgcaatctcactgcaacttccgcctcccgggttcaagaaattctcctgcctcagcctcctgagtagctgggatcacaggtgcccgccaccatgcccagctaatttttgtatttttagtagagacggggtttcaccatgttggccaggttggtcttgaactcctcagctgatccacctgccttgtcctcccaaagtgttgggattacaggtgtgagccaccacgcctgaccgtattttattattttattattatttttgagacaggttctccctctgtcacccaggctgggggacagtgacgcaatcatggctcactgcaagcttgacctctgggctcaagtgatcctcctacctcagcctcctgagtagctgggactacaggcttgcaccaccatgcccaactaatttttttattatttgtagagatggggtctctctattttgcccaggttggtcttaacctcctgggctcaagcgatcctcccacctcaacctctcaatgtgtcgggattacaggcgtgagccaccacacccagcccactttatttttgtttagtcacaagaacaaaatgttttctttttttgagataaagtctcgctctatggcccaggctggagtgcagtggcgcgatctcagctcactgcaacctctgcctcccaggttccagtgattctgctgcctcagcctccctagtagctgaaactgcaggcatgtgccactgcatccagctaatttttgtatttttagtagagacagggtttcaccatattggccaggatggtttcgatctcttgacctcgtaatctgcccaccttagcctcccaaagtgctgggactacaggcatgagccaccgtgctcagccaagaacaaaatgtttttatcaggaaattagctgctaagaaaatgtcagtctgctctatgaaatagaatatgtttattataatcagcattgaggcagaagtctgaagcaggaggatcatttgagcccaagttccaggctgccttgaactatcatcttgccactgtaccgcagcccaggtatcactgagaacatgtctctgaaaaaaaaaaaaaagttttcaggggtgagacttggtgttaaccaaataaagtgcaagtatactttgtattttccgtgaatattaacgctttagcttaattcattgtcaagagctatataaataagctttaggattttgattaatagaattaatgactccttttataaacctaattatttttaagttttacttttgtaattttttttttttttttgagacggagtctcactctgtcttccatcctggagggcagtggctcaatctcggctcactgcaacctctgcctgcaaggttcaagcaattctcctgcctcagcctcctgagtagctgggattacaggcgtgcaccagcatgtctggctaatttttttttgtatttttagtagagacagggtttcaccatggtggccaggctggtctcgaactccttgatccgcccacctcggcctcccaaagtgctgggattacaggcatgagccaccatgcctggttgcttttgtaatttttgagtgtataaaataggtaactttgttttaaaatatttgatccaaaggactgttcagcagtctggggtaaaggaattacagcattatgttaggaatcaggcagcctgtgtgtgtgtgtgtttttttttttaggcatggtttcactttgttgcccaggccgaagtgcagaggtgccattgtggctcactgcagcctcagcctcctgggctcaggtgacccacccccctcagcttcctgagtaggtgggactacaggcgcataccatcacgcttggctcatttttgtatttttcatagagacggggtctccctgtgtcacgcaggctggtcttgaattcctggactgaagcgatctactccaccttggcctccaaaagttctggaattataggcgtgagccaccatgcctggctgagacctgtgttttactctttgctctgtttctaacaggcgaggaggtcctaagggaagtttttagactctgtagacctagatattcttatctgtaaaagaggagggaagatggttggccattacctttaagaccaatgcccccaacaaaacagatttattgaggcgttttggttttttaaaaaatatgttgtagagatgatgtctcactatgttgtttaagctggtcttgatcaagcgatcctcttgcctcgaccgcccaatctgttggaagaacaggtatgagccaccacacttgaccttttattgaggtttcaaggacgcttttgacaattctgtgctctttttacggtggaatttagaagcctatgcatttgtgtgtgtgtgtgtgtgtgtgtgtgtgtgtgtgtgtgtaatactggaacaggcctaatgttacaagttaaaggtagatatttggtctagtttgtacttgaaagggaacatcattcaggaaatattacaatactaggagaaagtcttacagacatgaaatttttatgtcctttgatgttctgatcttcccacatagaatgcataatttcctttagcaaactcttctcagttatagaagttggatactgccgcctagaaggttgctaattcctgtttcctgaagcagacatagctttctccattctgtgttacacacctcacttgtggaaggtttgttctatagttgatatgtggggagtttattcatcttctaaaagagggttacagcagattatgttcattttttaattctttaatatctggctttgtgaagatgaaggaagaaaaaacctgtattccttgagacttggcttcctgaccatgattcctcaagtttggggtgggagagggcatgaagacaagggagtgtgtgaggtttgaaaacagtgatattttgtactattgatttgatgtgtttttagtcgcaatatttaattcacattgatttctaaataaaatcaaagacaccatcaggtttttgtgtgtgtccttttttttttgacacagggtcttaaaaaagacccatctgttgcccatgctggagtgcagtggtatgattatagcccactgcagcttctaattcctgggctcaagcaatccttccacctcaccctctcaagtagctaagattacaggtgcatgccaccatgcctaatttttattttttttttaagatggagtattgctgtgtcacccaggccgcagtgcagtggtgcgatcttggcccactgcaacttccaccacctgggttcaaacgattcttctgactcagcctccctagtagctgggattacaggctcccgcctctgcgccaggctaatttttgtattttagtagaaacagggtttcactatgttggtcaggctggtctctaactcctgacctcaagtgatccacccgtcttggcctctcaaaagtgctgagattacaggtgtgagccactgcgcccggactacctgactaattttttaagtattttgtagagacagggtctctgtgttgcccaggctggtctcaaactcctggcctcaagtgatcctctctccttgactccccaaaagtgctgggattacagatgtgaggcacgactgaccatcagtattttaaatttaagaaaggagagaaatgggttatggtggcatatgttctttgtttcagctactcagaagctgaggcaggaggatcccttgagcccagaaggttgaggctacagtgccctaggatcacacccctgcactccagccctggccaacatagtgagacccatctcttttgttttgttttgtttttgagacagaatcttgctctgtcacccaggccggagtgccgtggcacgatcttggctcactgcaacctccgcctcccaggttaaagcgattcttctgcctcagattcccgagtagctgggactacaggtgcatgccgccacgcccagctaatgtttgtatttttagtagagacagagtttcaccatattggccaggctggtctcgaactcctgacctcatgatccgcccgcctcagctcccaaagtgctgggattacaggcgtgagccactgtgcctggctgagacccatttcttaaaataaggaggccaggcaccgtggcttatgcctgtaatcctaacactttgggagactgaggcaggtgaatcacctgaggtcaggagttcaagaccagcctgacaaacatggttaaaccccatctctactaaaagtacaaaaattagctgggcatggtggcgcatgcctgtaatcctagctactcgggaggctgaggcaagagagttgcttgaacctgggagatggaggttgctttgagccgagatcgtgccattgcaccccagcctgggcaataagagtgaaactctatctcaaaaaaaaaaaagaagaaagaaaagaaaagaaggaatggagtcccctggtgtttagagattgaggagcacttgtatacataataaattgttgcagaattgccccacttgatccgaaatgtgaagatcatgtggaagatgcaggaaaaaatgaattcagatgatctctttgatgccttataaaaatattacaaatgcagtatgttacactatgtgatatacactggagctatattgctacagtattattgtacacatactatactatactacagatacagtttttaaaacaatttgtaattatgtgtttaattttataacttgttttgtagggtagaaattttaaagcctgcttatttactaccataatgatcattgaagtttattattgattaattttaactaaaaagttacttggcctttaattgtgataggtaaaataatattctcctaagaaccttgtgatggtgtattatttattccttcaataagtattttttcagggcttactttgggttatatttcctgaaattaatgaatcaaaagttttactgtattctgtgaacttgtttcagaattctcactacggtagatgctttgtgtattttacttgagtcctaggaagagagaaaatttagtttcttatttccttcataaatcctgcagaagttttaataaattagtacatgtgaagaactgctttcaggaatggataaatgttttataatattcttcaatgaagagaaacattaaaaagtggcaagtttactgtcatagaatgctggaagggttaaaattgtatttattcagtgattgttttcactacaacgggtaactcaagtttctctgttttcttttttcatacttttttttttcttttttttttgagacggagtcttgctctgtcacccaggctgcagggcagtggggcgatcttggctcactgcaacctccgcctcccaagttaatgcgattctcctgcctgaacctcccaagtagctgggattataggagtgggccaccacgcccagctaatttttgtattttaactagaaacagggtttcaccacattggccatgctggtctcgaactcctgacctcaaatgatctgccttcctcggcccctcaaagtgctgagattacaggcgtgagccatcgtgcccagccaatggtttttttaaacatgtgtcattttccttttcagcaccataggtatatatattttaaagtatttgcaaatgcctgggtaaacattcttcttttttcataggaagatattcatagagttaaagtaatttttaaaatttcaatgtaaaacatgattttaaagacattgatgggaaattgctgtgagaaatcatctgtccctgtactagtgactacagtttcactgtactgtcagctctgtgagggcaacaaagtgtcaggtttttaatttccactaaggtgttcaatcaataaatggatcgatctatatcaaaggacattgttgagtccacttgaatttttttttcaatattttactataaaaattgtaaacatacagtaaagttgagagaattttgcagggaacacccgtatactcaccatctagattctatcattaactttttttttttttttttagacggagtcttgctctgttgcccaggctggagtgcaatggcgcaatcttggctcactgcaacctccgcctcccgggttcaagcaattctcctgcctcagcctcctgagtagctgggactacaggcgcccgccaccacgcccagctaatttttttgtatttttagtagagacggggtttcaccatgttagccaggatggtctcaatctcctgaccttgtgattcacccgcctcgacctcccaaaatggtgggattacaggtgtgagccaccacacccagcctcattaacattttattatactcgctttatcacatatttttctataggtttattaatatatccttttattgtttttgagatggagtctcgctctgtcacctaggctggagtgcggtggtgtgatcttggctcactgcaacgtcttcctcccagattcaaaggattctcctgcctcagcttcctgagtagctgggattacaggtgcccagctaatttttgtatttttaatagacatgaggtttcaccatgttggccaggctaatcttgaactccaaacctcaggtggtccacctgccttggcctcccaaagtgctgggattccaggcatgagccactgcatcggcctggtttattaatatatcttcttttgggcgcatttcaaggatttttctggactatcatggaagttaatttgtatttctaatttgtatttgtgggccatagtttgaattggtgcaagagaggtgatgaggggtgagttttaggcattagatgtagctctgttactgacctcatatgaagtatattgataacttatgatttcttagtaatgttcctatgattttattattgtttccagctttttatataatcttctgatagaaattcctcggttgctgcaatgtcatgatgggtgactgcagattgtgcgtgtttactgtcgctattacaaataacttgaacattatttcacatggggcttcatccttcctgtgttttctgtttaggagtagcccatcgaagccagagcagtgaaggagtcagttctctcagcagctcgccctctaatagccttgaaacgcaatctcagtctctctcacgttcccagagcatggatatcgatggtgtctcatgtgagaaaaggtaaaatgaagccagttttctaatatgctcttttatttagggaaagagaaagatccattcactttagcctctagtccatagtcagaaatgccagctagagacccatgccagtccttagcaaattagtgtcaaatgtattaaatttaaagattttgtattattcagaaatattcttcatacttttgttgctgttgagacagagtttcactctgtcgcccaggctggagtgcagtggtgcgatcatggctcactgcaatttccgcctcccaggttcaagtgattctcctgcctcagccacctgagtagctgggattacaggtgtgtgccaccatgcctggctaatttttgtatttttagtagagacagggtttcagctgttggccaggctggtctcaaactcctggcctcaagagatcttcctgccttggcctcccaaaggactgggattacaggtatgagccactgtgcgtggcccactatacttgcatattaaatgtcttttatgaaataatggtgtagtcagttaaaaaaaatctattgttctcattttgtaaatataaagttggcaagcatatgcctctccctaaaacttttactaattagtgaaatttaaaagtttggaatatttcatacaggtaagccaaataaataccctatttgcttcgtacggatcaaggtgtcttgaaagagccctcctgtgttgcatatgtgccaaaaatgggtggtaagagtggctgaggtattgactcctttcatggttgagcaagtcagactccttggacctggctcctctcccctcaagcagtggcctcggtttgtgtcagtgggctaaacagatgaagaggggaattaagtccgggctcgatggctcatgcctgtaatcctagcactttgggaggccgaggcaggtggatcacttgaggtcagaagttcaagaccaacctggaaaccctgttgctactaaaaatacaaaaacttagctgggcctggtggcaggcgcctgtaatctcagctactggggaggctgaggcaggagaatcacttgaacccaggaggtggaggttgcagtgaaccaagattgtgccactgcactccagcctggccgatagagtgagactccatctcaaaaaaagaaaaaggagaattaaaaatatgaataaggggctgggcgtggtggctcacgcctgtaatcccagcactttgggaaacagagacatggatcacttgaggccaggagttcaagaccaacctgtccaacatcgtgaaactccgtctctactaaaaatacaaaaattagctgggtgtggtgttgcatgcctgtagtaccagctacttgggaggctaaggcaggagaatcacttgaacctgggaggtgtaggctacagtgaactgagatcacaccactgccctccagcctgggtgacagagtaagactctgcatcaaaaaaaaaaaaaaaataataataataataataaccaaatagaatatctagaaatgaaaaggtaatttacattgagaacttgctgtaagagttaaataggggttagacatagctgaagaaagaattgacaaactgaaagagctgaggaaattacccagaacgtaccacaaagaacaaagcagatgaaaaatataaaagatatttagagatacagaggacagagtccttggtttctcctgaaatgtatctaggattgaaatttctgggtagaaaattaaaattgtagtgaatgcagatgttcagctttaaaaaagaaaaaaaagacaacaggggtccaggatatatctaaacatcaaaaagggagaatagagagttggagagatttccttctgctcactcttattccacatttttttctctactggtttgaaagatattattttaaaaaatcaggccaggagcatttgaaagatattattttaaaaaatcaggccaggagcagtggcttacgcctgtaatcccatcactttgggaggccgacgcaggtgttcacttgaggtcaggagttcgagaccagcctggccaacatgttgaaaccccgtatctactaaaaatacaaaaattagcggggcatggtggcatgtacctgtagtcccagctactttggaggctgaggcaggagagtcgcttgaacttgggaggtggaggttgctgtgacctgagatcgcaccgctgcactccagcttgggcaacagagtgagactttgtctcaaaaaaagtaataaataaataaacacatcatggaaaattgggtgtccatttcctcaagcatttgtccttattttttttggagacggagtctcactctgtctcccatactggaatgccgtggcacaatctcggctcactgcaacctccgcctcctgggttcaagcaattctcctgcctcagcctcccgagtagctgggattacagacatgggccaccacgcatggctaatttttgaatttttagttgagatggggtttcaccatattggccaggctggcctaaaactcctgacttcaagtgatccacccgcctcagcctcgcaaagtgctgggattacaggcgtcttatatttcaattaagtttgctttaaaataatacaatataatataaatatagtatatcatgatcaatttaggcttactttaggaatgcaaggatgcattgatattagaaaatctataaatatcatctaccatattgcatgttaaaaagaaaatccttataatgttggtagctgcaagagtttgataaaattccacattaattcatggtaataagaaaatgaggaacagaaaggagtatctttaaactcacagtgtggcacagacaaagttcaccaaatattccacaggctccccagaatttcccattctcttttacagttagattggggccaatgactagttctgtcctgtagactatgaactagagtgacgtgtcacttttagatgaaggcagttgagccaatgttcctcctccgtccctctcttctcttgctccagtgaccttggaggctgtgtattgcagatggcatagattaaagatggagtaaggatgcttcactctcatcagactttgtgtaagcaagaactaaatccttacagtgttaagcctcttaagatttcagagtgtatgtgttactacagtatagcctgtcttactctaactaatataaagggcatctaccaaaaaactacagcaactctcctattcagtggtgagaagttagcatcattttctgtaaaatcagcaataagaacaaggatgactgctatttcttcttgtatttagcagtgcagtaaaacaagtaaggattggaatggaagaaacaacagtaataatttgcagataaattatttacatgttggctgggcacagtggctcacacctgtaatcccagcacttttgggaggccgaagcagacagatcacttgaggtcaggagttcgagacaagcctagccaacatggtaaaaccctgtttccactaaaaatacaaaaaaaattagccgggcatggtggtgcgtgcctgtaatcccagttatttgggaggctgaggcaggagaattgcttgaacctgggaggcaggggttgcagtgagccaagattgcaccactgcactacagcctgggtgacagagcaagactctgtctaaaaaagaaaaaattatttacatgtaaactttctatgtataaataaataagttgcttataagaagtgtatatttaaaatcagttgcattcctgtctgccagcaacaaaaagttagaaaacgtaatttttaaaaaggtgccattcacaatttcattaaaaagtattaacatatggtacctaggaataaatttagcaaaagaagtataaaatttttatagagaaaattactaaagcttattgatagaccttaaagaagatcttaatacttggagagtaatgaaaactcagtaatatattacttctccccaagttgatctctaagagtgaaaaaaattttggtcaaaatcccgggagggtttttaaggaattcctcaggctgattcctaagtatgtgtagaagaggaaagagccaaggatagcaaaacctcttaaaggagaagaataaagtggagacattgacctagcagatatcaagatttgtgaagttttagtaattaagacaaagtggtattggccagggacagacaaattgtctaacagaacagtaatgagtctccagaaatagacccactcgttaatgaaaattggacacgtgacataggagctttcatattaatgtaaaaaggatgatctttccagtaaatggtgctagggcaattgttcaatcggggataaatgatatgtacttaaccagtttttataataagacttcagttgagttttttattttcttaattaaattttttatttttattttttatttttttgagatggagtctcgctctgtcgcccaggctggagtgcagtggcgcagtcttggctcactgcgagctctgcctcccgggttcaggccattctcccgcctcggcctcctgagtagctgggcctacaggtgcccaccaccatgcccggctaattttttgtattttttagtagagacgggtttcaccatgttagccaggatggtctcgatttcctgaccttgtgatccgcccacctcggcctcccaaagtgctgggattacaggtgtgagccatcgtgcctggcctattttctcaattaaatttttaaaaatgtttatttaattttttttagagccagagtcttgctatgctgcccaggctgggatacagtggttattcacaggcacagtaatagtgcatacagcctcaaacttctgggctaaagtgatcctccagcttcagcctcctaggtagctcggaccataggcgcatgccaatatacctggcctggttgaattttatgtcattttaaaatactatatataggtaacctactttaatgatatacttttatttatttatttatttgagacggagtttcgctcttgttgcccaggctggagtgcaatggtgcgatctcggcttaccgcaacctctgtgtcctgagttcaagtgattctgctgcatcagcctgccgagtagctgggattacaggcatgtgccaccacgcctgactaattttatatttttagtagagatggggtttctccatgttggtcaggctgatctcgaactcctgacctcaggtgatccacctgccttggcctcccaaagtgctgggattacaggcgtgagccactgcactcggccaatgatatacttttaaaaagtaagcccaagaaaatgacaacttaggaaaaatatttccaacatgtataagagacaaattgtttagatcctaatttatgaagaactcttaaaaattaataagaaaaaagatggaccattatcattttcctttcctgattaactgatattttaaaacattttctcacccagcagctacagtgacattgtgcggatttataaaaggtaaaaggcttgtttgtcttttgtactttaagcatgtcccaggtggatgtggattcaggaattgaaaacatggaggttgatgaaaatgatcgaagagaaaagcggagcctcagtgataaggttggtaagcgatgaagcccttggtacaggtaatagaaataaacacatttcatgtcttgtatctgtagagtctgttagattggggccacccgaaatcaggaagtcctaggcaggtgattatttttattcttttgaggaaaaatgaataacctagattacccttattcatgaaagtgtaactcagtcctttgatctgataatatccatctgtttttggttcagggccatgattttatcagtaaatttaggttgtaataggaactaatttagagcaaattagaattctttctgttggtcttttgcttttttttttttttttttttttttttttgagacagagtctcgctctgtcgcccaggctggagtgcagtggtgcgatctcggctcactgcaagctccgcctcccaggttcacaccattctcctgcctcagcttcccaagtagctgggactacaggcgcccgccaccacgcccagctaattttttgtatttttagtagagatgggttttcaccgtgttagccaggatggtcttgatctattgaccttatgatccacctgccttggcttcccaaagtgtgggattacaggcgtgagccactgcgcctggcctggtcttttgcttttaagcaagtagatcatcacatctttagcagtattctgaggaaaatgactgggaattgaagcaagaatatgtagaatctagtcgcaagtagaaggttttggaaaacatgaagcctttatatttgaatatcacctgagcttagtgctctgcatttagggtgtgtgtgtgtgtgtgtgtgtgtgtattaatatagataattacatcactttctgtttagtaaattattaggaatcctttagcaacacatgttaatgattattggaagttgcactgtaaacaaaaataaagacaaacaaaggaaaaaataagaagttgcactgtagcctcctagtggtgcagtgctttattttgtatagttctttaatgtttacaaaattcttttttatatgctgttttatctgtggtggtatgtaatgagaaatgttacaattttgaaaaattcctggaggaaaattggtcatgcacctggagtgttaacctggtcctatggaattcagaaaagtaaatagataggatatgtacatcctctgtcacatatttttccttggtgacttttgataatgactttgctctttttttttttttttttttttttttttttttttttttgagacagggcctcactctgttgcccaggctggagtgcaatggcgtgatcttggttcaccacaacctccgcctcctgggttcaagcgattctcctgcctcagcctcccaagtagctccgagtagccaggcccgcaaccgcgcctggctaatttttgtatttttagtagagacagggtttcaccatgttggccaggctggtcttgagctcctgacctcaggtgatccactggcctcggccttccagaatgctgggattacaggtgtgagccaccacgcccggccatctttgctcttttatgctccccatagattgtattgtaagctcatgagacttagatgttgtaactttgatgttataggaataggcttacttttcccctaatcagtgggtgaatggtttcatgcatttttaaaatatcatcactaataatgaattaaatcagaataacgtattcctattgaaacacctaactcatacctcttatttgaaattaacctgcaaatcttcttcttcaccaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaaggtaggaatctagctcagcagtcttactgcagagtactcgacaagaaaataagatgtgagatctttgccctctgttatccacattcactccatcttgctcttgggttgtatttttgatgacagggatacttcttgatgaggacacaattgtttagccactttcttccctttccactgatcttatcgataacttatttttcatttccatgatttctataatactatgtaaataggttaatggtctccattttctcagggttgaagtttttctctttgtagtaagaaggtgcttagagcattacctcctctttatttatttatttatttatttatttatttatttatttatttatttattttgagatggaatctcaccctatcaccaggctggagtgcagtggcatgatctcagctgactgcaacttctgcctcccgagttcaagtgattcttctgcctcggccactggagtagctgggactacaggcgtgcaccaccacgcccagctaatttttgtagttttttttgtttgttttgtttttgtttttttttttttttttgagacagagtcttgctctggcaccaggctggagtgcagtggcgcagtcttggctcactgcaactcccacctcctgggttcaagcaattctccagcctcagcctcccgagttgggattacaggcatgcgccaccacacccagctaattcttgtatttttagtagagacagggtttcaccatgttggccaggacggtctcgatctcctgatctcgtgatccgcccgccttggcctcccaaagtgctgggattacaggcatgagccaccgtgcctggcctcatttttgtagttttagtagagacaggatttcaccatgttggccaggatggtctcgatctcttgacctcgtgatctgcctgcctcggcctcccaaagtgctgggattacaggcttgagccaccgagcctggccttacctcctcttatgaagtatagatatagtgggtggtctccagggatcctgagagaagtgttctgtatgagctatacctgctttaagtgcctatgaagccatgtatagacggtggaattggtctatttggttaaattgcttagcaagatagaacataatgacattttgctgtgtttctgatattccactttaagaggccaagcttgtaacaaaataataaaactcttagcaagatatcagcatcatagggcactatcctttttctttacagtagtcatttggaacgcagaagaggtatgggaggtgtgctggagtggtttttttggcctatcactggaatgtaacttccctcatggtagggatttttgtctgttttactcattgatgtatccctagaaggatatcttgcacaaaatagtccctcaatagatagattttaaatggatgcgtgaatatcaaggagatcacctttctcttttctatgctgcctatcttctgaggagggaaaaaaaaagtcctttgtatttctggaggatagataagactatttctgattttacttattaactctgctaatggagcagaccatgtatttgaaactctgctacttgttattcttattataaatcttaagattctctgtcttacacatgtaagtggcaaatctgtcttacacatgtaagtggcaattttaaataaccaaatcagataaaatttccatgagttaaaacttttgttaaaacaagtgtcttacacatgttaagtggcaactctgtcttacacatgtaagtggcaattttaaataaccaaatcagataaaatttccatgagttaaaacttttgtttagtggtatttaaaatgtatctaaagaccaacagtaaatcaactgggagctgcaaagaataagaaggaagctagaatgtagcatttgctcctgaaagccacatggtgactagatgttggacccttcataaaatcttttgaaccttggacttaatagttttattactatctataaaacatatctagactaagaaatattaacccagttgcatttgtagtataataaagtaacctctatagttgggagtagcttctttttacaattaatatacatcagcggtaactctcaatgactgtaccccaactttctttttaataaacttttaattttggaatagtttcagttagtgcagggagttcctatatatactttacccagtttcccctgacgttaatatcttatataaccatggtacatttgtcaaaactaagaaattactactaactaaacacaaggctttatttaggttttccactaatatccttttaccattccagaatctaatccaggatactgcatcgaaccatttggggtcagctggcttattcaagggctgtgtaacctgtgttcgaactgtgtgtaacctgttctttgttctgcctttccaacagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctaggtcagtgtggttctctttgcacatcttactggtagtaaaataactgtgaactacgtaggagaagggaatgtttgttgacagtgttaatcagtgtcatacagggtatggcatatatcatatttggggaggtggatttagtcattggaagtggaattctcttttctagattattattttttggctctctatggttaagatattgctagatgaaattttagaagcagttggctgtgtatactacatcattcttcgaatggggactttatcgtcttgtaagtatagcctctagatcaatagggcaattagattataattatttagatgtttatctgctagatatacttgaactgaaatgattctcctttaaaagcttgatattttctgttttagttagttatctcaagtttttctttgatttttctcttctttcctccctttctcaactaatttagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctaggtatttatcccacaggagagttgcatgtgtgtttgcggtgcagggaaaggagattaacacggtttggaagaagtgctgtgtgacactgactctgttaaattgttgttttgggttattaacctgtgtggctaactagtttggtaggcacgtactctgagtccatgcttctgccaggctctaatcatgctggaaagtttgggttgctctattctattgtgaatccctttcttccctttgagagttggggcacacaggaaccctttttggccttttgtcctgttgccagtggtagttgaaatgctatcagaccaagcaggtgtgggagcaaatctgggcctggtgttttttacttctggtgagtggggtgggtcggttcatgtcctgacgtgttgagttttagttatatgtaagttcagtctcttagaaggaagcagtatcagaattccactaatccagtggccccttctctcaaatgtacctgtatgtgtttctataatttaggtgaattatgtttctgcatgtcagtggccaaaagttttagtgtatggtttatttaaaaggacagcagttgcaaaagcttctccccgtcttgttttttctttgttctctgatggccttttttgcttttgttgtggtagtatgtacgacaatcctttctccttcctcttcctcgcactttctggggacagtagtgatgaagaagatgaagaagaagatgatgatgatggtgatggtgatgatgaaggtggtggtggtggtgatgatttttcttgtgtccagtttgggtccaggtatcagaggaatggagtcttacccctgcatgtgcgtagatgcttaggaactaacttctataagctctaacaaggggcgtgctttgaatccaggcaggatagggtcaaatgaggtgggctccagagtatattgatgtgttcagaccttctcatgggataaagtagcacataggagaattttctttttttctttctttctttcttttttttttttttttttgaggcagagttctgctcttgttgcccaggccggagtgcaatggcgcaatctcggctcacggcaacttcctcctcctgggttcaagtgattctcctgcctcagactcccaagtagctgggattacaggcacccgccaccatgcccggctaatttttgtatttttagtagagacagggttttgccaggttggccaggctggtctcgaactcctgacctcaagtgatctgcccgtcttggcctcccaaaatgttgggattacaggagtgagtcactgtgtctggccccagaattttcagagttgtcgcctggcaagtttggaggaaaactttatgtataatcatttttcaaaagcatgaaaacagattaaagatcagtcatcaagtttatccacctttagatctaaaatgagggacccttcatttatctattgcgagaatgttattgtgaactaccagatgtgacaacttgtactctctgaggcatgttttcttaagtacagttgcatgaattgctgctatttagtaacgggagaggggctgggatttgggggaggtgtgtgtgtgtgtgtgtgtgcgtgcgtgctcccttcccaccccctcccagcctccaccgcccccctgttcacccccattgagctcagtctgggcaatccatcgaagaacatatgaggtcataccatctgcataactgtgactttgctttcatgtctagccttaaatttctcttagcacctcctggacctcagtgaagccagaccccatttgtttaaagagcctttgaaatgaccgcagaggctgaaacatagttccggatgttgctgaatgtttacccctggaaaccgagtgaaaagcactacttgggttgtgtaggtgactttgagcaagagaatataatagcaccttctttctaatcctctgactcattgtcttacaattttgctcttaaattgaagtttcctgtggactgagttggtgtttgtgcccagcactgttcaaaaataactccaggctataaatagagactgcagtaggagttaggtacacttcattcaattcgatggtgttcagaagaatcattagagaatacgtaaagagacagaggaatgttgatgcaaggttgaatattgattcaggaaggttgatatttgtattacgctgaacattttatcaccatttctcaagtaaatttcccaaaggtgaaagtgtctttttcacgtagataaaatcctattgcatgattatagtaataaagcaggcatccttcctaggaaccagtttccacatggtaaaagtgctgtgttacctgttttactgtaaattttctgtgggagaaattctctctccctggcctatttagttgtgactttctctaacaaccgtatcagattgtgtgctgcttttactaatacctctctttctggacttctaacaccccagccttgcctcagatctaaattctctccctactaggaggaataaaatgtaccaagtgtataaaaatagctgcaaatactcatggagcattgtgcgccagatgtggtgtcagctctgtccatgtatcagcccctttactcctcgctgtagcctgctgtgaggaagtggcagggggaacgggggggccggggggacagacaagagggtcaaaatcatagaaatgcattcagacttgagcatcctgaatccagactcatgttcaccaccgcaccgtgctgccacccacttttccatttctgcccaaataggtcttgtttgttcttgttccttactactgtttttgctgccgagagtctgtgcatctactcggttcctttggcagggaagtgccagcatttcactccttaattacaaaatgccatcccagtcagttgatatgtcccttgttggccgttacagtgaactgtgatcatccagattttggcagcttataggttcttagttgatataaaaaagaatgccaaagcatgggtaaaaatacatgacataactatgtaaacaagtagaagaacttagggttcttctaagtagggtcagagccaagatgagctagcaaaaaaccttgttacttttttttttttgagacggagtcttgctttgtcacccaagctggagtgcagtggagcgatctcggctcactgcaacctccacctcctgggtttaagcaattctcgtgcctcagcctcccaagtagctgggattacaggtgcatgccaccacacctggctaatttttgtatttttagcagagacaggatttcaccatgttggccagagtggtctcaaactccacacctcaggtgatctgcccacctcggcctcccagagtctcaaacttctgacctcaggtggtccgcccacctcggcctcccaaattgctgggattacaggcgtgagccactgcgtccagccaaaaccttgttactttgagcagtcagcaaagaaatagtactttatccttccccctttctcattgatcttcccagaatttttttactctgaagtaagcaattttaacactcacttcttgcctggtaagactaatgtcatagaagaaagaatcatcaggggttggatcgctctctccatctgctggcccagtggattcgatgtcttataaatctttttggaagtagttgggacatacatttatatgttaagtatttataggggtgatgataaggattaattttaaaaaggtaaaacattccttctgtaatgttttgcagacttctgagaaaagaactgtttgagatataaagaactgctttttgcgcgagtggcataaatgagtgaagtgagaattaccgtgtgtgaaaagataactgttgggtggtgggcttaatgcatgggtgatgaaataatctgtacagcaaacctcctgtaacagaccttcatatgtacccccaaacctaaaataaaagttaataaaaatcaataaatcaataaataaaagctggaagttgatctgaaaaaaaaaattaccccatggtaaaggtaccgcagaagttatccggaggaaaatgtttctaattgtttcctaggaagttgatgactagaaagaaatttggtggttttgtgtttgttttttaactgtaaatatttcagtgaaggaggtcaaatcttgaatgtcacaagccttatatgagtagagaaagggaaaattagtgaatagtgaaaaacgttgacattgactctcctgtttttgctgattgtcactgcttggggttgaaacatagaaacagtggaaaagaaatcattctggctgggcacagtggcaagcacaggtaatcctatcactttggaggccgaggtgggaggcttgtctgagcccacgagttagaggctgcagtgagtcgtgatcatgccactgcactccagcctgggtgatagagtgaaaccctgtccctctcttctctctgtctctctctgtctctctctgtctttctctgtctctgacacacacacacacacacacacacacacacacacacacacacacacacagtctttccaccatatctatccctaagatcccccagtgatttcccttctcacacagagtaaaatccaaagcctctgaccatggtctacaaggccctgcatctcacgtacactccacatactacacacacacacaccacgcgctacacacacacccccacaccaagcatacatgcacatacgtgccccattctaacttaatctccctctacttgtctacttcccctaactcatgtactggactcctgttctttgcacgtaatactccctcctgccttaggcctttgtacttgtttctccccttcggaccactctccccactagacagctgtatggccggctccctcactctcctcaggtctatcagagggtggccactgacctcattgtctcaaacattatatagaacacacacgcacccatgcacgcacaccgtcgttcttcatccgcctggttccgtgcactattccaggacctacagcagtgcctagaacacagaacatccattagcaacatttgtttaatgaatttatagtgcctaaacctgcacaactctgactttgccttgctattagaaaatgcaaggccaggcgcggtggctcacacctgtaatcccagcactttgagaggccgaggtgggcggatcacttgaggtcaggagttcaagacaagcctggccaacatggcgaaacctcttctttactaaaaatacaaaaattagctaggcatgatggcatgtgcctataatcccagctactagagaggctgaggcaggagaatcacttgaatccgggaggcagaggttgcagtgagccaagatcacaccactgcactccagcctgggcaacacagcaagactctgtctcaaaaaaaaaaaaagaaagaaaatgcaaattccaaaggctgcatttgagaagtcagtaaatgggagagtaattatagaagaaactgaaacagagtcgctttaagagcaagttttgttagtgcatttaaaatgggattcagtctgcacagatcggatgcacgtgtaatccctaggcacatttacattgtgttttcagaaggatgcagctctgtttctattatgtgaagtaattacttggttacattggactgctaatgtagttatcagaaagtggtttgcatattctcccagagggaggtataattttctagatgctcttaggacttcaatatgacatatttccaagattttaggatgtcacagttgtaaaagcatcatgaattttgtacagctgagggaaaatattaaatactactttaaatatttagaaatatttcttttttgttttgttttgtcttgttttagacggagtctcgctctgtctcccgggctggagtgcagtggcgcgatctcagctcactgtaacctccatctcccaggttcaagtgattcacctgcctcagcctcccaggtagctgggattacaggcacccgccaccatgcctggctaatttttgtatttttagtagagacaggattttatcacattggccaggctggtcttgcacgcctgacctcaagtgatctgcccccctcagcctcccaaagtgtagaaatatttctccatagcataaatttatgcatgtactatattccgctttctccttcagtatcacactcaaaatttgaatctacctctttcagtttgaatctaaaaattcttgtaaatcagtttttgaccattgacacttaacgcttgtattagtgaaactggccacttttcttacttgtgatcatgatttactctggcacctttaggattaatattataattttgaaacacattgacaaatactgaggttgatgctacatttcctgtttggttaaagctttgtttaactccccccatctgccgccttgcaagtcagcttgtttggtgcctggctggtgatcactgtgttagtccatttgcattgccatacagaaagggtaatttataatgaaaagaggtttaattggctcatggtacctcaggctgttcaagaagcatgacaccagcatctgcttcttgtgagggcctcagaaagcttccagtcatggcaggaggtgaaaggggagcaggcaggtcacatggcgagagcaggagcaacagagaggaggaggatgtcccagactcttttaaacaaccagatctcacgtgaactcactgagtgagaactcactcatcaccagggggatgttgctaaggcattggtgagggatctgcccccatgatccagtcacctcccactaggcccgtgctccaacactggggactgcatttcaatgtgagatttggacaaacatcccaaccatatcaatcaccaaaacacactgagctcttttagctttgaacattctctcatagatcctgagtgcctttccttgcattgcctggcacaagaaaagcaatcgtctacatagtcttctacatacattgtcacttttcatgtgtgagtgcacggtttgtgaaaatatttcaagtggcagtgagggtttcaaatttaagttaaaatgaagtcggatgtattgctaggaatgggagtaatttcagtggcagttgcatgagccagcgccatctaagcctgctgagttcacaggcacgctcacatgctggctgggggtgctgcatcagactgaggcctggcagctggcaaggacctattgacatcaaacataagatgcttttcggccggacgcagtggctcacgcctgtaatcctagccctttgggaggccgaaatgggtagatcatgaggtcaggagatcgagatcatcctggccaacatggtgaaaccccgtctctactaaaaatacaaaaattagccaggcatggtggcgtgtgcctgtagtcccagctgctcaggaggctgaggcaggagaatcgcttgaacctgggatgcagaggttgcagtgagccgagattgtgccactgcactccagcctgggtgacagagcgagactccgtctcaaaaaaaaaaaaaagaaaaaaaaaaaaaaagatgcgtttcttcccagaaatgtaaagatgtgagaagaatggggcttattatcaagaaatagagtttcatattttcattttaaacatgaagaagatctattttcattgtcatctgcaagagctgttcataggaaaattaccctcaattgtgtgtaggtacaagcctgttttagcaaagttcatccttgcaaagtgcagtgaatatagtcactgagttatgaatgttagcagcagaggagggatcgcaggtcttgaaactaactaaaattgctacaagcaaagatagatatttattttttcctttcggggggttccctgcacttctctcattggttgatggctttttctgtttgttctagtgtgtgtttttcctgtgctttattacagtactcacttttcagttatcaagccagtcagcagataccagatcctgccattaattaataaagtataccaaaaaattagttgctataaagacacaataattggccaggtgctgtggctcacacctgtaatcccagcactttgtgaggctgaggcagatggatcatttgaggtcaggagtttgagactatcccggccaacatggtaaaacactgtctctactaaaaatacaaaaattagctgtacatggtggcgagcgcctgtagtcccagctacttgggaggctgaggcacaagaattgcttgaacccagaaggcggagtttgcactgagcagagatcacaccactgctctccaacctggatgacagagcgagactccatctcaaaaaaaaagacacaataattaattgcctttgtttgttaagggatcccacacggacctgcccagccttgtcatgactctggcgagggctttgtaggtggcttagttacctactcagtcggcagggagttggctgccttgttcctttgactgcttctcagcctcattgtctccctttgctttcacctgtcaggcctatgttataggttgttggagttcaaatttactagactctgggctgaacgccttgaatttcaaagtagcattgtttctccttcttactgaaatactttaataccatactttttttttttttttttttaatagcaggccaggctggtctcgaactcctgacctcaagtgatctgcccgccttggcctcccaaaagtgctgggattacaggcatgagccaccgtgcccagcaaatatcatagtcgctctcttgcccaggctggagtgcagttgtgtgatctcagctcacagcagcctctgcctcccgggatttaagagattctcctgcctcagcctcccaagtagctgggattacaggcacacgccaccatgcctggctaatttttttgtatttttagttgagatagggtttcaccatgttggtcaggctggtctccaactcctatacctcaagtgatccacctaccttagcctcccaaagtgctgggattacaggcttgagccaccgcgtttggccaatatcatacctgtattccaaggtcaattatgtgtagttttccaaagtctaaggacaatgatgtccatacagacatgtgtcctttaacgagagggatacattctgagaaatggatcgttaggcagattggtcattgtgtgaacatcatagagtatacttacacaacctagatcatacagcctactacacacctaggctatgtgatatatagcctgtttctcttaggctacaaacctgtactgcatgttagtgtactgaacactctaggcaattagatgcttatgccaattatggtgagtatttgtgtatctaaacatgtctaaacatagaaaagatacagtaaaaatatggcattataaccttgtgggaccactagggtatatttggtccatcacagagtgaaatgttgttatgtggcgcatgtgttacaaatgtgttccaaaattagttatgcatatctatctgtctgtaaaacatgtcaattcctcttggtcctgttagtttctagacattaattgtgtgtcctgggttgaagtagggatgtgtctctcacattcctgatgttcccatactttttttcttttattttaggacagcgtctctctttgtcgcccaggcaggagtgcagtggcatgatctcggatcactgcaacaacctcctcccacggtcaagtgattcttgtgcctcagcctcctgagtggctgggattacagacgtgtgccaccacgcccaacaaatttttgtatttttagtagaaacagggtttcgccctgttggtcaggctggtcttgaactcctggcctcaagtgatccacctgccttggtgtacgaaagtgctgggattacaggcatgagctaccatacccggccatattaccatcctttatcatcttctgtatgtaggttttttgccaagtttatgttttctcattttcttcatttcagtactccttactttttcctgtcgtaattaatccgtatgtgtcttttatgtatatcaaatccgtttgtgagttaaacaccagatttgttatgtggcctgtcaatggttgattttaactttgtttaatgtcctcaaatttaacccttgtgcttatgtttggtttttatctcagaggatagttactactaacataacagtgcttcacagtatagactgctgatattttacaaagcacctccacattatttcattaaaaccccactgcaaaagagatggaggttctagcttcaggtaacaagtaagcagtggggttgagactagaacccacgtctggttactcctagtacaatatttttgttttgtcttttactatactactttacctttttcactgatagttttagagtttttatgtcgatagcaaatatgttcatgtctcctcctaactggagagtttcttaacctttggttctattgccaaatgttagatgagggcttttgagatccatggtagaagtcacaaagatgagggctattttgtcagtcccttataacttttcccccaaagagtttgattacagcagtagcatagtctggctttaacctacagccctctgagtgatgccattctttttggttaaagtacctgtgatgtcccttccaatgcttaacacttggtaccagttcttagtgcttctggttttctaagttgccacctgcagtaagaagcagcccttcttaggtccctgaaatgttaccaaaagttactattgttggctttggagcaggtgaaacaagcagtcagggtggatcttggccgcatgggtgtttgtgctttgttatgtgtacagggatcctaacaggctttctgctgcagaaatgcaaactctgccaaaaataatcaagagataagaatcagaatttcttcttgtcttctctgaagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaaggtaatatgaaatggattaacttaaaaaaaaaaaagcctagttatttgtttgattatccccacccctggagcattcattgatttattcaatcagtaaagcaattattgagcatttgccatgtgccaggcacaatactaggaacttaggatgtgtcgatgaacaaaacagagatccctgccctcgtggaactcacattctaatagagacagagccaaggtttgaacctagatggcctggcttcagagtcctctcttgaccacactgtagctcggtaccgccagtgactcatatggccctgataattctactgctttgttataataaccaacattatagagcctctgtagattgccaaggactgtgccaggtcgacattagcttgtatcctcagttgctctgttagtgcagtggaacccggtataacataggcattcttttttcaacgtatgactaagcaaatgactctcagagagattaagtacttgtccagaatcacgtaaataataagttgcaaggctgggcttaaactcagtaagctacccttttcccatcacttctcttgactggcttcattgttttctcattttattcctatttcattttctgattttaattttacgttagaaacgaacctcgttgcccactggttagtttcatatttgtaaagggccttctttgggctttgttgtacttagccttagtggaagcgaaatgagtgggcatgtctccaaggttttttgttttttttgttttttgagatggagtctcgttctctcacccaggctggagtgcagtggcgctatctcagctcactgcaacctccacctcctaggttcaagcaattctcctgcctcagcctcctgagtagctgggattacaggcacctgccaccacacccagctaattttttttttttcttttgagacggagtttcactcttgttgcccaggctggagtacaatggcacaatctcggctcaccgcaacctctgcctcctgggttcaagtgattctcctgcctcagcctcccgagtagctgagattacaggcatgagccaccatgcccggctaattttgtatttttagtagagatggggtttctccatattagtcaggctggtctctaactcccgacctcatgtgatctgcccaccttggcctcccaaagtgctgggattacaagtgtgaaccactgcacccggcacacccagctaatttttatgttttttttagtggagatggggtttcaccatgttggccaggctggtctttttttttttttttttttttttttttttttttgagatggagtctcactctgtcaccaggctggagtgcagtggtgcaatcttggctcactgcaatctctgcctcctgggttcaagtgattcccctgcctcagcctcctgagtagctgggactacaggcgtgcaccaccatgtctggctaattttttgtcttttagtagagatggggtttcaccatgttggccaggatggcgtcgatctcctgaccttgtgatccgcccttcttggcctcccaaagtgctgagattacaggcgtgagccaccgtgcccggcccaggctagtcttaaacttctgacctcaagtgatttgcttgccttggcctcccagagtgctggaattacaggtgtgagccaccgcgcctggcctctaaggttcttaagtataagtttggtcacctcaaacttacgcttctttcttctctgacatcagtttctgcagaggcagtacacttggaaggcacagttactgtagctcgttcactaagaataaaggaagaggaaagcacgctgtttactgatggtccatcccttttaactcttatttttaacagcatggaattgtattgtttgtttcttgtcgtcctcacttccacctttccttttcagatgtgcagccagccagcagtcagccagcttctgagcaacatccgctcacagtgcatatcccatactgctttagtactacaaggctccctaacacagcccaggtatgaagacccgtgacgtgcttgacattagcaggcagagagccctagccgtcagtggacatcaggctctctggccattcttgcaccaccttagataactcccttcctcacctgtaaaatgaaggtccctttccttcgctaaaatactatgaaaataaacactcctttcttcctcatcttctaaagtagtacaaagcatattttaaaaagaaattagttatgttttaagaattctgcctgctttttgaaatagaccattgttgaactatgtggacaagcatggcagaaaattagtaactgactatacagcaactgcctgaagttggtggaggtatttgataaaatgtgtagatcatcaccttccatgtataacacggtcaatttctgttactgagtaataaacaatagtaatggaatggatagtttaggaatcaaccaaagtgctacattatttgcttctgagaatcctataaaggttgcaaatttttgtttttattttgtttttaaaaattttttttctttgcctctcagtcttctaaaggtagcaagtttttaaaaaggatgtgtatttcatttcttttatataaaaaatatctaaagggaaaagcttacatttaaaagtttaggccgagcatggtggctcacacctgtaatcccagcactttgggaggctgaggctggcggatcacctgaggtcaggagtttgagactagcctggccaacatggcaaaattccgtctctactaaaaatacaaaagacttagctgggcattgtggcatgtgcctgtaatcccagccacctgggaggctgaggccagagaatcgtttgaacccaggaggtggaggttgcagccgagatcgtgccactgcactccagcctgagtgacagagcaggactctgtctcaaaaaataaaaattaataaaataataaaaaattaaaagtttacaggccaggctcatgcctgtaatcctatcactttgagaggccaaggcagatggattgcctgagctcaggacttcatgaccagcctgggcaacatggtgaaaccctatctctactaaaaatacaaaaaattagctgggcatggtggcacgcacctgtaatcccaactactggggaggctgaggcacgagaattgcttgaacccgggaggtggaggttgcagtgagctgagatcacgccacttcactccagcctgggcaacagagcaagactgtctcaaaaaataataataatactaaataaataaaaattcacaaacataacattacatttatttattctaggtgttcttatgttattttgtatgccataaccatatgtttttgaaacttttcaaaaagaaggaaaattatatacatgtaccaaaactttaaaaaacgttccttgattaaaattaataagccctcagccactactaatattttttcccccaatttagatgaggcataaagaaacatataatacggccaggcgtggtggcttacatctgtaatcccagcactttgggaggccaaggcaggtggatcacctgaggttaggagtttgggaccaacatggtgaaaccccatctctactaaaaatacaaaaattagccaggcgtggtggcaggcgcctgtagtcccagctacttgggaggctgagcaggagaatcacttgaacccgggaggcggaggttgcagtgagccgaaattgcgccaccatactccagcctgggcaacagagcgagactccatctctaaaaaacaacaaacaacaacaaaaaaaacatataatacttcttttttatttttatttatttatttatttttaagagacagaatctcactctgttgtctaggctggagtgctcactataacctcaaactcctgggctcaggcagtcctcctgcctcagccttccaagtagccaggactccaggcacacaccatcttgcccagttgatattttcatcttttgtagagacagagtcttgctgtgttgcccagactggtcttcaactctgggcctcaagtgatcctcccacctcagcctgccaaagtgctggtattgcaggcgtgagccaccgtgcctggccatgcttccttttttcagtgcttcatttttaaagggctctatgtaggaaaagatgaattctttgaaaattcccatagtgtctcattaaaaagaccaaaaagtgattactattggtaagaagggttagctttcgcctgaaactattttgcagaatatttgggagatgtcaagtttgacttttgactgggcagttgttgctgacatgacatttcacgtgcctctgtagtgagttgacttcatcaccgtccctaatgttcatgggtccacaggtccttgcagcagccgtccttcctagtgccgtatatgctgtgtaggaatctcccatatggcttcattcaggaactggtgagaaccactcaccaggatgaagaagtgttcaagcaggtacggtcgtatgagtttgctcttgcaaattttagcctgagagcctctatgtcgaggctaatttctgaccattgaaaacttttgcctgaattcgaacatccatgtgttattagagagaaggcctacccaatattcttttgaggaaatcagattgacagctgcattgttcaaatcatgtgcccatttcaacgaatcagtcaaacatctatcttctaaacaaggtctgcactaggtgcttcgggcaatatgaaaaaaatatgtaaggccccgttcctgatttcaaggagcttttaaaacaagaatacccagagacggcataaggcatgatatgcatttgccagataagtagtgtcaaaaattcattctctgagtttgtaagattaacttaatgaccatattagctcattggcagcctgcatgccatatagaatctttgtcttcttcccactaggaaagatgtctcatatcttcctaattatttcatttggtatttatacattgttttggtatctcattgtgtaaagccaggtgaaaatgcagatatgtagtgcttaaaaataaagctgtgtacgtagtcttgaaggtttcttccaaggtgaaactttgttgttaacattgctgtttgaaggacctgtttgggaaagtaagcactttgcctttagcaactgtcacacaagttttttccctgatgaaagggcttttatcaaattttcttacagtttgctgtatcatcacttccttttttgtgactacagagaataacagaggcaatagctataattggtatgattcctttcactctgttttatacctaagattatttataactgttaattttaagacctttgaattcttgggaattgtgttttcagcagtcttcaaaatatttgtaaaagaagcagccaggatccaagaataaaaattccagttagtgttgtgtattctgtctggaattcactagctgtttatcttaggtgatgatcttactgactaatggaaatattaatggcaacatagtgagcttttcttctctagaagggtaagtgaactctcaggaaaataaatcactgtcggccgggcgcagtggctcacgcctgtaatctcaacactttgggaggctgaggcggatggatcgcctgaggtcaggagttcgagaccagcctggccagcgtggtgaaacccggtctctactaaaaatgcaaaaattaactgggtgtggtgacgggtgtctgtaatcccagctacttgggaggctgaggtaggagaattgcttgaaccaaggagacgaggttgcagtgagccgagattacaccactgcattccagcctgggtgacagagcaagactgtctcaaaaaaaaaaaaaaaaaaaaaaaaaattactgtcttggaaggtttgagtgatgcactacattaaagaggtaatgggtagtaattagaatacttttcctattcaagaagataccatttgaggaatcgagtagttctctctatataaaatcagcccagtgaccagctgaaaggggtatattgagcctactttattcataaacaaacttacacaagaggttatgaaatgacctctgggtgttttttgtttgtttgtttccccatcaccagctttggacagagaagtcctgcattttttaaattaagatgaaattcatataacatcaaaccaccgttgttgttttgttttgttttgttttgttttttgagatggaattttgctcttgttgcccaggcctaagtgcaatggcatgatctcggctcactgcaacctccgcctcccgggttcaagcgattctcctgccttagcctcccaagtagctgggattacaggcgcctgccaccacacccagctaattttttgtatttttattagagacggggtttcaccatgttggccagactggtgttgaattcctgatgtcaggtgatccacccgcctcagccgcccaaagtgctgggattacaggcatgagccagcacacctggcctcaagccatcattttgaagtgtacaattcagtggcatttactacattcacagtgttatacgaccaccacagacctgtttattctattaattaattaattaattttgagggtgagtctctctctgttacccaggctggagtgcagtggcgccgtctcagctcactgcaacttccaccttctgggttcgagcgattctcctgcctcagcctcccaagtagctgggattataggagcgtaccaccatgcccagctaatttttgtatttttagtagagatgaagttttgtcatgttggccaggctggtcttgaactcttggcctcaaggctggtcttgaactcttggcctcaagtggtccgcccacctcggcctcccaaaatgctgggattacaagtgtgaaccacagcgcctggcccagacctgtttgtttttaatcccagaattctgctgacttttcagccactcagtgttgaatactctttgtcttttcttatgtgctaccatgtgttttatctagagaggaatgataactgggatggagctgttggactgcaaagcagcattttacctttttgtcttgaaagagtggcaaatgtgaattattaaatctttgactgaaatatctacctccttttaatgtttgagaaatgttcacagataaataaatagcagctagaatttaggactggaggtggatacttacagtatttttaatcagtgctaggaggtattcatttgaaaattgaagaattatttaaaatatataggtcaggccaggcatggtggctcacgcctgtaatcctagcactttgggaggccgaggcaggtggatcgcctgagctcaggagttcgagaccaggctgggcaacatggcaaaaccccatctctactcaaaatacaaaaaattagctggcgcagaagtgcatgcctgtagtcccagctacttgggaggctgaggcaggagaatctcttgaacccgagtgatggaggctgcatttagctgagatcgcgccactgcactccagcctgtgcgacagagtgaaattgtgtctggaaaaaagaaaaagaaaaagaaaaagattatgcttagtaatattttacctgtgcaatgcacaaaaggataactatacaagaaagtgtaattatattttacttgtagcctccctaaaaaaatttggagatttttcaggacaaccagttatgaactaatttttggtgattctggaacctctgtttgtcttttcttcctcattacaatgttggcattccccagctccacacctgagtgttacttctccatttttatctggcatatgagagcaagttacatctaccttgattgttggtattgcagaaaccatagaatgatctcttccagagctgtattgatatctcacaacactccacggacactttgtcatccagggcacctgtgttttatactgtgctctttaaattattaaggtgctcatggaatgaaattagtaggaaagggaatttttcaagttttctagtggctacatagtatactcctattacaacttgttggcattcagattgtcagctgttgtttacaacatttctatttaatgttattagccttgaatcccaaccaactccctaaatgtgttgatcagtgcttgcattgtgaaatttgaagatgagctaggctgagtaaatcttacatggtgttacctggtattaatcataaatgtataaaagcagatttgagttcctttaagtgccaatagcaggttaatgtattaattacactatatgtggaggtaaggctttctaactaaagctttctttgtaaatttcaacatttaccaactagctctttgctctaatttaagtttaatgtagtaataatgttgattgttggcctgtttatcttgttttcctcaaaataaatggggaaaagcttttaaaaaatattgatagagggccaagcgcggtagctcatgcctgtgatcccagcactttgggaggctgaggcgggtggatcacgaggtcaggagttcgaaaccagcgtggccaacaaagtgaaaccccgtctctactaaaaatacaaaaattagccaggtgtggtggcacatgcctgtaatcccagctggctcgggaggctgaggcaggagaatcacttgaaccccagaggcacaggttgcagtgagccaagactgtgccattgcactccagtctgggtgacagagcgagactccgtctcaatatagatagatagatagatagatagatagatagatagatagatagatagatagaaaggaggaaatattggaacatttaattgaattttttaacaggttatagatgcttggtaatcaagaacatattagttgctgagatgtgcagaatttaattgagtagagcaacgactcctggagagttcttcaacaggctccaaatgtatgggttttgttgaattactgggttttgttgaattactgggggtcctgtcagagtattagagttcaccaaactcctcttacttctggagaattcagctgtattactttatggttagacttgtcaaagaacaggtcaacactctggctgaattctagacttttatatgcaaaaaagcttttccctggggaaggaatgaaatttggacattcagttctagcaccttatttgacatacttcccactcttagattctcttaaacttatatttctgattttgttttttttcttatagatatttatccccattttacaaggcctggctcttgctgccaaagagtgctccctcgacagtgactactttaaataccccctcatggtaaaactttgttctttttctttaactcattcaatagatgtttttctttcagattattttgacatatacttttctttcaggtccatgagatcaaccttgttttcaaatttaaaacatgaaatcactgtgttggccatgcagagtgtttggtgtgcagtgagatgcatcagtgaagacagttagcagcctggtacatcttccacctatccaagtcctagacaggagttaaatgcacttattacaatgtactttgtatagcttatgaaaaagataacttatctcctagcaatgagcataccatagttgggatgaaattttgttacttaaaaaaaaaaaacctattaaaaatgcaaataaaaaaggcaaagctgtacatactaagaaaatgaatacaattttatctttatgtgtttactttgtgcagaaaatctcagtgtagctctcttgttcaccctccctgtttcctaaggtcatatttacttgggaagtagaaatctgcttagctctttaacgcacttagagcaggcatacattgtggacagaagcttcagctagattcccatggggaggcttgaatgttgtgaaaatgctgaaactagaatgaaaattagaagctcctttctgttctgaattcgcttatttgaaattttgggagaaaagtattttgaagtgttactgaatattttcgttgcagaagtgtaaaggaaaaaatatcaaaatgaaattagtttattctatgtataaattaagtcttatgtaaattgagaccatggttgtttttcttactgtatttatttcttttacttattccactgattggattccattataccatgaattcattactgacgatctgttctgtgctagacactggtgatacagaagctaggaagacaaggtccctctcctcaaggcactcataatctactgcaaaaataagagctacagcgcaacagttgaacagatactgtgataaatgttaaaacagagctgtacacaaagggtgtatttatctatttaaaaaattcaaacctgtcatggcactaaaaggctacaagaatgctgggaaattagaaggtgaaaccagaattcctactttaaaaaataattttaagtggatttatgccagagctctttccattgtacatgttattggggctcctggtaaaattatttgaatccttatgtattgttctccctgtggcagataaaaggaagtggaataatctgattgtttgagttcagtgatgaaatattttagtgaacactaattatcaccatattatgtagatgttccttcatgggactgttggcttttgggttgtggtgtgaattagcttgatgtttcagtgaggagcttttagcatctgatatcaccaaaatgtccttttgttcaaaagacagaggcctccattgtggtagacagtgatttcattttgtgccattattgatgcttgcataataacgaggacacagtgagtgagagggtacaataatgagaggcaggaagcggaagactgttgaagctaaaatcagaaatcattgtgatcattctctaggtcagtggatcctgctgtgccatacgttggaatcaccttggaatcagctggggatctttaaaggtgtttctgcctggctccccaccccagaccttgtgatttaattcaccaggggtgtggcatggcattggggtttccaaaggcttcccatgtgatcctaatatgcagccacgtttgtgaactcctgcactaggcagtgagaacgcttccttctgagttgaggctgcctgaacctcaaaggcatctcaacgttgtgtcaatgcctaaatgcactcttcggctcatgtagcaacttctagagctgcgtccgaatcacagaggaaattaactgttgaaaataatgtttgattgagttaccatgggcatgctaaattatgtttatgtccctaaaaagtgtttttcatcgttctctaatgttaggatggttggatgtctgaaggaaagtgttggaattcttaaaagtactagaaatcttgaaaccaagttatgtttttaaatatgttttgaatttgatagcttattaaattgtaattatttatagtcatgtttaacactggcaagaggagccatctaaagtttatgaaataaatctttttgacatggaaagatatgaagtggaaaaacttttttgtaaaaaacatatatagatacagtacacaaaaatatatctgaaaactgttgctcaaaatatcaatagaggttatctttgagggtaaagcttgagtaatttttagtttcattttatatttctgttttatttcaagttttcacattgcatgtgttttagtttattaatcagaaaaagtagtgaagctgctgccatttcagagggaatgcatgtgtgccattttagagggaacgaatttatagcagcagttaaaactgtttctttatgctacaaatgacagtcagtttaagatgaaatgcatttaaatgactctgatcttatttctaggcactaggtgagctctgtgaaaccaagtttgggaagacacaccctgtgtgcaatttggtaagcactcacctgatgggcttgcacattttcagtgaatatatcataacccagaaggcattcctctagtgagatggcctggaaaatgtctcttgaaggacatttaggtgtaggcggaggtaacgtgtctgggaggctctcaactgttacatttttgttagacacgttatatcctgcattacagttgttcatttctatgatttttttcccttttttttctaagaatctcactctgtcacccaggctggatggagtgcagtggtgggatcttggcacactgcagcctacgcctcctgggttcaagtgagtctcgtgcctcagcctcccaagtagctgggaatacaggcatgcattaccatgcgaggctaatttttttgtatttttagtagagatggagttttaccatgttggccaggctggtctcgaactactgacctcaggtgatccacccgcctcagcctcccaaagtgttgggttacaggcgtgagccaccgcaccgggcctgttttttttcccttgacaagtattgtacaactaaactaacaagaggtatggaaaagttattcgagtcctttggtggtataagaagagttcatttgaacttcatccaatagtatcctgaaacttaaacattcttttttttgagacagagtctcactctgtcacccaggctggagcgcagtggcgcaatctcagctcactgcaacctctgcctcctgggttcaagcgattctcttggcctcagcctccccagtagctgggattacaggcgcacaccaccacgcccggctaatttttgtatttttagtagagacggggtttctccatgttggccagggttgtctcggactcctgacctcaggtgacccacccccacccacactggcctcccaaagtgctgggattacaggcgtgagccaccatgcctggctgaaacataaaagttttaataatatcttgtgaaaatacagaggagctggagagttttcattacatttttaccccaccggcctgttcagcggcttgactggctcttccatcttctgcctaggttgcttctttgcggttgtggttgccgaaatccttaagtcctggctgtgggcgggagctgcagagactctcttacttaggggctttctttagcttctcagtctttgcagaagatgatgtaagtatagtggctacttgtactttgctgcccttttattcagattctttcccaaatgtgcattatatgttgactgcattttttccttctctttccaggttaaagtggttgaaaaatacttctcagggcctgccattaccctggaaaacactcgtgtggttagccaatcattgcagcattacttagagctcggaagggtaagtgttcagaaaacaaatccagaggaagtatcaaagatgagctccagatacagagcttttattttgtagactggactatgcccagtagacaaacggctaacaaaagccaattcgatcttacataaaaaagataaactataagtaagtagcctgtgtcttgaataacaggttgtaacaacagcagtatgctgcctttgtatgtagcatcactgggaactggtcctaagcttagtggcccggctcctcctccagctggcccttaggcatttacactgtgagggtgagcaaggattgttagtttgcacacaccctcactgacttgcttatcccaaatgcagattaatatgtcttcaattctcaaacttaaaggcagagaagggccgggtgtgatggctcatgcctgtaatcccaacactttgggaggccgagtggggtggatcacctgaggtcaggagtttgagaacagcctggccaacatgacgaaaccccgtctctactaaaaatacaaaaattagccaggcatggcagcgcgtgcctgtaatcccagctacctagctactcgggaggctgaggcacaaggatcacttgaacccaggaggtggaggttgcagtgagccaagatcacgccactgcacatcagcctgggcgacagagcaagactccatctcaaaaaaaagaaacaggcaaagaagttacaggcttgggtaactaaggtaattttgatcatgggaaagaagtaacaaagcctattttattaaaactgtaactgccggctgggcgtgttggctaatgcctgtaatcccaacactttgggaggctgagatgggctgatcacgaggtcaggaagtcatcctggccaacatggtgaaacctcgtcactgctaaaaatacaaaaattggccaaggcaggtggatcacgaggtcagcagtttgagaccagcctgaccaacatggtgaaaccccatctctactaaaatacaaaaaaaattagctgggcatggtggcgggtgcctgtaatcccagcgacttgggaggctgaggcaggagaatcgcttgaaaccgggaggcggaggttgcactgagccgagatgtgccactgcactttagcctgggcaataagagcaaaactccgtctcaaaaaaaaaaacaacaaaaatgcaaaaactagctgggtgtggcggcgtgtgcctgtaatcccaactactcgggaggctgaggcaggagaatggcttgaacctgggaggcgcaggttgcagtgagctgagattgcaccactgcactccagcctggcaacagagctagactctgtctcaaaaaaaaacaaaaaactgtaactgcctacctcccccactccatattctgctttcatgctcattactttgacatagttggatgtggatatttcttatattctttcactcaggctcttctaaaatgagtagaagtgggagaggagagaacgtgggaagtaggctagctgttcgtgaagtcaaaaaggaatcatgtgcaaaatagttttaatttgtttcttctttttaaaaataaatttcagcaagagctttttaagattctgcatagtattttgttaaatggcgaaacccgtgaggctgctctcagttacatggcggctgtcgtcaatgccaatatgaagaaagcacagatgcaggtaggattcctacagactgcttttcgctgtttgtcaaattcattcatctgacccagatttagtcagcacctaccaggcactgttctaggagtgggggtacagtattgaacaaggtagacgagcttcctgcttttgtggagcccatgttccacagaataaacaagtagacatataaatacatgattttagacagttgtataatcagtgaagaaaatagagcaaagtaaatgacatgagaagaactgtaggtaccagaaggaagatctgaaggtgatttttgattgggtggcaggaaaggcctccctgaggaggtgacatttgtttcataggaaggagccagccattgtagtggctgagaaaagagctatccaatgtggaaacgaagcagctttggtacaagcccagcacgcaggcttttgtggctggagaagagtgaacaggagggaatgtcgggtcctggagttagtggataggcagggcgccatcgggttaggtttacgtgatcagaactgtcatgggagggttttcagcagggaaaccacaaaagctgctatgtagacggaccaaaacagaagggggcagccaggaacagacccaagggggcagccaggaacagacccaagaaggcagctgcaagggcgtgagtgcttcggtccgggtgagacaggccagtggctgcagctgctttgccagaggagaaaagggcatccttccttgactagtaataaataatgaatgaatgatgtgatgtgtatactcagaagcaaaaatcatgtagagagaagagcacagatcttgtgatttctgatcgtggttccaccgtttactaactgcgggaccttagacagtgactcctctgtgcctccatttcctcatctgctaagctgcggtactactggtactgggtttattatatataaagctgttagagtggtgcctggtacacagtgatcactcaaccaatattaactatcattcttatcattgttgtattattatttttttcttaacagaggtaatcaagttacattgttatattgctaatgcaggagcatgctgatgctgtcacctagagaaacaatgtcacatgataagaagtggagcaacttgttttgatgctcttgagggaaataaagaggagaaagaggccgggcatggtggctcacgcctgtaatctcagcactttgggaggccgaggtgggaggatcacttgagcccaggcatttgagaccagccctggcgacataatgagaccccatctctacaaaatatacaaaagtcatctgggcatggtggctggtgcatgcctatagtttcagctacttgggaggctgaggcaagaggatcacttgagccagggaggtcgagaccagcctgggcaacatagggagaccctgtctctacaaaaaaaataaaaaattagccagtatagtggcatagacctgtagacccagttattcaggaggctgaagtgggaggatcacttaagcccgggaggttgaggctgcagtgagctatgtttgcaccactgcactacagcctgggcaacagagtaaaaccctgtctcaaaaaaaaaaaagaaagaaagaaagaaacatttattgtgtttctacttactaattttgagcctcaggcaaatcacttcagggtctctgagtctttatttcctcctgcataaaatgttaacagcagtattactgacctgtaagaattatcgtgatggttcagtaaaagaatgtataaaatggccaagcgtggtggctcatgcctgtaatcccagcaatttgggaggccgagacgggcgtatcacctgaggtcaggagttcgagaccagcctggccaatatggtgaaaccccatctctactaaaaatacaaaaaatttgccgggcgtggtggcgggtgcctgtaatcccagctactcgggaggctgaggcaagagaatcacttgaacccgggaggcggaggttgtagtgagcgaggatcgtgccactgcattctagcctgggcaacaagagtggaactccatctcaaaaaaaagaaaagaaaagaaaagaatgtataaaatgcctcttatataaataataattatataataggcggtattcaacaagtagcacctgctaatatagaattaatggaatgacagtggtgatgagatatatgtcttctcattgactttaggatacagttatgtttgaaagttcagtctgctttcttacaaagtttgccaaaatttctattcatgttattttaaatactttttcttggctggtcacagtggctcacacctgtaatcccagcactttgggaagctgaggtgggcggatcactttaggtcccagctacttgggaggctaaggtgggaggattgcttgagcctgggaggtggaggttgcagccaagatcacaccccttcgctccagcctgggcaacagagtgagaccccatctcaaaaaaaattttttttaatgtttaaaaatactttttcttttcaactttcacagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctgtgagtactgtgttcgtgactcggtcattaaaacactgccctcttgtctgtgtgctagtagttcctcacagattgttaccacctcaccataaaatgaacttaagagatagagaaacataataaaaattaatacagtaggcctggcgtggtgactcatacctataatcccagcactttgggaggccgaggcaggtggatcacgaggtcaggagttcaagaccagcctgaccaccgtggtgaaaccccgtctctactaaaaatacaaaaattagctgggcatggtggcacacgcctgtaatcccagcactttgggaggctgaggtgggcagatcaaaaggtccggagttcatgaccagcctgatcaccatggtgaaaccccatctctactaaaaatacaaaaattagcgggtgtggtggcacgcacctgtaatcccagctactcaggaggctgaggcaggagaattgtgtgaacccaggaggctgagcttgcagtgagccatgatcacggcactgcactccagcctgggcaacagagtgagactctgtctcaaaaaaaaaaaaaaaacagatacaaattgaaaaaaaaaatcaagttatcataatatatctataaaaaagccaaaaccaaagtgataaaatagaatgtaagtttttgaagaagtaggtgatatttaatcaatttatttaacctatctgaagtgaattctggtgattcatagcaaaaaatataatactgttgttctcaataattctacttttcaggttatattcccaaagttggaggaaaaaggaataattttgtttacataaatcctcccagtagtaacattatttataatagaaaaaaattagaaaaaagaaatatgcagggaaacggctctggaatcagtagtttattaacataatttaataccatttcgagatttaaatatttctgtattgtgttgaaaaatggagattttatacaatacatcagtaaggaacatcaccaaagattgttgatgggctgggaatggtggctcacatccataatcccagcacttttggaagctgaggtgggaggagagcttgagcccaggagttcaagaccagcctgggcaaaataaggaaaccccatgtctacaaagaaaaaaattagcccagcatggtggcacatgcctgtgttcccagccacccaggagactgaggcaggaggattgcctgagcccaggaaattgaggctgcagtgatctgtgatcttaccactgcactgcactgcagcctaggtgacactaggtgacagagtaagaccctcttaaaaaaaaaaaaaaaaaaagattgtgatggacatctgtatgcacatttaacgaggtaggacagaatacggtggtccttgaatggagctaacaggaattctcttcttcttgtagtattgtttaagtttataattgcaaaagtatccttaaacttctggcggggcatggtggctcacgcctgtaatcccagcactttgggaggccaaggagggtagattgcctgaggtcaggagttcgagaccagtctgagcaacatggtgaaacctcgtctctcctaaaaatgcaaaagtagccaggtgtggtagcacacgcctgtaatcccagcttactagggaggctgaggcaggagaatcacttgaacctgggaggcggaatttgcagtaagccaagatcgtgccattgcacttctgcctgggtgacgagagcaaaagtccatctcaaataaataaataaataaataaacaaataaaaagtatctttaaacttcataaaaattcaaatgtaattttctcttctgaattcagctttttctctgattgagacatgtaatagattttatttagggaatgatgttatttttcctagatggcgatcagcctccattttctgagccgaaattccctacggagtgcttctttctcaccctgcatgctcaccacctctctattctgcctagttgccgtcgctatatccgcagactccgggctatccgggagctcaataggtatgtgccatgataccgtgtcctgggattgcctgagttaccactttttctcaggggcaggcaattccattgtgaacagtagttttgaatgttgggggaggtatgtacgttatatagtgttctgtctgcctccaccgccacatccatgttgctcagttgtccagagttctttacctggtgaagtgatccaaaccttgatttctgagagttctgaaccctggatatttcactctgtttatggttactacagacttccattaacttttcccactgggcatacattaccaggaggcacttcaaactttaaaagtttaaaggatcccctgggtttcagacataccccttcttccctggactgtgaaaaagtaaccatggtttcccttgataaccaggatcatttactcctgcctacatgtaattctctttttggcttgttctgtggcatgaggggtccaaaatggccagatagcagcctcaaatttccaattcattagcaccatggttgtgtttcttactctaagcattttttcctgtgtactaacaccaacaaacagaagtcacaggaacacagaagcaaatatttttgagcaggttatctggaataataatgatgccacttctgctttttggtctagaacctgcgtagtctgtctatgagagaaactgaatcatatttatatctctgtatctaccttgcttaaatcacttactaattctttttttttttttttttttttttttttttttgagacggagtctcgctctgttgcccaggctggagtgcagtggtacgatctcagctcggtgcaacctctgcctcccaggttcaagcgattctcctgcttcagcctcccgagtagctgggattacagatgtgcaccaccacgcctggccaattttttttttttttttgatggagtctcactctgtagtccaggctggagtccaatggcatgatctcggctcactgtaatctctgccgcctgggttcaagcaattctcctgtctcagtctcctgagtagctgggactacaggcgcccaccaccacacccagctaattttttgtatttttagtagagacggggtttcaccgtgttagccaggatagtcttgatctcctgacctcgtgatccgcccgcctcagcctcccaaagtgctggaattacaggcgtgagcccatgcacctggcccaattttttgtattttttgtagagacggggtttctccatgttggtcaggctggtctcaaattcctgacctcaggcgatccgactgcctccgcctcccaaagtgctgagattacaggtgtgagccaccgtgcctggcctaaaatcacttactaattctaatagttaactctgcaaattctttatgatttactttctacacataatcatgtctataaatgatgacaattttatttcttttactttttttttcatgccttagtgcccaggctgtaatttttagtacaatgttgaatagaaataaccttgaaatttccatcttgtttcagttggtggaggaaagctttctatatatcctcagttaccagattaagaaaatttccttttatttcaatagttagttcccttagcactggttgaattttattaaatacttttgccatatctgttgaggagactagacttttttcttctctattctgttaatgtggttgaattatatcagttggttttctgttattaaaccagtctttctttcctggagtaaacttaacttttatattaatgtttttatatctaattggatatacaatttgctaatattctgtttaggatttttgcatctgttcaaaagaaagcctgacctgtaattttcatttcttgttaagtgcatctcaaattttggtatcaaggttatgctgccttatagaagaaactgggggctgggcacagtggcttacgcctgtaatcccaacactttgggaggccgaggcagacggatcacctgaggtcaggagttggatgctagcctggccaacatagtgaaaacccgtctctactacaaaaattagctgggcatggttggcgcatgcctgtaatcccagctacttgggaggctatagcaggagagtcgcttgaacccgggaggcggaggttgtagtgagccaagaccgagccactgtactccagcctgagcaagagtgagactctgtctcaacaaaagaaaaaaaaaaagaaagaactggagaatattctcctgttttttatgttccctggaagagtttattgtataagaattatgttgtttcttccttaaatgtcagaaaaaattcagtgatgaagttgtcagggcttaagagttttctgtgtggggatgtttttaattatggatttaagacagttaatatatataagactatttagattttcattacatcttgtgtcagtttttctaaagtttgaaaatgttttggcatgaagttgttcataatatccttttatcattttaatgtctgtaggatccttattatttctgcttttatttatttattttagtttttgagaggaggttcactcttgttgcccaggcttgttgcccaggcaggagtgcaatggtgcaatcttggctcacctcaacctctgcctcccaggttcaagtgattctcctgcctcagcctcctgagtagctgggattacaggcatgtgccaccacgcccagctaattttgtatttttagtagagacagggtttctccatgttggtcaggctggtctcgaactcctgacctcaggtgatttgcctgcctaggccttgctgggattacaggtgtgagccactgcacccggcccattttaattggctttctactgcctcttgagatggatatttagatcatcctttccaaccctttcgcttatgtgtatatttaagactattttgtttccctcttagtgtgaccttagctgcatccctcatttttgttatatcatatcttattactcagttcaaaatgttttctaatttttgtttgttcttatgtaacctgtgggttatttcaaaatatattatttaaattctaggttcttagggtatttgtctatgtatcttttgttaattgatttctagataaattccatcatggtaagaaaatatattttatgtgatttgtgtcttttgaagtttattgaaatttactttatagccttttacattagtagacctgaaaagactgctatctgtgttgtttttacagtgttccacatatattatttaggtcaagtttgttaattttctgttcaagttttccttatatctaatgattttatcagcttataatatcaatcactgagagaagcttataaaaaattcaaactatgattgtggatttatctgtttctttatcctccgatggattacctcctgggatacagtcactcccgctggctttagagggtccatttcaatggaaccatctagaacctttgctcctggcttgcagcagatagcctttattgtgctttccagagacatttatgttcacctcatctgtgtatttttcaatgctgtgatttaagaagtatcttctaggacatagttggggtgtgtatatgcgtattggaaagaggattatctgagcaaatcacataaagtaaatccaccttaattttccaagctctttaagttttgaatcatttcctctgaattagatcaaagaatatttggcaactcagcttcattcagtataggtcactgtcaattcaaagtttgggtcaactagttggttgcataatatgaacctctcccaactcagaataatactgaattcagggtctctggtaggtataatcatgtcagtgattttagccctacatagaagtatatcagcattttcttctcttgctgatcaagcatcctcagaatccattcccatacataatcctacataaccgtcatgtttctgcagtacatatgtggttggtagagtaatggcatctcaaaggtgcccacatcctggtctcggaacctgtgaatatgttatctaacttgattaaagggactttgcagctgtgatatcaggttcatgatcttgaggtggggagattatcctggattatgtgggtaggtccagtgtcattgcaaaggtcttcataagagggaatcaggagggtcacagggagagacggaatgtgatggggaagcagaggttggagtggtttggggtcatgagccaatccggtaacctctggaagctggaaaaggcgaggaaacttgttctcccctagagcctccagaaggaaccatccctgctgaccccttttagacttccagaactctaagactataattgtgtggtttggagccactgaggttgtggtaacttgttacagcagcaatagaaaactagcataacacattagcaaatcttgccattttttttcttcaaatatgtgcttctgttgcatccaattttgtaataatgccataaggacagtccttgatctgactctagctgtggttctggaagcgaagagggatgatgggttagaacctaggggaaaatagcattaccctgcaaggtgactatctctgatgaggtcattatagaaactgcttctgctagcaagcaaggctcagggaatttagagatttaggtacttggagtcagctagttctcccaaactcctccatttgaactctttgggtcccagtctttgccttaactttcagataagaggtccagcaaagttattaatttcttctgtactgtaatttgtagaactggagctgctcctttcctttaacaacagtcttagaaactcctgattaattcacatttcctggagataagaatttaaaatctgaagcctgtcatttttttttttctataagctccaccacataattagaggtagccactccacatcctcattccagatcaccagggatcatgtatatagctgtttttctactcagagccttgggctaccagtgttccatcctcaaatactaattgtatcttcaccatgcagcccaatcaaagaactgatcccagagccccatttttttcatgaaggcctgttacctataaactcttgtgatacccgtagccatataggtcattatcttagtttcctatgactgcaacaacaaattaccacaactttagtcacttaaaacaacacatattacagttctgaaggtcaggagtcctaaaatcggcccagcgcagtggctcacgcctgtaatcccaacactgggaggccgaggtgggcagatcacatgaggtcaggagttcgagaccagcctggccaacatggtgaaacctcgtcactactaaaaatacaaaaattagccggtcatggtagtgcatgcatgtagtcccagctactcaagaggttgaggcaggagaatcgcttgaacacgggagacggaggttgcagtgagctgagattgcgccactgcactccagcctgggagacagagcgagactgtctcaaaaaaagaagatgaaggttgcattccctgcagaggctctaggggagaatctcctttgccttttccatcttctgaaagctgcctacgttcctctgctccttatcaccccccaccccaccccaccttactgtattttcaaagccagcaacatagtatctttagatctccttcgcttgcctggtgtatcgcagcactttgggaggctgaggtgggtggatcacttgaagtcaggagtttgagacccgcctggccaacatggtgaaacccttttctaccaaaaaatacaaaaattagccaggcatggtaacgcacccctgtagtcgccactactcaggaggctgaggtacgagaattatttgaacccaggaggtagaggttgcaatgagctgagatcgtgccactgcactccagggcaacagagtgagagaccctgtctcaaaaaagcaaaaaacaaggctgggcacgtgtctgacacctgtaatcccatcactttgggaggccaaggcaggtggatcatttgaggtcagaagttcgagatcagcctggccaacatgttgaaaccccatctctactaaaaatataagttagccaggcctggtggcaggtgtctataattccagctacttgggaggctgtggcaggagaatcgcttcaacccgggagtcagaggttgcagtgagccagatgatgccagtttactccagcctgggcaatagagtgaggctcagtctaaaaaaaaaagacaacaacaagatctccttctctctctgacctttgcttccattgtcccattgtcacatctccttctctgtctctgagtccttttttctcttagaaggacctttgtgattatattgggccctccaaaatcatccaagatactcttcccatctcaaatccatacccttaatcacatctacaacgtccctttcgccatgggagatcacatgttcacaggttccctcgaaggattcggatgcgacaagtttggaggagccattcttttgtctaccatactcatgtttcagttgtagacgaaagaatccaattcttctgggataagcagaaaggggaactagttggtttactgaatcattggaatggctataatagaagattcccagagctatactttgaacaaggaagctgcttcggaggtcagcctgacagcacagcctctgccacagcttcagccaaaacccctctaccactgtacttccagaaggatcatgcaatcacgcagtcacttcacagtactcactctgccttcagtgagggttcatcttggtgaaaactaggtcttacagaaatgctggcaggaggggagtctaggaaatgtagcttttggagatttagcagcctctagtattacacacaacatcatgatagaaaggggttgaaatagtgttaagagagtcggtcttcaaaatatgcagcctattaggtgatggggaagccttttactgcagagacagatggtgtttgagcagacacctgaggggagtgaaggagcaaagccagagataacctcagagaagagcattgcgagcagagggaacagttgtaaaggacgatgccgttagtaaaatagccttttgttttgggtaattgaataggcaaagtaacctcgaattttcatgagagacttctttttttccctcccagaaaaataagggaacaatgtactttcttgcaacaaaaaagatgattatattcaccaaatctgtagtgccatccattcaaagacacatcattgttttaggaaccaataaaaaagaaaaatatggcccgacgcagtggctcatgcctgtaatcccagcactttgggaggctggggcaggcagaccacaaggtcaggagtttgagaccagcctgcccaacatagtgaaacctcatctctactaaaaatagaaaaaattagctgggcatggtggtgagcacctgtaatcccagctacttgggagtttgaggcaggagaatcacttgaacccaggaggcggaggttgcagtgagctgagattgcagcactgcactccagcctggtgacagagcgagactctgtcttaaaaaaaaaaaaaaaagaaagaaagaaagaaaaatgctgccaattaaactatgatttgccgctggttgtaagatatactctgattttaaagatgttacaatgcgaaaacaaacaactgcgtgtgagagtcagtgaaatgagcaagatgaatgggtaagatggatccggctgttttctttcatttgactgttagtctttgatttcagaactgtagaagatttgaaaaataatgaaagccaatggaaagattccccactggcaactagacaccgcgaaatgctgaagcgctgtaaaactcagcttaaggtttgtatagctaagtggaataattatagaccagcctcatagtgataattttcccaacagaatatatgccttgagtgagcagtttagtgtcctcactttttctttgttattcttttcccttccaataaaatagtatattttaaaacttgttgataccttacttatatgtgtatataatgatttcagtctcaggacagaatatggatagatatgcttctgctgtgattatgaattcttaatgggttttatgattctcagtttaacatcacctcccttggccgggcgcagtggctcacacctgtaatcccagcactttgggaggcctaggcgggcggatcacgaggtcaggagatggagaccatcctggctaacacggtgaaaccccgtctctactaaaaatacaaaaaaaaattagccgggcgtgatggcgggcgcctgtagtcccagctactcaggaggctaaggcaggagaatggcatgaacccaggaggcagagcttgcagtgagccaagatggcgccactgcactccagcctgggcgacagagcgagactccgtctcaaaaaaaaaaagacaacaacaacaaaaatcacctctccttccctgccttatgcagggccctcctcacctgctgtctcccacccctcgccccaacactcatccagtatatctagccatgcatttccatgatatttgacaaagagtatctgtggtagtggaaagatctctttcctttgcccctcattctttctttttaattgaaattgattcatcacacaaaacctaactatagatgggaatattcttgctggtgagacatagctaaaaacatatgccagctgacattgtacaaataaagcatagatagcaaatttatgcatttttcttctattcatgttccagttataaacctgagtgttagctggtcatgcattctgttgaacagtaggataatatgtggaaagtttacctgacatagctttctagtaccagttaagatttcagttttatttactaatagactagacttcttcaagatgcacaattaacaaggggcccttatctggggtctgtgcacccccctaagcagtccacagatgtgtttcaaggggatctataaactgcttaaattgccaggcatggtggctcacaccagtaatcccagcactttgagaggccgaggcaggcagatcacctgaggtcaggagttcgagaccagcctggccaacatggtgaaaccccgtctctactaaaaatacaaaaattaactgggtgtggtggcacacgactgaaatctctgccattcgggagactgaggcaggagaattgcttgaacctggtaggcagaggttgcagtgagccaagatcgcgccactgcacttcagcctgggcaacagagcaagactctgtctcaaaataaataaataagaaacataaaaactgcttaaatgtatacatcagtgtgtgcatgcatgtgtgtgtaattctgtcaacaggcctctaggtaggaattccatccttagtggccagcattttgcccgagggcagctcgtaagaggcgacactggaattcagacactgattgtttggctttttcccactaaccaccctgacacccaaagggcctccctgtcgccaccctctcctcatcaggttatttacttgtgactgttggaactcaacattttgagctttaactgtgtgctagacctggtggtactcggtggtttgcttgccacgcctttgtttttctcaggaaaaaggtcttgagacacaaccagcatcttatagctagttaggagatgaagctctagaagctctggaacccaaatttcccatctcctggccccagtccctgcccagtccccctgtagggacttagctactgactgatctttgggtggggacatccctgcttccacagaaactggtacggtgcaaggcctgtgctgatgctggcctacttgacgagagcttcctgagaagatgtctgaatttttatggccttctcattcagctgctgctccgcatcctggaccccgcatatcccgagtgagtgtgcttcttcctgtttcccttgtccctccttggctgggctctgttgtctttattgtccttcaaagttgataactaaaaccaaaaccctttctttatcaagaattcacttctctgcaaggcgcagtggttcacgcctgtaatcccagcactttgggggaggctgaggcagatggataacttgaggtcaggagttcaagaccagcctggccaacatggcgaaaccgtgtctctactaaaaatacaaaaattagccgggcttggtggcagatgcctgcagtcatagctactcaggaggctgaggcatgagaatcgtttgaacccgggaggcggaggttgcattgagccgagatcatgctactgcactccagcctgggcgacagagcgagactctgtccccacccaaaaaaaaagataattcacttctcagtttccagattgcatttatatagattatgtagttatattgataggtgttttccctgtaattagttacaataataggcaaatgtcaacacctgttattttaattttgacaagttttctttaaaatttgctataaagtctttgattgatagaaagagaaatctataaattggaagccaaaagctggagataatattaggccctcctaagcactgggtccaggaatacccacctaattcagagagtgagctaagaacattgttgatcactttgtcatcaactggtcatctcctccaggcaaaccatttttgttttatttattattattattattttactgttatgaagtctctggttcactgatgttggtgagattggcccaagacccgtgaaggcgtggaaaatattatttaaaatatgtgtgtaggccgggtgcggtggctcacgcctataatcccagcactttgggaggccagggcgggtggatcacatggtcaggagatcgagaccatctttgctaacacggtgaaaccccgtctctactaaaaatacaaaaaattagctgggcgctgtggcgggtgcctgtagtcccagctactcgggaggctgaggcaggagaatggcgtgaacctgggaggcggagcttccggtgagcggagatcacgtctctgcactccagcctgggtgacgagcaagactccatctcaaaaaaaaaaaaaaatgtgtgtagctctgttgtttccgtttgagttgcacaaaatgaccaaataggacctttttatttccttcccattttacttattgcattaaccttagcaagaagtcaagaaggctgggcgtggtggctcacgtctgtaatcccagtactttggaaggctgaggcaggcggatcacttgaggtcaggagttcgagaccatcctggccaacgtggtgaaacaccgtctctactaaaaatacaaaaattagccaggtgtggtggtgggcgcctgtaatcccagctactcgggaggctgaggcacaagaattgcttgaacccaggaggcagaggttgcagtgagccgagatcacgccactgtactccagcctgggtgacagggtgagactctgtctcaaaaaaaaaaaaaaaatcaagaaaagggccaggtgtggtggctcacacctgtaatcccagcactttgggaggccaagatgggtggatcacttgaggtcaggagttcgagaccagcctggccaacatggtgaaaccctgtctctattgaaaatacaaaaattagccaggtatggtggcacgtgcctgtaatctcagctattcgggaggctgagacatgataatcgattgaactggggaggtggaggttgcagtgagccaagattgcaccactgcactccagcctgggtgacagagtgagactccatctcaggggagaaaaaaaagaaatcaagaaaaggaaaacatttcacacatacccttgcatatgcactgtcttcattattccctgttcatttctggttgtagtttctttgcctacatatttattacatagtattacagaatgattttcttccccaaatgaaatacttatccgatggtaatgtaatactccttgtagtttgatgtaccataatttcatttaataaattgtcctttttttctctttgacagtataacactgcctttaaattcagatgtccccaaggtatttgcagcgttgcctgagttttatgtagaagatgttgcagaatttttattttttattgtacagtaagtgcctttaatattttacatagttctaatatgtttttatgcataatagtataatattctgagctatgttgcaaacctccatttcatgcctgaaatttgatgtaactgttttaactgaatgctgcctagagactggaaaaaataaatccaactgtggcatcagtccaattccaataatatctcaaagacagaggcaggattaacagtgcagataatgtattccttgaaaattgagttgaatttctaatagttaaatatgtgtttctgagcaacagaaggaggaaacagtttataaatgtctgaatgaacatcccaaaaccagaaatatccacatctatattttgtactaaaatttgtctcaattgtaaaattggagaatgcttaccaagaaatggtttgaatttctaactggtattgtagggttttaatttttttttcaaatccttatttggtttatcaaattaacattttatttctaaaacattacaggttagaagaattacaatttcaatcccttggcaccatgatagcacctatgactagctgagggagtggtatgtgaagtctattgtgaaaagtaaaagtcatgctgggcactgtggctcatgcttgtagtcccagacatgcaggaggattgcttgagcctagttcaagaccagtctgggcaatgcagcaagtctgcatctctttaaaaaataaataaataaatagtataggtccccagtcacagaatacaaattgtgaaagttttgtaacaaacaacaggaaaaaaacaaaattagtataaatgattttaaaataagggccaaaagtaaatggagcaagttaatattgctgtcataaaagctgcctttaaaaaaaagcccaaatcaaggcagaggttgcaatgagcagagatcatgccactacactccaacctgggcaacatacacaaaaaaacccaaatcattggtgacacgtgattttgattggtatgaaattttaaaagtgactcaaaaacgtggtttatttgttgaaaaaccaaccttggaatttaagcaactcaagtcacattttaaaatttgttctatgcacagtgatacaaaagacacctatttgaaaaatttcatttattctcattttcagcagagattaaaaaaaaactatcaaaatttttatgttttggtagtgatgatcttttgtgaagtttatctgatttgatcataggttttgtttatagttaatataacatgctacagccagtaaccatgtttggttttaaatctgtcttgttacagtgtgaatagtcactgtaggctgggtgcaatggctcatgcctgtaatcccagcactttgggaggccaaggtgggcaaatcacgaggtcaaaagatcaagaccatcctggccaacatggtgaaaccccatctctactaaaaatacaaaagttagctgggcatggtggcaggcacctgtagtcccagctactcaggaggctgaggcaggagaatcgcttgaactttggaggcggaggtttcagtgagccgagattgtgccactgcactccagcctgggcaacacagcgaggctccatctcaagaaaaaaaaaaaaaaataggctgggcgcagtggctcatgcctgtaatcccaccattttgggaggtcgaggcgggcggatcacgaggtcaggagatcgagaccatcctggctaacatggtgaaaccccatctctactaaaaatacaaaaaaaattagccgggcatggtggcaggtgcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaagtcactgtaaactgaatgagttcaagggcactcccaaacctacttatcctgccttcccctcctcacttactgacaccagccttcacccaagatgagtttctcagcagtttctcagcggtctctttcttgctcttcttgcctctgttcagatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacaggtaggttgctggaacacagtgtagcacatggcaggccaacttaggtaaggtcatctaaagctagtggacgacgttgctctaagcctgttacctaatatcctgctacctgtgtgtatagcctactaacctgtggcctgcagaggatgtacttttggttcttcttgccctgagtagttaggaataggacaaccattccacctactggtctctgatgattcagcaggaactactgaaagtcagatgattggcaccgagacccagggtatcaagagcacaagttggtagtgttatctgaatggaattatctggttcattttacctttgaacttacagcatttgttttttaacactatcctataacccactttccaaagtgtgggtgaaacagggagcttgttaaaaatgcatattcttggtccgggtgcggtggctcatgcctgtaatcccagcactttgggaggccgaggcgggcggatcacaaggtcaggagttcaagaccagcctggccagtatggtgaaaccccatctctactaaaaatagaaaaaaaaattaaattagccgggcatggttgcaggtgcctgtagtcccagggcggttgagggaggagaattgcttgaacccgggaggcagaagttgcagtgagccgagatcccgccactgtattccagcctgggcaagagaacaagactccgtctcaaataataataataataataataataataataataataccacttttcacctgtcaaatttatttcttaagttgaaaatacctggtacaaacatggttgtggagaagtaagctaacctgcaaaaaaacctgcttaatctaccctatagccagtgtgcagatttagtgctatgaaactctcatgagaatgcaaatttaaagcctttctgaaaggcagtttagcagcccacaccaagagccttaaaaatgcttttatcggggccaggtgcggtggctcatacctgtaatcccagcactttgggaggccgaggcgggtggatcacctgagatcaggaatttgtgaccagcctggccaacatggagaaaccccgtctctactaaaaatacaaaaattagctgggtgtggcgggcggcgcctgtcatcccagctactcaggaggccgaggcacgagaatcgagtgaacctaggaggcagaggttgcattgaactgagatcacaccagtgtgctccagcctaggagaaagggcaagactccgtctcaaaaaagaaaaaaaaaaagcactgggataacaaatagtaggtgcaggaagtagccatcttctatccctcagtctggggacccaagggaagagcctggggatctcagaacccagctgccctgatgagggcttggacggagctaggacccagtcctctgtggaaggcccttggccagtaggtgctggtgtctctctcgggggttgtgcacggttgctagctctgggggtacgagacaaagctgaaaattggaaccaactgctactgctgacagtaagtgcaaggtcctaagtcccttgtttctccttcagttttccagttctcctgcagcaccccctattggcaaccctagagagggcgggctgccaaaggaaagattctgcagtgccagccccagaatcacaaagccaactacaaagagtgcatgtgggctgggcacggtgactccagctaataatcctagcactttaggaggccaaggtgggaggattgtttgagcctaagagttggagaccagcctgggcaacatggcgagaccccatctctacgaaaaatttaaaaattagatgcctgttgtcccagctactaaggaggcagaggtgggaggaaggcttgagcccaggagttcaaggctgcagtgagctatgatcttgctgctgcgttccagcctgtgaaacaaagcaagaccctgtttctaaaaaaaaaaaaaaaaaaaaaaaaaaaagggtaaaaagactgggtttcggccaggcacagtagcttacacttgtaatcccagcactttgggaggccaaggcagtggatcacctgaggtcaggagttcgagactagcctgaccaaaatggtgaatcctagtctctactaaaagtaaaaggccgggcgtggtggctcacgcctgtaatcccagcattttggaagactgaggtgggtggatcacaaggtcaagagatcgagatgagcctcgccaacatggtgaaaccccgtctctactaaaaatacaaaaattaggcctggcacagtggctcacgctgtaatcccagcactttgggaggctgaggtgggcgaatcacctgaggtcgggagttcaaaaccagcctgaccaacatggtgaaaccctgtctctactaaaaatacaaaattagcctggcatggtggcacatgcctgtaatcccagctacttgggaggctgaggcaggagaatcacttgaacccgcgaggcagaggttacggtgagccaagatcgcgccattgtaatccagcctgggcaacaagagcaaaactccgtctcaaaaacaaaaattagctggacatggtggcatgtgcctgtagtcccagctactcgggaggctgaggcaggagaatctcttgaacccgggaggcagaggttgcaatgagccaagatcgcgctactgcacttcagcctggtgacagagcaagacttcatctcaaaaacaaaacaaaaaacaaaacaaaacaaaattagccgggtgacgcatgcgtgtaatcccagcaacttgagaagctgaggcaggagaatagcttgaacccgggaggtggaggttgtagttagccgagatctaaaaaaattttaaaaaaaaagagtggatttggagctacgagacaacagctgaatagctatactctgacataagaatttaatttcttgaaatttattcaatggaaataattacgaatgtttgtaagtgatgttctccacagcattatttataaagcagtgcagtgaaaataataaaaacaactggccgggctcagtgactcacgcctgtaatcccagcactttgggaggctgaggcaggaggatcacctgaggtcaggagttggaggcttagtctggccaaaatggtgaaaccccgtctctactaaaaatacaaaaaaatttagctgggcgtagtggtgcacacctatagtcccagcttctctggagtctaaggcagatgaatcacttgaatcagggaggcagaggttgcagtgagccaagatcgtgccattgcactccagcctgggctacaagagcaaatctccatctcaaaaaaaaaaaaaaggaatgtagggaaggacatataccaaaatagtaacagcgcattggttatttttgaatggtagcattataaatagtttttatttttattttattatctgaacttcttaatttttctacagtaaacatgtattgttagtagtaaagacaaaacaattttagttaaatttattttgtagtcagtgttctgggcctgtcactgtggcttcaggagagagagagagagagagagtgtgtgtgtgtgtgtgtgtgtgtgtttgtgtatttgtgtttacacaacagaactgggcctgttgcctataagacgagtgctgggcctagtggagtcctgctgggaatgttccagaaggaattgggtgggggttgttctctctttcctctttgccatgtgtgccctctggcctggaccacctcttcagtcatagatggatgacatctgtactaataatagccaccacttattgaatgcttactaatcctttcacttaatccccacggcagtcctaaagatagtactataaatacatccactttacaaatgaggaaactgaagcttaaaagggtcaagaagcttgctgaaggtcagtggctagcaagtggcagcaacctcgcagatgccctttagcacaggtccccctggctactgtgctggtcttcctacagctactaagggaccggtgtgagggtacccctgagggaggcatcacagacatagtccccagtgctcatcacctccatgtgaagacctggctgattaggtcctggtccctgagcagatgggaccctcagatataaattaaaagttgccacacacaagatcagtatgtggaacaagctcctcttaacaccacagagatagtattctagcttagaaaatgctcaagttaggctgggcgtggtggctcacgcctgtaatcctagcactttgggagtccgagacaggtgaatcacttgaggccaggagtttgagaccagcctggccaacatggcgaaaccctgtctctactaaaaatacaaaagattatccgggtgtggtggtgggggcctgtaatgccagctacttgggaggctgaggctggggaattgcttgaaccgggacctgggaggtggaggtcgcagtgagccaagatcttgccactgtactccagcctgggctacagagtgagactccatctcaaaaaaaaaaaaaaagaaagaaggcagcaagaatacctggggggaggagggagaggttcaacacaagtctagtccacctacggccttctagaacaaggacctgggaattagaacttgggctggtatgactttgagggaacagtagaagtgaataagaagaaaaaaaaactgttgggagaaatgtatattgttttgtttcattttcttttcttttttttttttttttttgagctagggtcttgctctgtcacccacgctagagtgtagtggtacaattacagcaccatgcactcttgacctcccgggctcaagtgatcctcctacctcagcctcccctgtagctgggactgcaggcatgtgccaccacacccagctaatttttgtggtttttgtagagacggggtttcacgatgttcaccaggctggtctcaaactcctgagctcaagtgatctgcccacccgggcctcctgaagtgctggaaatacagatgcggggccctgctgagatacatattgctacataataaattaacatttacttagtctctactatattcagaattgggtgcagatattggggcattttagatgatatgaggcgttgggttggtcctcctgtatcttcctcttgtaggctatccttatgtcaacactccacactttagctcatgcttttatacaattaataaatgacatttagtttattttaaggaaaggttacttaatgaatatacataagtactttcggatcttagtatgataggtgttaattatcttattttatttttaaatagctgtttccttttttggtcacacacaaaaaaatgtgttctttggaaaatacagaaaatatcaaagacaaggtatagtggctcacacctgtaatctcagtactttggaaggacgatgtaggaggatcgcttgaggcaggaatttgaaaccagcctaggcaacatagtgagaccccatctgtaaaaaaattaaaagtgaaaaaaaaaatttttgagacagagtcttgctttgtcgcccaggctggagtgcagtggcatgatcttggctcactgcaacctctgtatctggattcaagcaattctcctgcttcagcctcctgagtagctggaattatgggcacacaccaccatgccctgctagtttttgtatttttattaatagtagaggcggggttttgctatgttggccaggctggtctcgaactcctggcctcaagtgatctgcctgcctcggcctcccaaagtgctgggattataggcgagagccaccacgctcagccataaaaaataagccacgcgtggtggatacacctccagtcccagctacttgggatgctgaggtgggaggatcacttgagcccgagaggttgaggctgcagtgagccattattcacaccactgcactttaccctgggtgacagggcaagaccctgtctccaaaaaaataataataaaatagttgggcacggtggctcacacctgtaatcccagcactttgggaggccaaggtgggtggatcatgaggccaagagatcgagacaatcctggccaatatggtgaaaccccatctttactaaaaatacaaaaattagcagggcgtggtggcgcatgtctatagtcccagctactagggaggctgaggcaggagaattgcttgaaccccgaggcagaggttgcagtgagctgagatcgtgctactgcactccagcctggcgacagagcgggactctgtctcaaaaataataataataataataaaatttgtcatgaattctgaaatttctcatgcctaagcttttgccatttggacaaacaagtttgatttttatccctctttaatagatttagggatgatagacacattggtgttttttcaacaccaaaaatggtcaatagatagacacatttagtaaatacatggccctcaataaaattaaacctaactttttatccgctgaagtatgtccatttgaggtgccatagaatttctgtaaattaataacttaaaattaggtggggggagtatgataattcagcttttggtcattggtaagttgatgttgtcctaatgatgggagttttcctagccccgttcctttaggtgttgtgtcattgtcaaatcttcattgtgaaacttttgtctttaaaagcagcttataatttctgtcgtgccctacatgcaaaagaagtgcaaaatttcaccagctctctgattttgcaggtttacattcactcagtatcattgttggggcaataactggatttggaaagcaagaaaatacatatccctcagtacctttgtctttcttctttagatgttgagcataccggagccaccagtgagttttatgacaagttcacaattcgctatcatattagcaccatttttaaaagcctttggcaaaacatagctcaccatggcacctttatggaggagttcaagtgagtatggggcccctcgtgtcacaacttgctttcttgcaaatcgcaggtaggattgcagcttaaaagcatgcacagctgggttcttgttgactgtttgcttggtctcagactcctttgagtttaccacaagatgccactaaatgtgggcaggattttttaaatggctttacttgcaagatattgctgaattttagatttgtcaagatactttgggggtggtacacaagcgaagattgtatagggcagggcgtggtggctcacgcctgtaatcccagcactttgggaggcagaggcgggcggatcacttgaggtcaggagttcaaaaccagcctggccaacatggtgaaaccccatctctattaaaaatacaaaacattaactgggtgtggtggcgcacgtctgttatcctagctacttgggaagctgaggcaggagaatcacttgaacccgggaggcagaatttgcagtgagccgagattgtgccagtgctctccagcctgggtgacagagcgagactccgtctcaaaaaaaaaaaaaaaaaggaaaagaaaagatcctataaatatgctgagatgatgggttaagtgtttttttggtgttttctacgatgacagtgttaaatgaagttgtcagaatgagtgaaatgaaatcttagttcctgaatgttggaaggactttagattttgcaacaattaggtcagagttgtcatttaaagtatcattctttgtggtaaggccctaaaccttaattaaagacttttcatatacctacctgaaatctgagtgactgcttaaacctggacattagtaattccatctaaattatctgtcagtgcctaaaaacaaaagggagatgaagatgctgaactcttgaattattcttcaaaaattttatcccatctaagggccgggcgtggtggctcatgcctgtaatcccagcactttgggaggccgagcagggcggatcaggaggtcaggagatcgagaccatcctggctaacatggtgaaaccccgtctctactaaaaataccaaaaaattagccaggcatggtggtgggcgcggtggcgggcgcctgtagtcccagctactcaggaggctgaggcaggagaatggcgtgaacctgggaggcggagcttgcagtgagccgagatggtgccactgcactccagcctgggcgacagagtgagactccgtctcaaataaataaataaataaataaaaattttatcccacctacttggatcttttgcaacccatgttagatctttgatcaaatctagctatacttgttaaccgaattactagtcaataatatacaaattaccagtggaataactatttgccagatagatttctgtgaagcaaactttttaactttttgtttccataaactgctcttatggtcagaattgtgttccagctaaagcctggcacgaggcaggcccatggcttggtctgaatggtgctgattggagcgcttgtcctgaacttgccatgttcctgagatcgaggcctcctgcacttgttcacaggaacttctcttctccagcatgggcttaccaccccgtagttgcacagttgtagaccctgaagtgtagcttctttttttctctacgaatctggcatctccagagtctaacagaggtaggccaagctatttcagttcaccagcaagttctcattataacacgatctgcagaacagttccttagattggaggcttccagttttaaagtaagttaatatcccactttatcaatattacaggttccaatttttcttccatgcgtcagtctttgtgataaggaataactatatcagttgttttcttatctgttgtatgtggttaattatttgcattttcttggtatattggtgagtatatgcgtttttcctgttctagtctggaagaagtgttttctctccttaaaaacattgagggagtgagctaggggtgtgctggtaagcctgctctgggaagcagggtgggggagtcagcatttgctggttttccatggtgtgactgtttcctctgttgcccaatttaaggtgccaggggaatctggttataaaattctggaatatttagcacttgactgtcatcagccgtgcaaggtggctccaaataccactggaatgagcttatcataaacaatttaaaagaataacaaaatccaggccaggtgtggtggctcatctctgtaatcccaacattttgaggggctgaggtgggaggaacgcttgagcccaggagtttgagaccagccctggcaacataacaagtccctgtctctacaaaaaatacaaaagctgggcgtggtggtgtgtgcctgtagttccagctacttaggaggctgaggcaggaagattgcttgagccctggaggtcgaggatgcagtgagctgtgattgtgccactgcattccaggctgggcgacagagtgagaccctgtctcaaaaagaaacaagattaacataatctaaagagaagcttggtggtccttgaattccatagtgcctgacttgtgccagggtagccaggcttttagggtgagatagttgcagtctgggtggaggtgcttgttccctgggatttgctgtggcattttgcttcagggagatgtatgaccatgtacaatataattgcctttccagctccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggtgaggacgtggtccagaggcttggacagctttgcaggccatctgcctccacacacgggcagagctgctttggggctgcatttgtgggtctgatgatatgcgatctgacatgctgggattttccttccatgaaatcatattgcaggattggaataggaaaattcttaaataccttatctgaagctaagaaatgggttgagaagtctttgaaaatgtacactgaaaactttctctgcctttttaattttaaagggcttttttggagatgagcttttattgtctgaatatattaatattcatgaacataattaggaaagaaatctctagaattatgtctgctggacaagaatttgatttgttcctatgggcttctctaggcaactgtgtgaatcactcaggatcctggcggggtgttttttccctttcagttgatcttgggttttatattcagttattaatagaaaagaggcctggcttgccaggttccatggaaagcacgtgccgtgccagtaccagtgctctttcctgacgtgcgtagcagccactgagatacttccttggtcgcttatgaggcccttgacagttgctggtgacttcttagattggcttaggtttattgattctgttcttggaattgtcaggctcagaatcagaactgatttccataaggggttctcatgtcaaagtggggactgctttttcttcactttttcttttttttttttttttgagacggagtttcactcttgtcgcccacgcaggagtacagtggtgcgatctcttctcactgcaatccccgcttctccggttgaagcgattttcgtgcctcagccttctgaatagctgggattacaggcgcctgccaccacacctggctagtttttgtattttgtttgtttgtttttgagacggagtcttgctctttcacccatgctggagtgcagtggcacgatctcagctcactgcaatctttgcctcctgggtacaagtgattctcctgcctcagcctcccaagtagttgggactacaggcacctgccactacgcctggcttattttttgtatttttagtagagatggggtttcaccgtgttagccaggatggtctcgatctcctgaccttgtgatccgccttcctcggcctcccaaagtgctgggattacaggcgtgagccattgcacccggacaatttttgtatttttagtagtgacggggtttcaccatgttggccaggcctgtcttggactcctgacctcaggtgatccatccgcctcagcctcccaaagtgctgggactacaggcgtgagtcaccgcgcccagactttttttttttttttttcttttttaatttcaacttttattttagattcaggggatggggtacatgtgcaggtttgttacatgggtataccgtgatgctgaggctttatgattcagcctgtcacccagggagtgagcataatacctaataggtagttttcaaccctcactcctccctcactcccctcccttgtagtccccagtgtctgttattcccgtctccgtccatgtgtaccaatgtttagctcccatttatacctgcttttcttcttatgtattaaagttctacccattctctgagtaaggtcctatccaaatactccctcaggtttgtcttcgccaatcagcatagctgaaaattctcacctttctccttacttctgtaacacccactttataccattcacagtgcttggtatgcccagcttatattttatttacttatttgttttttattattattaataaataaagacagagtgttgatctgtcgccttggctggagtgcactggcaggatcatagcacaccacagcctcaacctcctggactcaagtgatcctcctgcctcagcctttgtagatccaaagagctggatctacaagcatgtaccaccacgcttggctaattaaaaaaattttttttatagagacaaagtctcacatgcttgcttcagcagcacgtatactaacattggaacaatgcagagaagattaccatggcccctgctcgaggatgacatgcaaattcataaagcattccatcctttaaaaataaatattaggccaggggtggtggctcacgcctgtaatcccagcactttggaaggccgaggcgagtggatcacaatgtcaagagatcaagaacatcctggccaacatggtgaaaccccgtctctactaaaaatacaaaaattagctgggtgtggtggcacgccgctgtagtcccagctacttgagaggctgaggcaggataattgcttgaacccgggaggcggaggttgcagtgagccaagatcgcaccactgcactccagcctgggcgacagagtgagactccgtctcaaataaataaataaatattaaagagagagagtcttgctagttttcccaagctggtcttatattttatttacttactatttttattattaaattattttttattttattttattttattttttgagacagagtctcactctgtcacccaggttggagtgcagtggcgcaatcttggctcaatttatgcctgctgggattacaggcgtgcaccaccacgtccggctaatttttgtatttttagtagagatggggttttgccacattggccaggctggtcttgaactcctggcctcaagcaatccacccacctcagcctcccaaagtgcgggggttacagacatgagccaccatgcccagccttattattattttttaatagaaacagagtcttgaccgggcacagtggctcatgcctgtaatatcagcactttgggaggccgaggccggcagatcacctgaggccaggagtttgagaccagcctggccaacatggtgaaacccagtgtctactaaaaatacaaaatttagccaggcatggtgacaggtgcctgtaatcccagctatttggaaggctgaggtgggagaatcacttgaacccaggaggcagaggttgcagtgagctgataccatgccactacatttcacatttcagcctgggcaacagagcgagactccgtctcaaaaaagaaaaaaaaaaagaaagaaagagtcttgctctgtcacccaggctggagtgcaatgacagatcttagctcactacagcctacaacctcctggcctcaagcagtcctcccacctcagcctcccaaaatgctgggattatagttgtgagccaccatggctggccagcgtatattttagatgttggaatgcaggtctatagcacattctcgtattcatagtcagtacttaatagcatttgtttatgagccaactgaacaaataatattgatttttcctgtgttaatggatgaaaaaggcccaaataattcccacaattgctatttcagaaataatttttatttggctttgaagtcactttctacctcccactgccctggctgttcctgctcatctccctgacgtctgagcttggtgagctccagcactcagcccttaggcttcaatttctttcccactcatgctctctaggttagtgtttctcaacgagggcactagttggaattttgagcctagtggaatttggtataataataactcatgatgagaaaccatcccatatattgcaggacatttaggatctctgtttcctgccatttaatgtcagggatgtaccctcctacccccagccttcaggcaacgagaaacactgccacacataacctgatgtcccccggtgaacatcactgcttggtgagctcaggtataccaaggcattaaatacctgtgttctaaagactccagaatatatctccctggctcagatctgactgcagacttgcagaccaagtatttgtctaatcagtgtctcaaactcactgtgtccaaaacggaacccttgatgttgtccacatctcctgcctgagtctgcccaatctcagtaaatggcgccttcattctaccagctgctcaggctcgatgctttggagttgctcttgatttctctgcgtctctcagcaaatgcctctaagctctgtcttaaaatatatccattatctgacctcttctcagcacctccagaccgttggcatctcttacctgggttattgcagtagcccactgcttggtcttcaacctccactcttgagcatgtccatatcagggatggtgttaaacatctcagtctgatcaacatcaccactcagctcagccattttgggcttcccttatcactcagagccaaatcctgtggtgagagcagcctacagcacgcaggaggacctggccccacaatgtgtttctgctctcagctttggacagtctcttctccactcactctaccccagccagactcacctcctggcccttccactgacacgtgagggcctttacacctgctcttccccctacctggaatgctcttccctcagattttccgactccttcagatataccctccctcagggataccttccctgaccaccctttccagaatagcattccctgactcctgaccctgcttcatttttcctcatcactgtcagacttactgtgtgtctgtctgggtatttgtttctatgaagcagatcctccctaacggaatctaagctgcatgagagctgggagcctttttattctatctccagtgcccaaaggctgtagaagggcctgttgagacacccaggtacacatttaggtagttcacgcctggctgttcttgtgtctttcctggctctgcctttctttcagtaggctcattcttgaccagggaacggcaggccccccagtatccctgcagaatctccatcaagcacagactggagcactttcccagagggcactcaccggccagcttcagctctgccagctgtgttcctttcccaacaagaaaaggcctctgaacagatgtaagaattgaggcttttcctgatgggtctgtgtttgacccatttcagagcctgcagtgcagtacctgattgtatccatgagtcaaacagctcttattatctcctccccagcccatggcagagttgaaggaggaaagtgcgccagaggtaagcgtgctgacagttctgtggtgtgacagcctcacagtttggaaagacaaaattttaaaagcttagtagtccacaggcacttgtagaggcagagaggcagacccgataggcctcaatacggtggcacactgcatctcatagttttaaaataatgaagactggctgagcacggtggcttacacttgtaatcccagcactttgggaggcctaggtgggcagatcagttgaggtcaggagtttgagaccagcctgatcaacatagtgaaaccccatctctactaaaaatacaaaaattaggccaggcgcattggctcacgcctgtaatcccagctctttgggaggttgaagtggatggatcacctgaggtcaggagttcaagaccagcctggccaacatggcgaaaccccaatctttaccaaaaatacaaaaattagtcaagcatggtggcacgcacgtgtaatcccagctactcaggaggctgaggcaggagaatggctcgaacccgggaggcagagattgcagtgagccaagatcgcgccactgcactccagcctgggcaacagagtgagaccctgtctcaaaaaaaataaataaatcacacacacacacacacacacacacacacaaaaaaaaaaaattagctgggcatggtggtccactcctgtaatcccagctacttgggaggctgagacatgagaatcacttgaacctgggaggcggaggttacagtgagccgagattgtgccactgcactctagcctgggtgacagaggaagactccatctcaaaaaaaaataacaataataatagagggccgggcacggtggcttacgcctgtaatcccaacacttcgggaggccaaggcaggctgatcacctgacgtcaggagttcgagaccagcctgaccaacatggagaaaccccgtctctactaaaaatacagaattagccgggcatggtgacacatgcctgtagtcccagctactcgggatgctgaggcagaagaatcacttgaacctgggaggcggaggttccggtgagccgagatcgcgccattgcactccagcctgggcaacaagcgaaactccgtctcaaaaaataataataataataataataataataataatgactaagtaaaagttattattaagggaaataaactaccctttcttagtgccatgatgtgtgtcagatactatgttccattatcttatttcatcctgaatagaagttgatggtgacttttttttttttttttttttttgagacggagtctcactctgtcactaggctggagtacagtggcgcgatctcagctcactgcagcctcagccttctgggttcaagcagttctcctgcctcagcctcccaagtagctgggactacagccacgcaccaccacccccagctaatttttgtatttttagtagcgacggggtttcaccatgttggccagggtggtctcgatctcgacctcgtgattcgcccaccttggcttcgcaaagtgctgggattacacgcgtgagccaccacgcccggcagatggtgacttcttttatcattgaggaagcagagttaaataaggcaccaacatcacctggctggaagtctcaaagagctccgatgctgaaaggatgaaacttcagttatctgggacatgtggcaggcggttctgtcattccctaagcatgttgggtttatcacgcactttccagttatgtgcttggcgctttgctgagctgatgaccaggaccgagccttactcagcgtctgttcgatgtgtcctaggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggtgagtagaaacccggggctctgtttggtggtttggactccacattcagactctctcacttataactttagcagttgttgaagttctggaaattttaggatcacagtcatcaataagtgaaattctgtgactgattttgttcccagttatgctaattgataccagactctgttgatggactgaagagcagatgtctgatgtcaccacatagtctacagccacttccaaatgccttactgcactttgtgcttagacagtacattggattattcatgttgatgtcatgacatatttttaccattattgattcctatattttacttatagaaaaagcataaggtgccgggtgcggtggctcacgcctgtaatcccagcactttgggagcccaaggcgggcagatcacgaggtcaggagatggagaccatcctggctaacacagtgaaaccccatctctactaaaagtacaaaaaattagctgggcgtggtggtgggcacctgtagtcccagctactcaggaggctgaggcaggagaatggcgtgaacccgggaggcagagctggcagtgagccgagatggtgccactgcactccagcctgggcgacagagtgagactccatctcaaaaaaaaaaaaaaaagaagaagaaaaagcataaggtaacagctgttgacaatggaaggatattaagtagaataattgagaccgtgtaaaatctttggctctcttagctgtacctttgttacactcaggaagccaaaggttaatgggagccggccatcactagggtttatggtggattgcaaatagtcagaatgtttgttctcaactagtaagacctggttcctatttctaaaattgaaactgagcagcatcactgaagatttctgccctgcttcagccacccccaccacaaagttgaaaagttttatggtgtggccaggacaagggtagtgaggaaggcaagacggggacctaagattcggtagccatttgcctatgtggagacatgtttactttacaatggaatatgacgttactgcatatttcccctgattttctgtatttgctcttaccttcgttatgtgactctctgttatgtgactcctgtcatcagcagaggcactattgccactccctggcctggggacaactcttttccactcttttaactttccacctcatgtctcttcataaacagatttcagtgcaagagccatggaacacgaaacaaaacagctcagacactggcctcccttaaaagtttgcaaagtgcaaggccatggagcatgaaacaaaacagctcactggccagacactggcctcccttcaaggtttgcagaattctgtgaaggccagatagtaaatagttgattaattcctttgtaacaaggtcaacacccacctattttgtacacttgttgggaagactaagcgaaaacacacatagaagtacctggcataaggccaagcacggtggctcatgcctgtaatcccagcactttgagaggccaagaagggtggatcacctgaggtcaggagttccagaccagcctggccaacatggcgaaaccccgtctctactaaaaatacaaaaattagccaggcgtggtagtgcatgcctgtaatcccagctacttgggaagctgtggcaggagaatcacttgaacccaaaaggcagaggtcgcagtgagccgagatcacgccactccaacctgggtaacagagcaagactcttctcaaaaataaataaataaatttattttaaggcctgctcatagacctgagccatctgtacactgtagccctgttcttttggccccagcctgtgcctgtgcctgctgtgatgttttcatttcctttgctacactatttactatctggcctttgcagacaaagtgtaaaggcatttcattttgcaaacctttaaggtttgcattttcaccttctttactgactagctcagatctctcctacttcaaacagaatgaccaactctgtcctgttatgactcttttatttcacagcttctcaacagtgaaatacaggagtactctgtgcaaaagcaaattcttgaaaagctaagtatatgttgaatttgtataaatccagttattacatttcatgaaaaccttgtgacttaaaggaatgctttcgtgactcccttttatggccagtgtttaatgctctctaagccacatcttcctgtttcaggtttgcttaaaaccatgtatgcccaaccgtagtgggtactgagtcaccttgtgagattacagcatagattattactattttccaggtgtttcatttaagtttactctgtctcattgactagatttaaaactattcaaggcataacttttatcttctttccttgcattactttgttatttgtatctgataagtacataagaatgacacagactgaactgccaggggcttttaacatttatggggaaaaaagtttatgaaatactggctggaagagctgactcaaaactttttttgctcagataatggtaagatttgtataattttctctcttttacttgtttctcaatgaatttggagtgatactttttttaattaaaagcataaatgtaaagaaaagtttggcttcttttggtatttataaataaatatttcatcagcctgcaacattccattaagtattagaattatcagatcagaaatggggagtaaagttgaaatataatgttgtctttcttcagcttatgatacacagcacctgtaaggattctttgaagattaatccaaccaattcctgttcctccactgaaatgggagtttttggtccttttcacttgtctcaacagcatgaattgtcctattatcctgtgatttcctaggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccaggtcagtgagttgagttggtctctctgtgagtttactggcagatttggagataataaccacagtggccagggaactcgtctggtgtaaatgaagatgagtgggttgttttcctttgagtgtgaagagcagatttgggctgggcgcggtggctcaggcctgtaatcccaacattctgggaggccaaggcagggggattgcttgaggccagactgcagtgagccgtgattgcaccaccacactccagaatgggtgagagagtgagatcctgtctcaaaaacacggtggctcacgcctgtaatcccaacactttgggaggtcgaggcgggcagatcaagaggtcaggagtttgagaccagcctggctaacatggtgaaaccccatctctactaaagatacaaaaaattacctcagtgtggtggtgcatgcctgtaatcacagctactcgggaggctgaggcaggagaatcgcttgaacccaggaggcagaggtttcagtgagctgagattgtgccactgcactccagcctgggcaacagggtgagactctgtctcaaaataaataaataagtaagtaagtaagtaaaaaacaaaagtaaagagcaggtttggcgctctgagccctctccagttgagttcttaccccatctttttaagggccttcttgacaaatccattacatttctgaaaagagcccggtttctcaagggatcagaatcttctttcctagtctcctgctagagtgctgttatttttggggttgtccagattaaaaatcttgtgtggttttctttacattcttccctctcctttattccgtgggtctcctgtgagcagatctgtctgtgtgtgcttcatttccacagccaccgatttaggctaagctgtccctgcgtgatcttctagtcatcccataaagggctggccccctccatggtccgttctgcctcattttcaacgtcctcacagctaatgtttattaactgtacacctcatttcacccacttttcgtatctccacccatttagtcctcacaaaatcctttgaggtaggttctgtaaagtctttgttttaaagtgaggaaagaggcacagagaggttaaatagcttgctcgaggtcacagagttagtgtgggacagaggcatgatccatgtccaggcagcctggccttgaacccatatcctcagtctctctgctgtccacttaaaatgcccacaaagaaccatgcttgtctctgtgtctctgtctttgttcacactacttatccaaatactattcatggctcaagttaatcatcagtaggcattctagaaggttctttacccatatctcatccaaaggagtaatattacaatagaagcattgtaggtacttttttttaatgacagctttattgagctataactcacatatgtaggtgctttctgatgtagcaggggaagtggtcttaacaaaggatttgcagtgaaaaaatacatagtcatgtgctgtttctgtcgatgctggaccacaaagaccatgtggccccatcatattataataccgtattttcactgtaccttttctgtgtttagaatactcaccattgtgttacaactgccgacaggattcagtacagtcccacactgtacagttttgtagcctaggagcaataggctataccatagagcctcgacgtggtgtaggccacgccatctaggtttgtgtaagtaaattctatgatgtttacacagcaacgaaattgcctaacaagacatttctcagagcgacacatgactgtgtgtctaaagcagttttatcatacaaagtagtggctcgtaagagggttaggaaattttagttacttgtagatgttaaaatatatactgctggccgagcgcggtggctcatgcctgtaatcccagcactttgggaggccgaggcgggtggatcacaaggtcaggagatcacgaccatcctggctaacacggtgaaaccccgtctctactaaaaaaaatacaaaaaaattagccgggcgtggtggcgggcgcctgtagtcccagctactcgggaggctgaggcaggagaatggcgtgaacccaggaggcagagcttgcagtgagcggagatcgagccactgcactccagcctgggcgacagagcaagactgtctcaaaaaaaaaaaaaaattatatatatatatacacacacacacacaaacactgctttactagcccccgactatataatactgcactgatttagaaacagaaagcaagtcatagcctgcagtgagggaaagaaaagggaagcacttacccattgaggtggggtccacacctgactgtagctggcgtctccagcccagccagaggtcggtgtggaaagccccagggctcttccatcgttgccgtagagagacttggaagagctgtttagtgtgcgccctctccagggtggttgtgctgtggctgccacatcacaggcgcttaacgtaacacacagaaggtttcggtgtgggtgggcacagcacgcccagtgaggtgatgcaaagcaactgggtgacaaaggaatgctttgagcggcctttgtttggtgaccaaccacacattgcattgcctggtcatgccttagattatggtggtggcctctggtggcacctggcttgggttgtagacagcagtttctggcacagtgacacacggggctccttgaatgtctaaatagtcctgttcttccagagtggtgaaacaaacacacatgtgccagtgacacatggagagaaaagcatattttaagaagtgttggggctgggcgcagtggctgacacctgtaatcccagcactttgggaggccaaggtgggtggatcatgaggtcaggagttcgagaccagcctggccaagatgatgaaaccccatctctactaaaaatacaaaaattagccgggcacagtggaaggcggctgtaattccagctactcggaggctgaggcaggagaatagcttgaacccgggaggcagaggttgcagtgagctgagatcgcaccgctgcattccagcctgggtgacagagcaagactccatatcaaaaaaaaaaaaaagaagaagtattgggctgggtgcggtggctcacacctgtaatcccagcactttggggagccgaggcgggcagatcacctgaggtcaggagtttgagaccagcctggctaacatggtgaaaccctgtttctactaaaaatacaaaaaattagccgggcatggtggtgtgcgcctgtaatcccagctactcgggaggctgaggcaggagaatcgcttgaacctgggaggtggaggttgcagtgagccgagatcgtgccattgcactccagcttgggcaacaagagcgaaactccgtctcaaaaaaaaaaaaaaaaaaaagtgtttttgcttcctttcacagtgtggtgtgtgtgctgattgttgggtattttctatttatattggccataagctgattaggggcctgcttacttgattgttttagaagagagctttggtggggcagggggcggtaagtgcagaaggatggatggttggcaagcactggggaagaggttgtaaaattgcattttcttctttggaagcagcagtatcttagtttgctttggtatgtcttagtttggtttggtatgtcttgttttccgggaaagacaaaggaagaggaaaatgacagctttgcaggtaaagaaactgagaggcttctctccctctataccaagagtaggctgaagacccatgtccagaaggctgacagaaaggtgcctgggtgaagagccactgagcttgatgctcaggaatctgagggcagagctccatgccagagaagtgggataccacattggtcctgggagccaagaggaccaggatagggagatgttaaagtggcctagactgtgtctttatgggcagacgccagttccatggacagactgcatatctgtcgtccatgaagcattgtctgttaacaccattttccattaaaaaagaaaaaaaattcagcacctacttagaaaataaaaaaaaatagccgggtgcagtggctcacgcctgtaatcccagcactttgggaggccaaggcgggcggatcacaaggtcaggagatcgagaccgtcctggctaacacggtgaaaccccatctctactaaaaatacaaaaaattagccaggcgtggtggcgggcgcccgtagacccagctactcgggaggctgaggcaggagaatggcgtgaacctgggaggtggagcttgcagtgagccgagatcgcgccactgcactccagcctgggcgacagagcgagactccgtctcaaataaataaataaataaataaataaaaaagaaaataaaaaaaataaaaatcccatcagtcacacttcccccatgcagtcagtctttcctaagtaattgctccctcctctaacctaccagaatatgagtctgcgtctcacaaatgtaatgcttcattttcttgttatttttttcttctttaatgaggtaagattaatatataacgtagaagtaaccatttaaaagtgtaccattttgtggcatgtagtacagtcacagcgttgcacagccaccacctctacctagttccactacatgtatcaccccaaaaggaaaacccttaaagcagtcgctgtctagacccccttgccccagcccctggcaaccacaaatctgctgtctctcttttcctatttttggatttacctattcacctctccgggatatttcatataaacggacttatacagtgtgtaaccttctatgtctggcttccttcacttagcatcatgtttcaaggttcatttgtgttgtagaatgtatcagtatttcattcctttttaaggctgaataatatttcattgtatggatataccaccatttgtttatcctcatccattgatagacatttgggttgtctccagcctttggctcttgcaaatagtgctgctatgaacatttgtgtaaaagtatttaaacacctgttttcagttactttgggtctacacttgggagtgggattgttggtcatgtggtaattccatgtttaactttttgagggatgccagaatgttttctacagctgccgcccatttgacattcccactggcaatgtataaggtttaagtttccattctttttcattttttttctttggtttagtttatattctttccatcatgaagtttaaaaattaaacatgttaatttgtttttgtttcttaaatactcatcctagtgggagtgacgtggtatttcattgcggttttgatttgtatttccctaatgtcaaataccattggacaccttttcatgtgcttgctggccatttttatattttcttgggagcaatgtctattcatgttctttgcccattttttaattgggttgtttgtgtttttgttgttgagttggaagagttctttttttctttttctttttttttttttttttttgagatggagtctccctctgttgcccaggctggagtgcagtggtgcgatctcagcctactgcaacctccacctcccagattcaagcaattctcttgcctcagcctcccaaatagctgggactacaggcgtgcaccatcacgcctggctaattttttttgtatttttagtagagacggggtttcaccatgttagccaggatggtctcgatctcctgacctcatgatctgcctgccttggcctcccaaagtgctgggattacaggcgtgagccaccgcgcccaaccagaagagttctttatgtattctggatgctaggtcatatcagatgatacatgtatcattggatatatgatttgcagatattcttgtgttagtccattgcatcactatacagaaatacccaaggctaggtactttatgaagaaaagaggtttaggccgagcacagtggctcacgcctgtaatcccaccactttgggaggccaaggtgggcagatcacttgaggtcaggagatcgagaccagcctggccaacatggcaaaaccctgtctctactaaaaatacaaaaaaattagccagccgtggtggcgcacacctgaaatcccagctactcaggaggtggaggcttcagtgagccgagagcgtgcctctgcactccagcctgggtgacaaagcgagactccgtctcaaaaattaaaattaaaattaactgggcatagtggcatgcacctgtagtcccagctacttgggtggctaaggtgagaggattgcttgagcccaggagtttgaggctgcagtgagccatgattgcaccactgcactccagcctgagtgacagaatgagactctgtctcaaaatatatatatatatttatagtaaaacatatatggcaaaaacactggccacttgttttgcgatggtgatacaaatacaaatatatatcatcactaagcaagtggccagtgtttttgccatatatgttttactataaatacaaactacagcatactttactgtttggcatggcagtgatttttatgaattaggcacctgtgaggtagatgttactctgcccattttacactcaaagaacctgggcttaggagggttcagatttgcctacgactgcacagctggtaggtggtagagccagaattcaagttcagatttgtctgggtccacggtgggcgcctgacctccactccacaacttcccttcctggggacataaatcgtgtctgttcccaggcctattcatcagttcaccagggtggtctaacgtccatggagcccctgacatgtgctagtgctgaactaaatgagcttgaagaagcttgaaagtgaacaggagaaggctcctctagagtatgaacaatagtggattgtttttaccatgcttacctttgtggaagagagctgaaattttcacctcttctttcttataggctgccagggcacagtgccccccaaggactgaaatagactagatttccttctctttttaatgtttaaactttaaaagaaatgcgtgctagctgtaaaaattcaaaaaaaaagcccgtctgcctcagtcctgcagccctctccagagggagtgacctcgtacagtttggcacatattattccagtctttatccatttgtaagcataaaaagtgcatacttttatgaggctataaatgcataaagacggatatataaaatatataagtgtatatataattttagggcttttttagtgggggaaaatccacaaatggataatactttggatattttctgcagctcgcttttttccacctgacgtacatttacgtctcacattgccattcctcctttgcagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagaggcaagtggactcgtcgttttcatgctgatttcttttgagttaactggaaatcgataacattacaagaggacgtcctgtgcaattaattttttaatggtgtgctagagctgctttttgagacaatctgtcttaaattacatttgcctatttttagctcatattgtaaattgagaggaagaaacatccttagcttagcctgacttaaagccagataacaaccctgaagattctaagggcagggctgcctttgcaagtggggattcacattttcaaagaattcccagaagtcctaagacaaagaattccagcctgccgtcctcgccacggagcctgtggggcctgctgctgggtctgtcccaggctttcttctctgttccctccccccagcagtagctgacaaagaagcgccttccccttacaaaaggcaatgtatatgcctttattgaaggctgatttccttctaaacctgggggcctcacaggggccctttgattgctgttcctttggatagatttttcgctggtagaacgggctttgttttctttttcagtcgtgggctctcagtagattagagtttgctttgctttgtccccgcagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccaggtagaggagggtgcagtttgaggtgcagcgctggcgtcagtaccaagagataaagcccaagtcacatattggagatgaagcagaagggaaatttatcaaatgcagaaactacctactttatgacactctgtagcaaagacccaaaacactcttggccctttttccctgcagacatccagtccctccctctcatgtcccagtccttctggagtcttcggctcaatgagggaaagaatggccttttcttcccatttatacagagcgacaagcatcctctctcaggaagagccctcccatctggggcattaatcctcctttttttcttttctcagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaag

SEQ ID NO: 36140 - DNA, 2136 bp, Homo sapiens
cggaagttttgctgctagtcgcggacgcaatggcttcaaggttacttcgcggagctggaacgctggccgcgcaggccctgagggctcgcggccccagtggcgcggccgcgatgcgctccatggcatctggaggtactcgggtctccgggcgtgccagggaccagagtgttgccctcccagggtggtcccagggcggcaaagcggcgcggctcgtgcagcttctcgaggtcccagtggccgctttacggtccccagtgcctcaggctctgcaggcatctccctgtaattctggaccgctgctcctgccgctccccgaactcactccgctgcgaaagtatcctaaacggaggtgccgggtgaccttgggagggaccggggctgccaccgggatggggaggggtccggcctcccttcaaacctgcgcccacctcaagcagagtgggttctacatgcttttagacaaatgtcgacaaatttgcctcggtggttggagaaagaaaagctcataggccgggcgcggtggctcacaactgtaatcccagcactttgggaggccgaggcggacagatcccctgaggtcaggagctcaagaccagcctggccaacatggtaaaaccccgtttctactaaaaatacaaaaattagccgggcgtggtggcgcgcgcctgtagtcccagctactcgggaggctgaggcaggagaatcgcttaaacccgggaggcggaggttcccgtgagccaacatcgcgccattgcactccagcctgggcaacaagagcaaaactccgtctcaaaaaagaaaaaaaaagctcccccgagtgctgccgcttgtgtggatgggtacttggtggttcttaggggaccatggatatgagtagcctttaggagcttgtgagcccgctaaaacttatacagaagtttcggggcaccattttccttgatcatttctgtttgtagtttttctatcagtcatttcagtcagcgtcataattcacgttatcttcctttaggtggtgttcccactgatgaagagcaggcgactgggttggagagggagatcatgctggctgcaaagaagggactggtaaggagaaactcccttctgtgtcttctgtgtaacttatggccttggatgtgttcatagtggtctcctctctgggagtatttgatacaggaaacttggcttgtaggaacagtcccctgagcttctggaaggtagggcttatttggcctaatggttcaattcttgttttttttgttttgttttgttttttgttttttcttcaggacccatacaatgtactggccccaaagggagcttcaggcaccagggaagaccctaatttagtcccctccatctccaacaagagaatagtaggctgcatctgtaagtacctcacctctattttttatccacttgcttaatatatcctacaatagtgtgtaagctgcctcaaatcttcagtgtgtgagtgcatgttggtaagtttgtctaagggtcttgacactctcaagcctcattatgcctgatagttcatccttactggaaagaagcgcagcacagcggtaagactggctcactgggagtgcggcatgaaggagtacccacccagcaaatatttattgttatactgcttctatgccaggcatcattttagacactagggatacataccagaacggaccctgctttgcgttctacataggcaagggaattgttagaatttacagtgaccttgatacaaggtcagtttactcataggtgaactcagagcctcaatttcttcatctgaagaatgggaggagggcttgaactgatctcttaagatatcaaccatagtcttacttgtgtatcagagatgtctgaggaaaagaaattcatgttgaaagtctccctttctaggttggatgaccataaaccaccttttttcccttttaggtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccat

SEQ ID NO: 36141 - DNA, 81712 bp, Homo sapiens
gaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggaggtcagaaatgaactcccggatatcccccacctctgcctggggcgggagggtcctcccagctgcgaccccgatatccccggtagtccctgggtggtcctccttgcggccgcccttctgcctgtgaggaagcagcagtgttcccctcctccttccgccgccttcccctcccctcccagagcgctaggatggacggtctcgcgggcgggtggtctggggtggaacatggtttggggaggtgatggacagggggcaactcctcggagggatggaagctcacaagagaacccgaggcggtggccgcagctggaaatgtggctgtggggtggggagggagcaggccgagcctgagaaaacccgggaagtgggttgggggaaggggaaaggtggtaactggatcccaagagcagtgctgctcgaaggcccacacttttgagggtattcggggttattgcctgtcaggccttcactgttcttttcttggggaaggagcagtgagtccttaggtattgattaaaaaggaaggacattcagagttagtccttcttagttgggtgttaggagtcaaagggagacataatagaatactgtcttatttggtggcaggggtaagggaattttcacctgagttagcaagttaattccaaataagataattatctcttttccacttaacccccaaattcctaggcctcatctttattgacatctcaatcttttgagtgggcaaaggcaaggtgtttggtgtattaaagacatgtaaatatttttagttaggaaacaaataatggaatgtatgagtagcttatttcaaaatattgtttacaagttacagatcagagagactgtcttaagacagtgcctctgtgactcgtgttgtgccacgaaacttcattatgatgtccctcatagttaacttgattcttacttttgaaaagcagacctattaaaaatgtgaaatttcaccagattaatacattgtttcatctccttattgagatttatcacgacttaacagattttcaaaaaagttgcctcccgttgctcttaagtcctgcagaatttagatacatttgtactacgtttatttatgtaagatattcacagtgctctagtaatttgactcaaaattatgcaagtattagtacagtttctcataccaagatcaacaagaatgccagattgtcttccccacatgaattaaacaaaaagtaatacagaaaatgattattttcaagattcacataccattattgaatatatcattgctatttgtgtttttcttttacagttagtactttaatagtgtcaataataatttgtgaaattcagcattctaagtatgtgatgagtatacatggagaaaaaattatttaaaattcaaaaatgacaacagacttattgaaagtagtatataagtcatggtcggttttacagagcatgtgtatgaactctgacctctatgtttgttcatatgccaaaactctgaatggaaggatgactttgtattttgtggtacaatgcagaaatagagtcataagtgtctgtactgatacaatgaaacagcaattttaacttatttaatatgaaaatgtattccaggttagttgacatatatactcctaatgaaagcagttgttgttgccaacaactgaaaacatttcttgtttaataaggttgtacaagcctgaaacttaatagacttttaatgctttattttctgttacttacggtaacagaaacagtaagttactgctctggtaattaatgtggtctctttgctttttatgagctgacttttcaccgtggtattcttagtactaagttgaagattaccagaaatacttgtattgctctctagtaatgcatattaaaaaaacactgctctttatacgtaagggatgttgaagccttacttcagataagcatcaaaagtgtttcagaagaagaaaacaggaaatgcaaacagacaggttttttgttgtttttgttgtttgtttgttttgttttgttttgtttagaacagtacctgtataaatatggaaggaaacttctgggaaaataagttggaaagaacatttaggaaagggtcacatcatttaatcttggaataaatataaccaataaatagcttattttcaccagtattttttgatattttagtagccccagttctataagtgtattgttattttcaactcattgaagacttgtagtatagtccatgtgtttcctttttaagggtgtaaatacagtcttttgaatggctgatcaaataaatgtttcatcatgtcacttttttggtaaatcagcactttaccgaagtttatttcatgtgtttgtatgcttgtgtttactaagaacactggttgatttaaggactttttggggtggccttataagagcctttgtaaagatagctgacgcttactggattctggttatgagagattataagtggccgttcttagagtgtgttaaaatacagccaacaagataaatgtgaaaaagcaaggtgcagaatagtgtggaagaggccatttgtgtcaaaaagaagggcatgtgtgtatttgcctgtatgggtaaaaggtttcatgagaaattggtaaaattgattgctttctgtgtagagagttgggtgtctggggtatagatattttttgaattttgtgtcatacaaatgtgatttacttaaaggcatcatttggcctctttcccttaagacagtgtttggaaatttgtcagatgtttctttttattaattaatatttattttctttgttttagatgtttgtttttaaatatgagtgtgaattttaagtagttttaaataatattccaaagttgttaggcatggaatattgatgtaaagtacattttataattagttattttatgagtaggattacataagtaaattattaattgtgaggatataaacccataatcaatgttttattcataagttttattatttactattagttattgctgctgttaataactagctgccatttgtagaatggctagttgttcttagtatcatttgtttttacgttattgctaattcttaagcacagttctttagatgtcctatttcctagatgagaaaatagagatttagagaagttaaattatttgtctgcaatcacagagcctgggatttggatctaggtctgcttgtgttcatattgtcccacgctgtcatgacttgctaaggataggcatgcttttaattaatttaaaaaatcgagcctggtttgtattactggttaaaggatttaaacacagtttaatttgctagtttaaactcattgaaataagtgttacctataattaactttaagatgtacttgaatttctttctttcatgtttttttttttttcttttaagaaggaatctcgctgtctcgcccagactggagtgcagtggtgcgatctcagctcaccacaacctctgcctcccaggttctagagattctgccgccttagcctcctgagtagctgggattacaggtgcccgccaccacgcccagctaatttttgtatttttagtagagacgacgtttcaccatgttggccaggctggtcttgaactcctaacttcaagtgatccgcctgcctcaacctcccaaagtgctggggttacaggcatgagccaccacacccagccagatttacttgaatttcaatataccaaatattttaaaatttgaaacttaatgaaataaaacacccttaaatcagtgcactctcttgttggtcttatgctatatggcacctgttggtttttcatgttgtaattgcactttggtaacattttcttttcttttcttttcttttcttttttttttttttttttttttttttttttttttttttttgagacggagttttgcttttgttgcccaggctggagtgcaatggcgcgatcttggctcaccccaacctccgcctcctggattcaagcaattctcctgcctcggcctcctgagtagctgggattataggcatgcaccaccatggctggctaattttgtattttaagtagaggcgaggtttctccatgttggtcaggctggtcttgaactcccgacctcaggtgatccacccgcctcgacttcccaaattgctgggattacaggagtgagctactgcacctggccaacattttctagtctcatagggcgtgtttaaatctatggcataaacaaattggtttcgtgaaaattactatatagtacattaagttttccctcatcatttaaatagatttttgtgtctattttcctttaaaattttaatgtacttgatctagcttgatctagattattctgtaatagaagtagttgtaaatctctaaaagtaagtcttttgatttctgtagaccatggattttttaaccttggcactactgacattttgggcagatagttctttgttgagtggctctcctgtgcattgtgggatgtttagcaacatccctgacctctaccagtatatgcaggtagcactgcagagccccagcgcatgtccccactatctcttcttgctggatgcatcaactaaaaatgtccccagactgccatatgttgagaactatgtagacaaaacttttttttttgatacagagtcttgctcagtcacccaggctggagtgcagtggcacgatctcagctcactgcaacctccacctcctggttgcaagccattctgcctcagcctcccgagtagcttggattacaggcgcctactaccatgcccggttaatgtttttatttttagtagagacgggggtttcaccatgttggccaggctggcctgacaaaactctttaaaagagtgtttatggccaggtggggtggcttatgcctgtaatctagcattttaggaggctgagactcgattgaggccaggagttcaagaccagcctgggcaacatagtgagagtttgttactactaacatttaaaaaaaatcagccaggcctggtggtatgtgcctatagtggcagctactcgggaggccgaggctggaggatgcttgagcccatgaggtcaaggctgcagtgaattgtgatcatgtgaccgcactttagcctgggcatcagcgagaccctgtctcataaatgaaaaaagaaaatgattcctggctatttattaactatataagaagaacacagccaggcgtggtggctcacgcctgtaatcccagcactttgggaggcctaggcaggtggatcacgaggtcaggagatcgagaccatcctggccaacatgatgaaaccccgtctctactaaaaatacaaaaattagccgggcatggtggtgagtgcctgtagtcccagctacttgggaggctgaggcaggagaattgcttgaaccggggaggtggaggttgcagtgagcgagatggcaccactgcactgcagcctggcgacagagcgagactccatctcaaaaaaaaaaaaaaaaaaagaatactttgagacttaactgtatcagatgtgtaagataatttatctaaagaataaatggacacagacagtaaagacaaaaaatatatactggctttgaatgttttatttttaaaacttttaagtttgtttcccgtttttagtgtttttcttttaaaatttctcgcttttgattttaataaaaaggtaaaattttctaccaaaaatgaatgtaacgagaatttgaacagttgtttctaagactagaggcaggcgtggtggctcacatcggtaattgcagcacttggggaggctgaggcaggagaatcgtttgagtctgggaggtcgaggctgcagtgagcggtgattgtgccactgcactccagcctgggtgacagagcaacacactgtctccaaatagtaaaaaagtggtttttaaagtttttatttttattttattttttcaaaagtgtgtttgaaagttatgtaagttacagttttatgtaatatttaaatagtatttcttatggtttctggaatgggttgagcaaggaaagcctatagattgggttaaaaaaaatcaaagtctgtgcaggtaatatgtttggggtgaattccttgtatacagtgttacaaagactttgagctctgtccattgggcgtaggtttagacacatctgggctccctagcttcttccctttttatttatttatttttgaaacagagtctcactgtcaccaaagctagaatgcagtggcgtgatcacagttcactgcagccttgaactccccaggcttagatgatcctcctacctcagccttccaagtagcagggactaaaggcgtctgccaccatgcccagctaatttatgtaattttttgtagagacggggtttcaccatgttgcccaggctggtctcgaactcctggactgaagtgatcctccggccttggccacctgaagtgctgggattacagacgtgagccaccatgcttggcctgtcaccccttcttaaagactatacacctttttttttttttttttttttagacggagtctccctctgtcgcccaggctggagtgcaatgcgccatctcggctcaccgcaacctccgcctcccgggttcaagcaattctcctgtctcagcctcctgagtagctgggattacaggcatgtgccagcatgcatggctaatgtttttttttgtttttttttgtttttgtttttgtatttttagtagagacgggtttttaccgtattggccaggctggtctcgagctcctgaccttgtgatctgccgcctcggcctcccaaagtgctgggattgcaggcatgagccactgcacctgggtttttttttttttttttttgggagacagagtcttgctctgttgtccaggctggagtatggtggcacgatctcaactcaccacagcctctgcctcccgggttcaagcgactctcgtgcctcagcctcctgagtagctggtattacaggcgcaccccaccacgcccagctaatattttgtattgttagtagagacagggttttaccatgttggccaggctggtctcgaacccctgacctcaagtgatccaactgccttggcctcccaaagtgctgggattacaggcgtgagccaccgtgcccagccaagactatatactcttatttcccgtgaatacattattgacagttattgaaaatattgactatagccccaaaaggcttaactggttagagatacagggcagacaaaggatagataaaaatggtgggggcaaagagtaaatgctatgggattctaaagggtatctgcatgagagagattcctttttgttgttgttttgttttgtttttgtgacagagtctcggctctatcacccagcctggagtgcagtggctccatctcagctcactgcaacctccgcctcccaggttcaaccaatacctcagcctctggaatggctgggatcccgggattacaggcatgcgccaccacgcccagctaatttttttttttgagacggagtctcgctttgtcacccaggctggagtgcagtggcgcgatctcagctcactgcaacctccgcctcccaggttcaaccaatacctcagcctctggaatggctgggatcccgggattacaggcatgcgccaccatgcccagctaattttcttttttgagacggagtctcgctctgtcacctaggctggagtgcagtggcgctatctcagctcactgcaagctccgcctctcaggttcatgccattctcctgcctcagcctcctgagtagctgggactacaggcgtccacgaccactcccagctaattttttgtattttttttttagtagagacggggtttcaccgtgttagtcaggatggtctcgatctcctgacctcgtgatctgcctgccttggcctcccaaagtgctgggattacaggtgtgaaccaccctgtccggccacaatacccagctaatttttgtagttttagtagagacagggtttcattgtattggccaggctggtcttaaactcgcggcctcagatgatctgcctgcctgggcctcccaaagtgcttggcttaaatggtgagccaccatgcctggcatgcctggactttttttttttttttttcccagatggaatctcactgtgtcaccctggctggagtccagtagcatgatccaagctcactgcagccaccacctcccaggtcaagcggttctcctgcctcagcctaccaagtagctgggattacaggcgcgccccaccgcccagccaattttttatattgttagtagagacagggttttatgatgttggccaggctggtctcccaaagtgataagattacaagtgtgagccacaatgcccagccaagactatatactcttatttcccagtgaatacattattaacagttaccgaacatgttgaccacagccccaaaaggcttaattggttggagatacaggacaaaggatagataaaaatgggaggggcaaagtgtaaatgctatgggattctgagggtatttgaatgagggaggttcttttttgtttttgttttgttttgagtcagagtctctgtcacccagcctggagtgcagtggctttatctcggctcactgcagcctccgcctcctggcttcaagtgattctcaggcctcagcctccagaatggctggaattacaggcatgcgccaccacacccggctaattttttttgtatttttagtagagactggatttcaccatgttgaccaggctggtctcacactcctgacctcaggtgatctggctgtcttggcctcccaaagtgctgggcttacatgtgtgagccaccccacctggagtttttttgttttgttttgtttgagatggaatctcactctctcacccaggctggagtgcggtgacatgatcttggctcactgcagcttctgcttcccaggtcaggcagttctcctgcttgacccagtagctgggattacaggcgcatgccaccatacccagctaattttcctatttttagtagagatggggtttctagccaggctggtctcgaacttcagacctcaggtgatccgcctgccttggcttctcaaagtgctgggattacaggcatgagccgtcgtgcctggcctgtatgactgtatgagggaggttcttgagctaggtgccttttttttttttttgagatggggtctcactctgtcgcccaggggcacaatcatagctcattgcagccttgacctcctgggttctagcaggccttccacctcagcctcccgagtagctgggactacaggtgtgtgccaccacacctggctaatttttattttttgtagagatggggtctcattgtgttgcccaggttggtcttgaactcctggcttcaagcagtcctcctgcctcagcctcccaaagtgctgggattataggcatgagccacctcacccagccttcttgagctgagttctagaggaaagttaagactgacctcaaatttcaggagacagtcccaaaggaattctggtaatattgcaattttttttttctgagacagttttgctcttgttgcccaggctggagtgcagtggcacaatctcagctcattgcaacctctgcctcccgggttcaagcgattctcctgcctcagtctcccgagaagctgggattacaggcatgcaccaccacgctcagctaattttgtatttttagtagagaccgggtttctccatggtggtcagtcaggctggtctcgaactccgggactcaggtgatctgccagccttggcctcccgaagtgctgggattgcaggcgtgagccaccgcgcctggccgagattcttaagtaaatgaacttttctttaggcacatgaattggaactatggaacaaagagattattgatacaattattcaagaagcacatttgcatatttagaacagaaaggttgcacagctcttacatactcaaacatagttttagagttagatcatgatcttaactttcttcatggttaccttttggggaggaaaaccaccctttttcatattaaagtaaaatgtgtacgtaataaagtgtgactggcatccaaatcaagaaacagacccttcccagtaccatgggaatctgcctgcctttctagttactttcctgacttctaataaccgattagttttgagtatgtttgagtaaaagaatagatgtgagtatatattatgtattttaagtttgaaagttttcaaaagatgcttttcaaaatctttcttaagaaaaatatagtgtcttagaaaatgtgccaaaatgtattgaatttcagagctgaaacagatctaggccaaacttctcatctataaaatcaggaaattgaggcccaaggaggttgattgtttctcagagaaacagagctggttaatggtgaacccaggctttttgcataccagtttagtcataataagtagttggtttttgggaatatccttttcataaatgatagtataaaagctgactgctaatacaactttacagaaggggataacaatgcagtattatttgtgtctttttttttttttttcctcttagtatgagaacttgaacttgccaaggaggtagagattttttaactcctgaagcataatttagttaagttagcttagtaattaagggcgtgggctttagaattagatttgctttgagtcctggcttttcttcttaaaacctgaagtactggctctgtatctcgatttttttaatctgtaaaaatgtgggaagattaggagagtccttgcggtgcttagaacaaccttgggacataattaaacattcagtaaacggatagctgttagatgtcagaattagctatgttttcatattctgtcgtgcttattattcttggattataaaggtattgttcaatggtttagtgattattggatgtaaatatgcctcaagaaaagctcaagatgagggttaaggtacttctaatagtgtttctttgtcacctgtgtgccaataatccatggggctagtggccaagtagtccacccttatctgcagtttgattttctgcagtttcagttacccattgtcaaccatcgtccaaaaataagtgagtatagtacaataaggtattttgagagagcacattcacgtaactttcattacaatatattgttataattactccattgttaatctcttgtgtttaatttatagattaaactttatgatatgtatgtacgtatagggtcggtactatctgtggtttcaagcatccactagggatcttggaacgtgtcccctgtggataagaggggatatattaatacaaaggaatatatgtgggctctgttctccagatgtgatttatttaatctttctttaggagacagttataaatcgttcaaagtttgtgttaaaatgttgccttcctgaatgaaaaagttcatttgggaaactctcaaatgatatagagataatgggattattttgaatttcttgacatggctctgggtttcctgaaactagaccaaagaatctagattctaatcctgtggtgtataatcttggatccctttgcaaatccctttttcagtgggctttgggagccagaaaataggcagtctcattcatctgacatccattttattctcttacataaatctgaaaaggtgggagaactttatttcattgaacatgcttttttaaaatttttttatttttttaaggctagtcaaacgaagcagtggaaatggaaaaggaaaaaagtctgtaactggttatgatcaattaattgtaaacaccactgcaaaaccctttttttctttctcttccctttagttctttgcttttactccaaatttagaataactgcctacagttgaatgcctactgtctgattgattgattgattgattgattttaagacacaaggtcttgctctgttgcccaggctggagtgcagtggcagcagagcaagaccttatagctcactgtaaccttgaactcctgggctcaagtgatcctcctgcctcagccttcctagtagctaccacacctggctaaattatcttttttaaaattttttgtggagttgaggttctcactatattgcccaagctggtgtcagactcctgggctcaagcagtcctcctgcctcagcctcccaaagtcctgggattacaggcatgagctactgcaccctgcctatctgacattttttatatatggcagctttatgggattgatagtattcttgtttcacagatccaacagttgcagctgtgaagaaattaagtaactttctcagtatcagtaacttggtggtggaacagaggtttgaaaccaggtctgtgcgtccaaaatattggtggttatggtagaaagagttatactcatatctgctgcttgctccctacatttttgaagatttttttaaaactaagaaatactttatacttagaagttttaaaagtaatacgtgaacatctttatatctgtggtccatatttaacagatagtaatcttctcatactgtgggctaaactgcctctacccaaatactgtaaaacatagaggtaaagctcactggataacttttttcttattccattttttctttctttctaggagtatctgctatgtgaagttagtgtatatccttccccttcatatttttgtttttactgttaatatctcctgaatttaaaaataaaatacttttttgcttttttttttaaagttttttttaaaaacagtttttatgaatgattgtaatgtatgtctcttggaaactttttctctttttttttttttttttgagacggagtctcactttgtcgcccaggctggagtgcagtggtgtgatctcggctcactgcaagctctgcctcccggggtcatgccattctcctgcctcagcctcccgagtatctgggactacaggcgcccgccaccaagcccagctaattttttgtatttttggtagagacagggtttcaccgtgttagcctggatggtctcgatctcctgacttcatgatccgcccgcctcggcctcccaaagtgctgagattacaggtgtgagccaccgcgcccggcagcattattttttaaagatctgtgatagtgcatgttgtgctagttctttaatacagactatattgtattccatgtcagtttttaaagtttatttccctattgatggcatttaattccaacttttagataaaaggatgtactggacatttttataattttttggggaacatgtaagagtttttctaggaagtagatttgtaagacctgagcgtattttcagcttctgcctgactggacattgcttcactgttctccagatgattgaatcaatttacattcccactaaaagagttctgcccgggagaggtggcttactcctgtaatcccagcactttaggaggcaaaggcgggcggatcacctgaggtcaggagttccagaccagcctgaacaccatggagaaacctcgtctctctactaaaaatacaaaaaattagccaggcatggtggtgcatgcctgtaatcccagctacttgggaggctgaggtgggagaattgcttgaactggggaggcagaggttgcattaagccgagattgcgccattgcattccatcctgggcaagagagggagactctgtctcaaaaaaaaatagtcactattttttgtaagactatctcaggaaaaaaagaggaagggaaaaaaaaaacgtagttacttgaaaccgcccccccttttttttttggagatggagtctcactctgttgcccaggctggagtgcaatagcaccgacaaccttttttttttttttttttttttttgagaccgagtctcgctctgtcacccaggctggagtgcagtggcaagatctcagctcactgcaagctccgcctcctgggttcatgccattctcctgcctcagcctcccaagtagctgggaccacaggcacccgccactgcgcccggccaatttttttttttttttttttttttttttcagtagagacagggtttctccgtgttttttttgttttattttgttttgttttaagatggactctcgctttatcgcccaggctggagtacagtagcacaatcttggctcattgcaacctccatctcctgtgttcaagcaattctcctgcctcagcctcctgagattatagacgcatgccaccacgcctggctaagttttgtatttttagtacagacagagtttcaccatgttggtcaggctggtcttgaactcttgaccttgtgattcgcccacctcggcctcccaaagtgctgggattacaggcgtgagccaccgcactcggcctacatttttaagacttatgtttttgtcactatgatggatgtgaaatggtggtttattctaatttttacttccctagtcagtagagatattaagcatgttttgtgtttattggccattaggcttttgtaaatttagtgtttacttttttttttttttttttaaatgagacggagtctcgctttgtcgcccagactggagtgccgtggcgcgatcttggctcgctgcaacctctgcctcctgggttcaagcgattgtcctgcctcagcctgccaagtagttgggattacaggcatgccccgctaagcctggctaatttcgtatttttagtagagacgggttttgccatactggtcacactggtctctaactcctgacctcaggtgatccgcctgcctcagcttcccaaagtgctgggattacaggcgtgagccaccatgcccggccatgtttacattctttaactgcttttttaaaaattggatggtttggcctgggcaacaagagtgaaatttcatctcaaaaaagaaaattaggtggtttgtagttttctccttcttctgtaggaaattttttttttttttttgagacagttcttgctctggagtaaggctggagtcttgttctggagtcagggtttcgctttgttagccaggctggtctcttcctgacctcaggcaatctgcccatctcggcatcccaaagtgctgggattacaagcgtgagccactgtgcccagccagatttgtaggaattctttatgttatttatatgatattgtctatcttacattatgtggcttgatttttaattttggcttatctttttatgcttttttttaagttgtagtaaaatacacataacataaaatttatcattctaaccattttaaatgttcagtggcattaaggacattgtgtagctatcaccaccatccatctccagaacttttcatcttgcaaaattgaaactctgtacccaatattactaactccctatccccctaccacccagcttctggcagtcacatttctactttgtatctcaatctgtgtgactgctctatcattcattatttgtccctttaaaaaaaaaaactctgagtatactttcttcatttttgtttaaaaccgaaactctggaagttaaaaataacatccttgcccatgagcagcttttttttttaagacagagtcttgctctattattgctcagactagagtgcaatggtgcaatcatggctcactgctgcaacctcaacctcctgggctcaagtgatcttcccacctcatccttccaagtagctgggactacaggtacaccaccatgcctgactaatttttgtattttttgtagagatgaggtctcacactactttttgtagagatgaggtctcagcctaggctgatgtcaaactcaagtgatcctcccgcctctgcttcccaaagttttggggttataggcatgagccaccggagccatcaaatccctgtgcttcttacagacaccagaaaaagtttcagccttgttttcaacattgttctgctgtgctttgtccaaatgaacctttatgagctgcctgccatccagtttctcttgcccacaatttcacttgggaagaccaagccctcaaggattatgtcatgcacgcctgtcagaatagggctcctgggacacttctgcttattttttgtacagcttttcgagttggcttatgcagaattatcctctgagcacattatttgtccttttgtgactggtttatttcacttaactgtcctccttgtcttttagaagtttcatatatatatatatatatatatatatatatatatttttttttttttttaagactgagtctctctctgttgccaggctggaatgcagtggcgtgatctcagcccactgcagcctccgactccctggttcaagtgattctcctgcctcagcctcccgagtagctgggattacaggcatgtgccactacccccagttaaatttttttttatatttttagtagagacgggttttaccatgttggccaggatggtctcgatctcctgacctcgtgatgtgcccaccttggcctccctaagtgctgggattacaggcgtaagccaccgtgcttggcccagaagttctatttttaagagacaggtctcactcacacgcttacccaggatagagtgcaatggtgcaatgatgactctctgcagcccggaactcctgggcttaagtgattttcccatgcctcagcccagcctcctgagtagctgggactacaggtacaagccaccactcttggctaattttttttttttttttttgagacggagtctcactctgtcacccaggctggagtgcagtggcgcgatctcggctcactgcaagctctgcctcctgggttcacgccattcttctgcctcagcctcccgagtagctgggactacaggcgcccgccaccacgcccggataatttttttttgtattttttagtagagatggggtttcaccatgttagccagatggtctcaatctcctgacctcgtgatccacctgcctcggcctcccaaagtgctgggattacagacgtgagccaccgcgcccggccagctaatttttaaaaaaaatttttgtagagatgggaatctccctatgttacccaggctgatcttgaactcgtgggttcaagggatcctcccaactcagcctcccaaagtgctgagattataggtgtgggccaccatgcccgtctgcttttttgtatttttagtagagatagggtttttcacgatgttggccaggctggtctccaactcctgatctcaagtgatccacccgcctcagccttccaaagtgctgggattacaggtgtcacccaccgtgcctggccctgtttaattttaaagtagtcaatttttttctggtgtattttacttattgtcctcctttttgtcttacagaagtttaattttaaggtattcagattttatcttttcctacatggtgtgttttttgcattttaagaagtcttctcctactttgatattaataaaggcattctcggacccaggtcactggttggcctgacctcctgctctggaggcactgtgccggaggacccgtttttttttatttatttttttaaagacattcttctgtatttggtttttaaaagttaattcattttcttaacttctgtactcaggtttctctctctaccatgtcatactgaaactgctccttcaggcagtaccttcccaattacagaacacagagtgagttctcgtgatcatccattttgtacatgttccttcagcatttccatttccatcttagaactctcctcctttggttgctctgatactgctcttttctgattttcctctaacctctgttactatcctttataaaatattgtcactgatttacctttcatcctccacttgtctctggaatgtttgttttctcttttttattccttttgttaataccataggtcaggtttttatatctcaggatggactatttatttatttgaaacatggtgtctgtctgtctatctatcatccaggctggggtgccgtgttgtgatcacagctcacgccgcagtcttaacctgttgggcttaagtgatcctcccaccacagcctcccaagtagctggcattacaggcatttgccaccatgcctggctgattttttttactttttgtggagacagggttttgccatgttgcccaggctggtctcaaactcctaggctcaagtgatccatgcgccttagccgcccagagtgctgggattacaggcatgagccgctgcgcccagcccagatggactatttgtattaaacgtttcctggcaacttgcaatagcttaagccggtaatcccagcgttttggacggctgaagcaggaggattgcttgagcccaggagtttgagaccgatctgggcaacatagtgagaccctgtttctacagaatatttaaaaaatgaggccagacacggtggctcacgcctgtaatcctagcactttaggaggccaaggcgggtggattgcctgagctcaggaattcaagatcagcctgggcaacacggtgaaaccctgtctctactaaaatacaaaaaattagtagggcacagcggtgtgcacctgtaatcccagctgcttgggaagccgagacaggagaatcacttgaacccgggaggcggaggttgctgtgagccaagatcgtgccactgcactccagcctgggtggcagggtgagactccatctcaaaaaaaaaaaaaaaaaaaaagcctggggtgggtggtgcgcatcagtagtcctaaactactctggatgctgaggcgagaggatcccttaagcctgggagatcgaggctgcggtgaactttgactttgccactgcacttcacagagccaagaccctgtctttaaagaataaaatagaataaaagtttgcttatgtacatttatttttctgccttcagtctctcccagcttttcttttctttctttttttttttttaagatggactctcgctatatcgcccaggctggagtgcagtggcacaatcttggctcattgcaacctccatctcccgtgttcaagcaattctgcctcagcctcctgagtagctgggattacagatgcatgctgccacacccggctaatttttgtgttttaagtacagacagggtttcaccacgttgatcaggctggtcttgaactcctgaccttgtgatccgcccacctcagcctcccaaagtgctgggattacaggcgtgagccaccacgcccagcctctcccagcttttctagtcaaccctaatggtgccatgccactggatttaattttaaaaatacaatgttacatcattctctgttaggttttccagtgcctatggggataaagtcaaaacctttatactgttgttcttgtgtccggaattggtgggttcttggtctcactgacttcaagaatgaagccacggacccttgcggtgagtgttaacagttcttaaaggcggcgtgtccggagtttgttccttctgatgttcggttgtgttcggagtttcttccttctggtgggttcgtggtctcgctggctcaggagtgaagctgcagaccttcgcggtgagtgttacagctcttaaggcggcgcgtctggagttgttcgttcctcccggtgggttcgtggtttcgctggcttcaggagtgaagctgcagacctttgcggtgagtgttacagctcataaaggcagtgtggacccaaagagtgagcagtagcaagatttattgcaaagagcaaaagaacaaagcttccacagtgtggaaggggacccgagtgggttgccactgctggctcaggcagcctgtttttattctcttatctggccccacgcacatcctgctgattggtccattttacagagagctgattggtctgttttacagagagttgattggtccgttttgacagggtgctgattggtgcgtttacaatccctgagctagacacaaaagttctccatgttctctagattagctagatacagagtgtcgattgctgtatttacaaaccctgagctagacacagagtgctgattggtgcatttacaaaccttgagctagataaagagtgccgattggtgcattcacaatcccttagctagacataaaggttctccaagtccccactagactcaggagcccagctggcctcacccagtggatctcgcaccggggccacaggtggagctgcccgccagtcctgcgccatgcgcctgcactcctcagcccttgggcagtcgatggaactgggtgccgtggagcaggggacaatgctcaggccacgcaggagcccacggcaggggggcaggactcaggcatggcgggctgcaggtcccgagccctgccccgtggggaggcagctaaggcctggtgagaaattgagcgcagcgctggtgggccagcactgctgggggacccggccgcatcctccgcagctgctggcctgggtgctaagcccctcactgcccagggccagcagggccagtcggccgctcagagtgctgagcccgccaagcccacgcccacctggaaatctagctggcctgcaaacgccgtgcgcagccccggttcccacccgtgcctctcccttcacacctccctgcaggctgagggagctggctccggcctcggccatcccaggaaggggctcccacagtgcagcggtgggctgaagggctcctcaagtgtggccagaatgggcactgaggccgaggaggcaccaagagtgagcaagggctgtgagggctgccagcacgctgtcacctctcattctgacctacctttcctgacctatttcctgttaagtcacagatacacacttgcattcctacacatacctcagactttcagtctccctcaaaccttcagcaatacaaaattgcttgctatttagttgtttcatctgtctggaataagcccttatcttttttctttacctttcgaaacctacttgtcctaaaataccacccctggtaagcctttcttgaagccaaagtttccttctgtttttcattgtcagacttcatgagagcagttatcttactattgataattgtacatatgtccttctactcctggtagattaaactccttgagggctcatattcatttttttctctttagcaccttgtagggttccttgaatgtagaagccttagtaatttaaagcacaccaaaaaagtctttgataggtatctaattttgaggagctgctgctaaaagtgctcttaggacataggtttagggcaggcttccgttacttttagcaaatgtgtgattatggatttttctagtgattagaaatgtaggaccagctagtctatgtactcttttctctcagttaactatgggtgtcttgcttttaggtttctttgtttcaagtgaagcatcttacttggttttgtcatacccaattttgggttgtctgatgctgttgcttctcagcgagctgataataaaacattttatgctttttcttaaatcactgtagtgacttagtttttgttgtatagaatatagcacagtttttgcctcctattagacattcagttatttccagtttcttgatagtgtacatgtgtgagaattttgagtgtatatctctgaaagtgatacatactgagtggtcattgagtgttggatgaaattttaggtgtttatattgttaggtgctttctttccatctgcccataggcactgtgaatgtgagtcattgaaagcagagttctttctcactgatcttccattccccattgcttagcaccattgcctgctaagcaggagatacttgttttcctgaatgagtttaaggatattcctaagctctagagagctcatccccaaccattgtgaaagtttcatcctgattctgggactaggaagagttgaatatattgataaaggtggcctccaggtaaagttggatttctgttgcatgtaagtgttaataatgtagtcaggtcttgaattaggatgatggaatgtccaagcccaaaactgggaaacaagatagtgggaaggtaattttttttttttttctgtagttttcccttttgaagatctcactggcatctatttagtatatatgacatcatctgtggttcaattctttagtgtaactttacattttttatttattcacatatttactgaatgctacctatgttaataaaatggacatgatccttgctgttatggaataaattatggctcagtaaggcagtgagaaattgaacagctaataagtgtgtttgttgactttaagtaaggggacctatggaagttgggtattctagcctcagggaaagagtttcttgggaataaccggtaactgatacttacaggataaattagaatgaccatgatcaactctgtatacgtatagatagttaataatcattttacaatgaataatggaaaaacattttattgtttttttctatgtatatatgtttttatttattagagactaggtctcagtttgttgcccaggctggagtgcagtggtatgatcatagctcactgtaaccctgaactccagggctcaagtgattctcctgcctcagccttccgagtagctagtactacaggtagacaccactgtgcccagttaattatttttaaattatttgtagagactgagttttgccatgttacccaggctggtcttgaactcctggcctcaagtgattttcctgccttggctttctaaaatgctgagattacaggcctgagcccctgcctggccaacttctgtttttctttttttcttttcctgatggactgtcctacgactgtttttatttttttaaccaaaactgcgtcataacctcttcttggtttaagggaggctaggaaatcttctttagttgagcacagtactcctcaattaaaatgagagtttctttagtagggaagaaggaaaaaagaaagttgattagacaactagccatgtagagggtagaggggcaagaatgaactcaggatcatttaggaaacctttttaggtagcttaggcaagaaattattgtagtatggggctagagttgaatagggagccgaagagaagttataagtatttgggagaccctctgtcacccaggctggagtgcagtggctcaatcacagctcactgcggcctcaaactcctggtcttaagtgatcttcctacctcagtctcctgagtagctgggactacaggcacgtgccaccacgccctgctaattttcatatttttttttgtagagatggggtttcaccgtgttgcccaggctggtcttgaactcctgggctcaagcaatctacctgcctcggcctcccacagtgctgggattacaggcatgagacaccatacccagtcaacttttaactttttatcaataaaattttgaagagaaaagtcgaaaggacagtacacttgtatccccactagctaagatcatgttgctctcatgaatataattcactaccaaaaacttgagcatgcatctcttaaaaataatattcttttggttgggcatggtggctcactctggtaatccttgcactttaggaggctgaggcaggaggataagttgagcccaggagtttgagaccagtctggacaacatgacaaaagcccgtctcgacaaaaatagaaaaaaatagttgggtgtggtggcatgtggctgtggtcccagctgcttgggcagccgaggtcggaggattgcttgagcccagtaggtacagtgccatgatcatggctcactgcagcctctgcagtccggcctaggtgacagagtaagaccctgtctccaaaaaaaaccccaaacttctatttttcagttgacttaaaaaaaagtcttatctacgtaacgttcacagattgtatataattgtattcttgggtcttttacaatttatgattgttaaccccttcacatacctttctttttttctcatctcattaatactgaaaatcctgatgtctgtgattcctagtttaggtgtaaaggtttgattagcttcaggttaaacattttggtaagaagatcccaagtgatgttgtatacttcatattgaatcatattagtacatgtgtaatatcagattttcttactgttattgatgcttggtcacttgtttaatcatttgattaaggtgggaactacaagatttctttgtaaaggtacattttatgctctttgcaattagcaagtaaaggatggattacttctttggcatcctggaaataatcttattcccaaaatccttttaccaggtgcactcacacacacccccactctcactcatgctggtacagtttaaccatgccagttaatctagcatgtttatctttggaatttgggaagaaacctgagtacccggagaaaacccacaaagacgtggggagaacatggcaagctccacataagacagcagcccgtgtgggatttttttttcctcataaatgttataaggaaatgatgttatccaaggacctgctgtattctctttttctctcttttttttttttttgagatggagtctccctctgtcacctaagctggagtgcagtggcatgatctcggctcactgcaaccttcgcctcccaggttcaagtgattctcctgcctcagccccccaagtatctgggattacaggcgcgcaccaccacacccggctaatttagtagagatggaatttcaccatgttggccaggctggtctcaaactcctgacctcaggtgatccactcacctctcttttttctttaattttttttttttgagacagtgtctcactgtcacccagactggagtgcagtggtacaacttcagctcactgcaccccctgccttccagactccaggaatcctcccacctcagcctcctgagtagctgggactacaggtatatgccaccacacctagataattttttttttttttaagtagagacaggatttcactatattgcccaggctggtctcgaactaagctcaagcaatccacctgcctcgacctcccaaagtgctgagattacatgcatgagccatgagccattgtacccagccctgctgtcttctcttttttttttttttttttttccttcagactgagtctcgccctgttgcccgggctggagtgcagtggcacgatctctgctcactgcaagctctgcctcccaggttcatgccattctgctgcctcagcctcccgagtagctgggactacaggcatccaccaccacgccctgctaattttttgtatttttagtagaaacagtgtttcactgtgttagccagggtggtctcaatctcctgacctcctgatccgcctgcctcggcctccgaaagtgctaggattacaggcgtgagccactgcacgtggcctgtctgctcttaaagagattaataaattagagggaaaactcagaatgtctttgtaatttaaatttttgttaagggaaaataataacatttaaaataattgtttctctgtgttaataatgggtactgtacaattaatttccttttttaaaaaatatattttttgagacagagtttctctcttgttgcgcagggtggagtgcaatggcacaatcgcggcttattgctacctctgcctccggggttcaagcgattctcctgcctcagcctcccaggtagctgggactacaggcacacaccaccacacccatctggtttttttgtatttagtagagatgggatttcaccatgttggtcaggctggtctcgaactcctgaccttaggtgatccacccgcctcagcctcccaaagtactgggattacaggcatgagccaccatgcccagtccttttttaattttttttttttttttaattgttgtcaccaggctggagtacggtggcacaatcatggcttactacaacctggaactcctgggctcaagtgatcctccaacctcagcctcccaagtagctgagactataggcacgcaccaccacacctggctaatttttgtggtatttttgtagaggtggggttttgctgtgttgactaggctagtctcaaactcctgggtgaatcctcctgccttggcttcccaaagtgctgggattacaggtattagccactgcacccagcccaaactgtatttttttgtcttctagtacaccttgtaattttttattgaaagctgggcatgggccgggcatggtggctcatgcctgtaatcctagcactttgggaggctgaggcaggtggattgcctgagttcaggagttcaaaatcagcctgggcaacatggtaaaaccccgtctctgcaaaaaaaaaaaaaaaaaaaaaaaaaaatacaaaaattagctaggcatggtaagtgcatgcctgtaggcccagctacttgggggggctgaggcaggaggatcactttagccccggaggcaaaagttgcaatgagctgagatggcgccactgcccttcagcctgggggacagagtgagaccctgtttcaaaaaaaaaaaaaaatgctgggcatgttttactaggtaaaagtaactgagatacataagcctttagtgtgaggcattacgtttatctgacttaggattgggctgtgttttgtattaacattttttgtagctgtaggtgtgagaactaatatttcctccagtgttcttatttttgtttactttgttgtcttggggttccttagagacttcttaaataagatctgagacatgcagttatatatttttcttttttagttttttaattccttgcaagtattgcacaaatgcagttctttgagtaacgtcctgttgttatacaaaagccttcgtggccaggcatggtggctgacaattgtaatcccagcactttgggagtccaaggcagacagattgctttagcccaagaatttgagatttgtagacaaatggagacatggcgaaccgtctctacagaaaatacaaatattaaccaggcatggtgtcatgcacctgtactcacagctactcaggaggctgaggtaggatcatctgaacccgggaggcagtttgcagtgagccatgatcatgccactgcactccagcctgggtgacagagcaagaccctgtctcaaaaaaaaaaaaaaaaaaaaaaaaaaaaacacctcttgatagtaaggtttcagtattctgttgtagtcttttagtgaatctgtgtacctgggctgtgatattcacagttgcttctcagttcacacttcctccttagttgagattggaaggctgggattgggtttttcacttcccttgggtcagttagctctgataaaactccagttggttaacctctggtgaaatcttttctcttgaaggcaggcctttttaaaaagaacagattactttggaattacttcagaatggctactttcccccttccccctgccagaagcatgcagggaattttcttccatcctcactgtgagaacctcctgcgttcaagtgaccctcctgcttcagcctcctgagtatctgggactacaggtgcacaccaccatacctggctaatttttgtatttttagtagagagcaggttttgccatgttgcccaggttggtcttgaactcctgggctcaagcagtctgtccaccttggccttccaaagtgttgggattacaggcatgtaccaccacacttggcctttttttttaaaatagtattgtaaatatttgggtttttaaaataaaacatttattctcagagttgtggaggctagaagttggaaatcaaggtgtcagcagggtcagattgcctctgaaacctctggggaatccttccttgcctcttcctagtttctgttggtttgccagcgtttttggtgttccttggcttgtagatgcatcaccccaataatctgtctttatgtggcatcctccctatatgtctgtcttaacatgttgaccaggctggtctcgaactcctgacctcaggtgttctacctgccttggcctcccaaagtgctgggattacaggcgtgagccatcgtgcctggcctgtttttactttttaactttctgctaaaatttttaaacttgtactgaagttgagaaaatagcataatagatatcatcacccagttgctttttctttttcttttttgtagagacggagatctcactttgctgcccaggctggtcttgaactcctgggcttaaacaatcctcctgcctcagtctcccaaagtgctgggattacaggtgtgagccaccactcctcctggcctccactttcggtagttatgaacatgtggctagtttgtctgtcagattcccactcccttctagattattttgctgtttgtttgtttgttgtttgagatggagtctcactgtctcccaggctggagtgcaatggtgcgatctcggcttactgcaacctctgcctcctgggctcagacgattctcctccctcagcctcctgagtagctgggactacaggcgtgcaccaccacacctggctaattttttgtgtttttagtagagacagggtttcaccatgttggttaggctggtctcaaactcttgacctcaggtgatctacccacctcagcctcccaaagtgttaggattaccagcgtgagccaatgtacctgtccccttctagattattttgaaacaaatcttctgagttattttgcagcaaaccccagaattctgtcattgtacagtgaataattcattgtggatctttaacatacaaggacatttttatgaaaccaaatcaattgtcttattatgtccaacaaaagaaacactaatttttgaatatgtaatgacacagtacatgctcaggtttccttgacttctgacttacctttttacagttacattattcttcttaatggttgtaatcatttagtttactttctagtccttttatgtcacaagcagtcttagagtacaaatgttatatcacatacagaggattgtattgtgtaggaaaaacatggacaacaaagactgaattgaaaaggtgatactggagagtaggacttgatgtgaagaagtttgaggagtagctttgactgtttttcttttctctttaataatcttaaaggtttcttatggggggagcgctgagacaggatacaccacagtcacccaggcaggagtgccagtggtaagatcacggctctctgcagcctgggattcctgggctcaggtgattttcccacttcagcctcccgcattgctgggactatggccatgcaccaccacacccacacctacctaatttttttgtagagacagggtttcaccatgttgtctggactgatcttttttttttttttccataaggatagagatgggctggtcttgaactcctgggttcaaatgatcagcccatctccaccacccaaagagctgggattacaggtgtgagccactgtgcctggcctaatcttaggattgaagtatataaattctaaaagttgagtaagtgtataataaaaactgagtgataaagtattgtgtcatggtgtaaatggcagtgtttttttcttactggcatacattgagatgtcctctaactgaaatcttagaagtgagccgggtgcagtggctcacgcctgtaatcccagcactttgggaggctgaggcaggcagatcataaggtcaggagttcgagaccagcctggccaatgtggtgaaaccctgtgtctactaaaaaatatgtaagaaattagccaggcgtggtgctgtgcgcctgtagtcccagctactcaggaggttgagacagaagaatcgcttcaacccgggtggtggaggttgcagtgagccgagattgccccactgcatttcagcctgggcgacagagcaagacaccatctcaaaaaaaaaaataagtaaaagaaaagctctgtcttgactcttgaatcagttttaaaacctggcttcactgattattagctttgtgactttgttgcctcagcttccttattggtaagcacgtaagtttgttttaagattgagttattacatgtacatcagttaaaatattgcctgtaaattatatatagatattgagctgggagtggtggtttacgcctctaatcccaacagtttgggagactgaggcgggagaattgccttagctcagaggtttgaggcagcggtgagctatgattgtaccactgtacctcctgtctggatgataaagcgatgtattaggtattattgttgatcgttcagcaacattacccactgtttccttgaaatattattcctgtagtgtcagtgatatcagactatccaaatatctttttcttcctttcttctttcctttctttccttttccctttccctccccttcctcctgcctttccttttttccttttttcttttttttcttttgagacagagtctcgctctgtcccccaggtggggagtgcagttgtgcgatctcggctcactgcaagctccgcctcctgggttcacgccattctcctgcctcagcctccggagtagctgggactataggcgcccgccaccacgcccggctagtaggttttttttgttttttttgtttttttttttttgtatttttagtagagacggggtttcactgtgttagccaggatggtctccatcttttgacctcgtgatccacccgcctcggcctcccaaagtgctgggattacaggcgtgagccaccgcgcacagccccccaccttttttttttttttttaaggagtcttactttgtcgcccaagctggagtactgtgcttctgtctcggcttactgctccctccgtgtcttggattcaagcagttctcctgcctcagcctccagagtagctgggattacaggcacgcaccaccatgcccccagctaatttttgtatttttagtagaggcggggtttcaccatgttggccaggctagtctcgaactcttgaccttagatgatccgcccaccttgacctctcaaagtgttggtattacaggcgtgagccatggcgcccggtctttcctatctttctgactgtatcttcagatcactcctgaacccgagacctgaatttttcatttacctacttggttctttggattttcacagataccttgtatccaacatgtctcaaactgatttttcccctctccctcaaaccctgacttctcaattctttgtttccttatctttattatactgtcatccacccagcaaaaaatcccctcttctaagatcatagcttttagttagtaactaagtcctttagattttacttcctgtctgccttaattcatcttcttttcattgcactggactttattggcatctctcactggtttcctaagtattctctctaatccccctccagccatttccccctactccagccaggtgatctctaagagacccagatctgattgttacaacacttcaaatttttattattcttcatgaccctgaataatctggcttttgactgcttctcctgcctcatttcatcattttcattctttgtattgtagtcacattggcggcatttcaattcctaaacctgtcaagtcctcgtttgcctccattttgcacagcgtgtacgctctgccttaagtgctggcttttcctaaagttaagtcttttaaaactaatttcctcaaggaagcttcctcttactttctagattttctgtctgctaaatgttcttcatagtatcctgtacttcatttaaaaattatataattagttcttcagtaccttagaatgaaataactattgatacaggttagagaaaatttctagttgatcattatactaccaatatctgttataatgccttgcaaatagcaagtacttagtaaatattcatggaattgataaattcagacttgaattactcttcattgtagattgagtaaagtttgacagaagtccagaacttaacttttttttttaagagatggagtctcactctgtcacacaggctggtgtgtagtggcacagtcatagcttactgcacccttgacctcttgggctcaagtgattctcccacttcaacttcctgaatagctgggattacagacacacgttttttgttttttttgttttttttccacgctgtagagatgggagtttcactatatggcccaggcgggtcttaagctcctgggctcaagtgatcctccctcctttgccccacaaagtgttgggattacaggtgtgatttaaaaaatgctagctgcagcctggtgtggtggcttagcctgtaatcccagcactttgggaggctgaggctggtagatcttgaggtcaggagttcaagaccagcctggccaacatggtgaaaccccatctctaccaaaaattcagcaattagccgggcatggtggtgggcgcctataattgcagctactcaggaggctaaggcagaaggatcgcttgaacccccaagaggtggagtttgcagtgagctgagattgcgccactgcactccagcctgggcaacagagtgagactccgtctcaaaaaataataataataataattgctagctgctatagcttctttttttttttttttttttgagacagagtctcactctgttgtccggtggagtgcagtggcgtgatctctgctcactgcaacctccgcctctcgggttcaagcagttctcctgccttagaatttcaagtagctgggatttacaggagtgtgccactatgtccagtctcttgtactatttttatcttttattttcaagacagagtcttgctttgtcgcccaggctagagtgcagtggcacgatctcaactcactgcaacctctgcctcccgggttcaagcgattctcctgcctcagctggtctcgaactcctgacgtcaggtgatccgcctgcctcagcctcccaaagtgctgggattacaggcatgagccacggcgcccggccatcttgtactcttttcaatgtggatatcagaaaattttaaatttacatagtggcttacattatattgtattggatactgctcgtctagaacttgtttttagtaaggatcatacatgtgtctccatggcctcagtttttcattattctcccaatccctttgttttcatgtcacttctgctttgggactgttatgtgccataagcttcagaaaacacggtggctcacacctgtaatcccagcactttgggaagccgaggcaggtggatcaccagaggtcaggagtttgagaccaccctggccaacatgatgaaaccttgtctctagtacaaatacaaaaaaattagccaggcgtggtggcgggcgcctgtaatcccagctacttgggaggctgaggcaggagaattccttgaacccaggagtcagaggttgcagtgagctgggcaacacagcaagactccatctcaaaaaaataaaaaaaaaatttaactgcctagaaggtagaaatcgagtgtatttcttaggcctttgaataataggggaaagataagtcatttatattaaattatgagaaaataatggcaactgttaagcttttaaagtattatttccaactaaattaggaagaactaaatttcacttttacatatgcatgacaatgatgagcagggctcctaaaacagttgtggcttgactaggaaacaaataataatttttttatatcaataagaattacttgtaactttagggggcatttagaattatatttgtcttatttgagatttggatttaaattttattttagagcattttttaaaaaataaatagaagtgaggctaatattgttaattattctctttaaaaaatacagtatttgctttgggttaaaattttctgccccaacatcattatcaagagtcagcatattacaatgataaatttagcatttactgtgtggcaggcattgttctatatactttattcgttaaattcaccagcgaaccctatgaggaactatcttatccttagttgacagaggatgaaactggagtacaaagtagttaattaacttgttcatagctagtaagttttaaaaaggttaaacaacaatatactttgtatttagtccttaaatgataaaatcttccagtgtttagtttttcccactagaatgtaagctccaagtgggcagggacttaggttttgttcactaacatttgagatagcatatactagaacctagtcattatttgaaagaatttttacagtgatgatggtaacaatgacaatatcatttcactgagagatggccttggaaatacattagaaccgctttgagttcttcactgttggttgttgacaataatgttttttttatctcattcaaattagcttcaacgttatgtgctattttgcatgcttcatgtatatcttaataaaatagttgatttgaaaattgctaacttctatagcttcttccctcttttttttttttttttttttggtgacagagtcttgcttcgtagcccaggctggagtgcagtggtgtgatcttggttcactgcaacctctgcctcccgggttcaagcaattctcatgcctcagcctcctgagtagctgggattacagacatgtgctaccatgcccagttaatttttgtatttgtagtagagacagggttttgccatatgggccaggctggtctcaagtttcttgcctcaaatgattcatctgcctcggcctcctagagtactggaattacaggggtgaaacatcctgcctggcctagctgctatagcttttatatatctctgttccttttgtgcattagaaatgccttgaagcccccagggaacatcaggaaaaaaaaaaaaaaaaaaaaaaacaaccagaggtcccgctatgtgtttagctgagttgggagaagaaagtttagaaaagcaatctttgacctatccttatgaaaaatttacagtgataacacaattcttcagaatttcacccaaaagctacagctgccttggttgttgcagtcattgaagtgaataacacattattttattatttatttttagatactacatttttttcttagactgtggaaacaggactgtgaaattaattttgtaaaatcgggctttaatttttttttttttttttttgagacagaatctcggtctatcatccaggctgcatgtagtggtgcaatctcggctcactgcaacctccacctcccaagttcaagccattcttctgcctcagtctcccgagtagctgggactacaggtgcctgtcagcacacctggctaatttttgtatttttagtagagatggggtttcaccatgttggccaagctagtctcaaactcctgacctcaaatgatccacccgccttggcctcccaaagtgttgggattacagtcgtgagccactgcacccagccaaattaaaggttttatagttaatgttgttagggaaaggggaactatgctgcttacttctatccaagaaacttaattctgaaagtattctcattttacagtaataaaattgagagttaggtgttaagtgttatacctgaatgaataccacaagtaagcgacagaactaggattcagcacacatatgtcttactccaaaggccatgacttttgtaatactgtcatctttcaccattctccatgtcttgcttatagttcctgactcttaaagtaagactttaagttcgcttgtgggagcagggggattggagttttagattgtgaaataactggatgtttgaattaaactgtggtggtataaagaataattgttgcttgatggaaaattgagctgtgaaaaatttttggcttaactttgttttctttttatctttagttctgtgcaaataaagaccctattctaagccctctagaattttttttttttttttttgagacagagtctcactgtgttacccaaactggagtgcaatggcgaaatctcggctcactccaacctccacaccctggattcaaacgattctcgtgcctcaacctcccaagtagcggggactacaggcacacaccaccatgcccggctaatttttccggatttcaccatgttggcctcaaactcttgactcagtgatctgccttggcctcccaaactgttgggattacaggcacgagccaccgcatgcacctgaccagaatgctttttcataatgtaattcatcatgatgatggtattttcttgagcttatttagtacattttttcatacaataataatgttctttctatagagtgaaaaaaagagcaatttttttctgacttataatttgggggctggatgcggtacctcacacctgtaatcgcagcacttttggaggccaaggcaggaggccaaaggtggtggatcacttgagcccaggagttcaagaccagcctgagaaacatggcaaaaccccctctctactaaaaatttaaaactttagccaggcatggtggtgcacacctctcgtcccagcgactggttaggccgaggtgggagaatcacctgagcttgggaagttgaggtgcagtgagctgagatcgcactgctgcattccagccagggtgatgggagtgagaccgtgtcttaaacaaataataataatttgggggtgatgtagacagaaataaggacagaggtatgaaaaggaataattatttagcattttactagccagagatttgggcagtcccaaaaagcagcttttctaatctccctctcctttcccaaaaaactttaatcagatcctttagtatcctatcatctttgggttatttacatactactttttggaggggggattgtggaaagctatcgagatctttgaaagcattgatgattagcaagatgattattcctgtaagaagccttaagaggagaaatgcaagtgtaagttaacactggcttcttaaattggtcagtgaaagttggatgcctccaattttcttttaacattatgcatagatactagacaattttttatttttatttatttatttattttgagatggagtctcgctctttcacccaggccatagtgcagtggcacgatcttggctcattgcaacctccgtctccctggttcaagtgattctcctgcctcagcttcccgagtagcaggactacaggtgtgcaccaccatgcccaactaaatttttgtgtttttggtttttttgagacggagtctcgttctgtcacccaggctggagtgcagtggcgtgatctcggctcactgcaagctccgcctcctggtttcacaccattctcctgcctcagcctcccgagtagctgggactgcaggtgcccgccaccacacctggctaatttttttgtatttttagtagagacagggtttcaccgtgttagccaggatggtctcgatctcctgacctcgtgatctgcccgcctcagcctcccaaagtgctgggattacaggcatgagccaccgcgcccggccatcagagtagttttactgttgctaaaatgtacattttctcctctaccacaaataccaaagttgttaatgattttttagggcataagaagtagtttcttattgtacatatttatagttaaatttagtttttggataaaaaatattttcagaaaaatgtaaaaaaaagtactaattagaaagtaagtttttaaatcctatgtttttattaaaaaacaggattaatttggagtgatgtgaactttgaaaaatatgggttttaagtcatgtattgtttatgaactaaacgttctgtactaaaaaatatttaacatagaaaaagagtaaaaattgtggtttttttttttgggttggaggaggaagccaaagacagtaattcttacactgtttcatctagtaatcaagtttaagaaagtcagtctaaaagcaaaaaacataagagtagatatgttgtgtcaatcaggtaacaatatggaattctaaccaaaaaaaatgaagatataggccgggcacggtgcctcacgtctataatcccagcactttgggaggccaaggcgggcgtatcgcgaggtcaggagttcgagacaagcctggccaacgtggcgaaaccccgtcttgactaaaaataacaaaaattagctgagcatggtagtgggtgcctgtaatcccagctactcaggaggctgaagcaggagagtcacttgaacccaggaggtggaggttgcagtgagccgagatcgtgccatcgcactccagcctgggcagcaagagcaagactccgtctcaaaaaaaggaagatgtaacctgttctttagggattttggtttaaaaaatcgagaggatttactgtatttttaacataggtttgagaatataagtggagagcccatttgctggcaggcacttacgaatgttaatgtgagtcccactggatggttttctgaatcatttaaggttatcatggctctgagaatggactgtcataaggttaagagactcagtaatgctatagataggaaagtacttggagtagtttaaagtgcaaaataagtcaatgtagataaatttaaagtagaaatctggttttttgaagtaggtagttgccgttttaataaactaagcagaaaaacaaattgaagaaggccttttcttttgaggcatttagtcctctggaatttttcatggaaaggagaatctgttaggtagctagagctttcaccattctggtggatagtgtactatttcagtcagttaaactaaacatttaaagttgttatggttagttcaagtgagagtttatggcctaaatggcttttaatgaccctgaattttctgtttaagcagaacccatgtatcgtgggggtatagtgcagaatataatatcttagtgttcatctgtggatgattagatttatcgctttgggcctgatatacatggaattggcaaacataaaatagcttttatactatttttccctaataacattcctagaaagtcaagaagccattgtattgttgttcatagtggtgttatttcgtttaaaacaatgaagttagaatttattagtttgttttaaatattcttaaaactggataattaagtcctagaaaagccgagacttattttactagagcagataatcaagcttatgaaagagggggtttcaagattttttataggtaatactttaggcgtttttcttgctgacataactaacatttattttctgtttatttttaagacgagcaaaaatcaaattaaagtagatcttgtagatgagaattttacagaattaagaggagaaatagcaggacctccagacacaccatatgaaggcaagtacttttttctgtatcaaaatattgtgcgtattagaacttgtctgaaacatttaatcagaataatcttaaacatctataaattatatggagggtaacttcatttggtttagataaacagcaatttaaaaaatactaaatttagatactgaatatagactggtatttcttactgaattttagctaatttttttctttccataaaacagttttagcagagctttgttacaggtattataggttagaatttaatagaataaaagatctggcatggtaaacctctaaatcatatggactgtagacactcagttacccttcatatggtatctaaaacagaccttgccttaaatatctcattggtaaaatgttgcttttgtttttaaagttcttctttctgtcattcagcatttcattcactcatgtcttcatacaggctgtagtccaaatgtttattttctttattcaggaaagcttttagtgattatttcaagccatagaaaggaggtggctttgctgaacttggtgttcacaaattaagtctgtagctactttagaccatggaatcgggtggtaagatacagaaataaaccttatagcattttactttcttattaggtgagtcttcattaattaatattactgtaaatttagattatatagcatataaccaaggctcttgcattaataactattcaaatatttgtttattagaaaacatataacaatatatggtaaccctaattatacagtctttacatgtattttctcatttaatcctttcagcaaatcttactaggtaaatacaacgattgctgtttcatagatgaagaaacaagttaagagaagtaacttgtttaaggtcaaccatctaagtagcacaactgatagcctttgtcttcaaagcctgtgcttttaatcactttatgtaaatcagaattgacttaatattggaagtggtggtgatgtctgttttgttttatctatttttttatatgcaaagttttactgttacccaagctggagagcagtggcatggtcatagctcattataaatttgaattcctaggctcaggtaatcctccagcttcctcagtagctagtactacaggtgcatgccaccatatccagttaaatactttgtgtgtgttttttgttgttcattttttgattgtttgttttttgagactgagtctctctgtcacccagcctggagtgcggtggtgaaatcttggctcactgcatcctccatctcccagaatcaagtgattctcctgccttagcctcctgagtagctgggattacaggcgcaccaccatgccggctaatttttgtatttttagtagagacagggtttcacaataacggccaggctggtcttgaacttctgaccttaggtgatccgcctgtcttggcctcccaaagtgttaggattacaggcgtgagccaccaatcccggccaccagctaaatactttcgagtggttctataattctgtaatgaacagttacccaaaacacttttttttttttgagatggagtctcgctctgttgcccagcctggagtgcagtggcgcgatctcggctcactgcaagcttcgcctcctggattcacgccattctcctgcctcagccttccgagcagctgggactacgggcacccgccaccatgcccggctaattttttttgtatttttttagtagagacggtgtttcaccgtgttagccagaatggtctcgatctcctgacctcgtgatctgccagcctcggcctcccaaagtgctggggttacaggagtgagccaccgtgcccggctacccaaaacactttttaaaaatctaatattcttgaatattttcttgtttttaatccagattttttaagaccctagaatgtctttagcatattataccaattctgtttattcattttttttttttttttttttgggagacagagtcttgctctgtctctcacgctggagtgcagtggtacgatcttggctcactgcaacctccgcctcccgggttcaagcaattctcctgcctcagcctcccgagtagctggtactacaggcgcccgccaccatgcccggctaatttttgtatttttagtagaggcggggtttcaccatattggccaggcttgtcttgaactcctgaccttgtgatctgcccacctcagcctcccaaagtgctgagattacaggcgtgagccaccgcaccgcacccagcccatttttttctttctttattggagagatggcatcttgccaagttaccgaggctggtctcaaacccctggcctaaaacaatcctcttgccttggtgtcccaaagtcttgggattctaggcatgagccattgtgcccaaccttgtaccaattcttaagtgataaaattttattttttgttttatagttcatacgagccatttctagatatttaattttttatgctgtttatcgagtgcttcctatctgcttggcttggtctggcagttttcatggatgctgtttcatttagtcctttttgcaatcattaaatgtagaggagacctttagttatctttaaaaaatcagatgcttgtcctaatagcagatgtttttatataataatatactagcttcttcttgaagtcagaccttatagttattcttgaatttttttttaggttgttttgaagtatttttggaagatagtagggcagtgacattattctagaggtctgtcagcaaagttttaaattttttcattgatttttataaacaaggcacttcctgagctaaattagatagaagcaatatttaataggtagattaatttttttaattggataatgtatacttatatacattaagatatattaagatacactaattagccgggcgaggtggtgggcgcctgtggtcccagctactcgggaggctgaggcaggagaatggcgtgaaccccgggaggcggagccttcagtgagcccagatcgcgctgctgcactccagcctgggcgacagcgagactctgtcccaaaaagaaaaaaaaaaagatacattaagatatattcttatggccgagtgcggtggctcacacctgtaatcccagcactttgggaggctgaggcgggcagatcacgaggtcaggagatcgagaccgtcctggctaacacgatgaaaccccgtctctactaaaaatacaaaaaaattagccaggcgtgatggtgggcgcctgtagtcccagctacttgggaggctgaggcaggagaatggtgtgaacccgggaggcggagcttgcagtgagccgagattgtgccattgcactccagcctgggcaacagagcaagactccgtctcaaaaaaaaaaaaaaaaaaaagatatattctttattggttagaaacaagtttggtcattttttttcttttctttttcccgataccgagaatgggaccaaaagtttggtcatttaaaagtgcttatatctgcctgggcggggtggctgatgcctgtaatcccagcactttgggaggctgaagcaggtggatcacgaggtcaggagttcaagaccagcctgaccaacgtggtgaaactccatctctactaaaaatacaaaaattagctgggtgtggtggcgtgcgcctataatcccagctactcaggaggctgaggcaggagaatcccttgaatccatgagacggaggttgcagtgagctgagatcgcaccactgcactccagcctgggcgacagagggagactgcatctcaaaaaaaaaaagtgcttatttctgctgctgctgctgctaaatgaatattttgataagattagatttaatatgctttttatatatttgaggtagagtaacttgaattctgttattttatataaaactattgagagaagttcattttgttaaggaaaacaccattcaaggacataaactttaatgctttttcttttaaatgtgacgataggttaaatgtttattgcaaggatgttgcagttttttgagtttttaaaaatctaaacttaaatgctaaagcaaaagtttacatgtggaatgttaagcaatttataaccattattaagtaatgaggcagctgtttttgtagtatttaaagaatcagattgtgaagtagagtactcacgggaaaatgccatattgtggatgttacttaactcaattttcttcacttcttttgccttaataattcaatgacaaaggaacagtttagttcttgagcttttcttcctaaaatttcttttaggtttatggaatcattgttgacagcttaaaaattctcattccttcctcatctcctctttgggttaagttaaatttaaagattgttaatttttaatattaaaagctattcttcaagaagttaatgttttaaagtaaaaactattataatatgaataatatagttatcataaggattccttagttgtattaccctgatcaaataatgctatgattaatgctaagtggtcatatattgaaagttgtcagagcgtgtaacataagggatagaaataagattttagagactctcgagtccagcattatttatataatatctgtgggccctcacactgctcctaagagattattttggccattaacaaagaactttgtatgatgggttatagagatggtttaatctggagtttaatcagaaaaaaaaaattcttaggaaggaaaaagaaaagcctatgtagtgctgaagccaaatttattataactatatttgaagctggcatttctaattctgggtatagacagttattgtcacaaaatttcttcaggtacccttctcttacctgtcagttttttttttctttccactacttttctttaaatttcattattgttatatgttctgtgattcaggcatttagttcaactcatgcatgaatcactatgggattctattaaaaagaactagccacgaggcataacggctcatgcctgtaatcccattactttgggaggctgaggcgggtagattatttgaggtcaggagtttgagaccagcttagccagcatgctgagaccctgtctctacttaaaaaaaaattaaaaaattagccaggcatggtggcgcgcacctgtagtcccagctacccaggaggctgaggtaggagaattgctggaactgggaggtgaaggttgcagtcagccgagatcgcaccattgcactccagtctgggcaacagagtgagaatccgcctcaaataaaaagtagccagaagagaggccaggcgcaatggcttatgcctgtaatcccagcactttgggaggctgaggcaggcggatcacctgaggccagaagttcaagcccagcctgaccaacatggtgaaacctcatctctactaaaaatacaaaaattagctgggcattgtggtgggcacctgtaaacccagttactcaggagactgaggcacaagatttgctggaacctgaaaggtggaggttgcagtgagccaagattgtgcctctgcactccagcctgggcaacagaacgaccctgtctcaggaaaaaaaaaaaaagagaaggattcgaaacaaaaagggcttgaagaaaatagtaccacttttattttttcctcagattcatagtcatccatccattcataacaatggaggagtgaggagatacatttgagagagtctagaatatactgaagaaagtctcttgtttgactttttgaagagctgagtgtatagaattttgaagataatgttcctagcacacagttttttattttactttttattacagggaatttcagatatataaaaaagaagaataggccaggcgcagtggctcatgcctgtaatcccagctctttgggaggccgaggcgggtggatcacaaggtcaggagattgagaccatcctggctaacacggtgaaaccctgtctctactaaaaatacaaaaaaattagtcgggcgtggtgacgggcgcctgtagtcccagctaatcgggaggctgaggcaggagaatggcgtgaacccgggaggcggagcttgcagtgagccgagatcccgccactgcactccagcctgggcgacagagcgagactccgtctcaaaaaaaaaaaaaaagaatataatgaaacctcttcagccagctttaataactatcagctcacggccatctgtgatctaatttattctttgattatcttgaaacaaaatctcatagtcttataaataaatatttcaatagaacagttttatttactatattttgtaatagtattctatgttattaatcttagagttaagagttgaatccagcctctcatccagtgtaagacttaccccttcagtgttttcttttcttttttctcttttctgtttatttgagatagattcttgctctgtcacgtaggctggagtgcagtggtgcgaacttggctcattgcaatatccacctcctgggttcaagcgattcttgtgcctcaacctcctgagtagctgggatcgtaggcacatgccacaatacccggctaatttttgtattttaggtagaggtggggtttcgccatgtttgccaggctagtcttgaacttctggcgtcaagtgatctgcccacctcagcctcccaaagtgctgggattacaggcatgagccattgcacgcagcccagagtttcttaagaggcagttatcctttccttgagtaccccagttgtgagaagctagattgtgaagtggcacaatctgggctcactgcaagctccgcctcccaggttcacgccattcttctgcctcagcctcctgagtagctggggctacaggcgtccgccaccatgcccagctaattttttgtgtttttagtagagacggggtttcaccatgttagccaggatggtctcgatctcctgacctcgtgatccacctgcctcagcctcccaaagtgctggtattacaggcatgagccaccgcgccgagcctagataagctttttaaaaatgctgtatagctgctagttgctcaagataacttcaaaacgaaacaaaaagttgccttctgtttgtatattactggttagaaaagctccttggtaaaattttgcattttatatacccatttaaaggaataatttgggctgggcacagtggctcacgcctgtgatcccagcactttgggaggttgaggcaggtggatcacgaggtcaggagatcgagaccatcctggctaacatggtgaaaccctgtctgtactaaaaacacaaaaaaattagccaggcgtggtgatgggcgcctgtagtctcagctacttgggaggctgaggcaggagaatggcgtgaacccgggaggtggagcttgaagtgagccgagatcacgccactgcactccggcctgggcaacagagcgagactctgtctcaaaaaaaaaaaaaataaattaaataaaataaataaataaataaataaatgaaggaatagtttgtctttatgtctatctctcttgttgaattttgcttaaaaaataaaaaatatatttaaagttttttatattaaaatagagacaaggacttgctatattgagcaggctctactcaaactcctggcctagctttaagcagtcctcccacctcggcctcccaaagtgttgggattacaaggcattagccatggacccagcttgtttttattaggctagtgcaaaagtaattgcagtttaattgcacaaatattaacaaataagtattgacatttaatttagggcacaaatgaaaagattgggaccttatttcatttgcgagaaccagctagaagtagaattttgtttatggcataatctctgtcctttgtatcatctgtacttttatacctccttgccttcttttttttttctgacccttttgttgttgttgttatttagcaattcttaacaggatggattagaggacacagtggagattaaaactccaatagttaattgtcctgatgaaatgttggcattgcattgtctggattaaatgtatttatctctggccttgttactcactgataaactaatacagttgtatgaaatggatattctgtatgctttaaacaacctttaaattaaaaactagtgcttttgattactttctttctggatttcaactttaaaatgaatttttataattgaatataaaatagctgctctgaaaagctcatcagtatatttgtcttatatatttgaattgagcagcattcttaactttgttttccccatttttttaggaggaagataccaactagagataaaaataccagaaacatacccatttaatccccctaaggtattgtaagcctatttttgtgcatgaagttacaaaatattttatatttctgacctcattttattaatatatattttagggcttattaaagtcacagctttatgaattgcttactgtgtaaacttgatgtggacaggattttagataatggcaggtggctggcttctgaaattagaatgaaaagcaaactcacccaaaggcagccagtaatggctcaaaactggaataggatgtacatctgacaatggctcatatactagatctagaaatacgtggcagtgttcccaaatttagagagcccttttacacatagacagaggttcttacttgactcaaagaagtatgtgttttaggagagtaccttctacattcagtcattatttgagtactttgtgccaagaactatagcagtaactaagacttatactgttcctgctttcatagagctcacattatagtggggaaaaaaaactgagcatggaattgcaactgtgataaatgttgaaagggagtatggaataccctaagatcatgtataacagggggacccaacctaaacttatttttggattgaaccactttctttatgtctctgcttttactgtcatcagcactttaggcattcaactttattccctgttttgtctattatttaatcacccttccatcttttccatttctactcattctctgcactgttggtctagaaatcttcctagagttcagttttgatcatgctgcttttctttccctgaataaagtctaaactccatggcttggcacttgaaacctagaacctgaccccagtcttgtttcccactctaatcttctaccacttccacccacaatgtgggtctcattttccatcttagattgtttatttgtaggtgatgcttattcttccacagctttctatcagtttcacttaaatctttgtccctattatttaaaattctagttttctatgaggcccgagtatcactttcttcattaagctgagttcatcaaatgtttctccctctcctctctcagtagcattttatacaatttatatagtggcaacacaaatatagttccaactcatgtattattttggatatgtatctttctctagcttttatgctcctgagtcatataggtcttttacacctatatattatcagtaattcccaatagtatagtgtcccttgggcatatgatagcagtcactcagaatgttctagaatttgttcattcaacctattggttgttccagtttaagaatagatatgataatggaagttccagggtgattttggctcacttagcattatgggctgcctattagtctattgtttatgtacatctattttctgataagtctggtcgatttttttattgtgataaaatatgcatgacataaaatttaccattgtaatcatttttatgtgtgcagttcagtggcagtgtatttaccttgttgtttaacctttaccattatctgtctgtagaactttctcaccttcccaaactgaaacttcgtacccattaagcaataactccccattattccccgctcccagcttctggtaaccactgtttctgtttctccgagtttgattaattcagaaacctcatgtaagtggaatcataaaatgtcattttgtgtctggcttatatcacctagcataatgtcatcaaggttcattcatgttaaagcatgtgtcagaatttctttgtttttaaggctgaataatactccattataagtatagaccatattttgttttcttattcagctgttaatggatatttggattttgtttgtttgttttttgtttttttgagatggagtcttgctctgtctcccaggcaggagtgcagtggcacaatctcagctcactgcaagctctgcctcctgggttcacgccattctactgcctcagcctcccaagtagctgggactacaggcgtctgctacctcgcccggctaattttgttgttgttgttgttttcttttttttttttttgagatggagtctcgctctgccgcccaggctggagtacagtggcgcggtctcggctcactgcaacctctgtctcctgggttcaagcaattctcctgcctcagcctcctgagtagctgggattacaggcacccgccaccaagcccagctaatttttgtatttttagtagagatggcatttcaccatgttggccaggctggtcttgaactactgactccatctgaaaaaaagaaaagaaaaggaagtcatacacattaagtgggtgaattatgtctcagtaaaggtgtagcctttatagtgtataatagcttcaaagtaattgcatagttgtggctctgttttaggcagttcaacctgtaacttcatttaatttttgaaataaatattttattaaatctctcccacctcatccccacttttttttagagacagggtcttactctgttgctcagtctggagtttagtggcatgcacagtcatagcttagtgcagcctttaactcctggggtcaagtgatccctccaccttggcctcccaaagtgctgggattacaggcgtgaaccaccacatccactcccttgttttattaaagcgagaaaaatagactcaaaacataataactgaagtatgtctgatgtttttgctactacctcatcttgctattgaagccactgttacctggccaggcatggtggctcacgcctataatcccagcactttaggaagtcaaggcaggagaagcgtttgagctcgggagtttgagttcagcctggacaacatagcaaggccctgtctctagtcccaaaaaaaaaaaaaaagaaaaagaaaagcctctacatctctaattctagctgttccgtttggaggtagctttgacatttagaaacatcttcttaggttcaaccccaatttgtattactgtgacctcaaccaattagtcatagttgcagtttagtgttctttaaatacggtatatatgaaataaaatttttttaaataacaaaaaaaaataaagaacaaacaagaaaatgttatataccctacttgtggcattacgctcttgcagtaaatgttaatgaacatgataaatatgttctagatgtatactacgttgatttgaatttttactgattggtaaataaaatgagaagaatggggaatatttatgtaaatttcttgctgaattgtgtgttcacatgtgtttggactcaggcttaattttaagtcttatgaggtaaaattatcaaggtagctggttatattctcattactactgtgcagctaaaatttgagaaaagatgaaaaattcacatttgtcttaccatggtcacagaatgttttgtgtttattattatgcaataaattattgaccggaagagtaggcttacttctaaaacagagaaaatatatctttgaatcaggtgataatagtgtagaaggaatttgattaaatgcatacaaccaatatgatttctagcattaaattgcaatgtatattgtgttagtgaaaaaatcattagtaaaaatatagtccagtggtgtatcctgcttgaatagagcaggctggatgcggtggtttgctcgcctgtaatcccagcacctagggaggcagggggcaggcagatggcttgagctcagaagttcatgaccaaatggcaaaaacctgtctctactaaaaatgccaaaaactaaacaaaacaaaacaaaaaatactagtctggtatggtggcatgcgcctgtagtctcagctactcaggaggctaaggcacaagaattgcttgaacctggcaggcagaggttgcagtgagccgagatcatgccactgcactgcagcctggacaagagagtaagactctgtctcaaaaaaaaaaagaaattaagttgtgaattttgctctttttctttggtgttatcatcatactttttacatgttaagttgtatatacataccaatgctaataatctttaatgagcgtatgctcatctgtacatgcatattcaaaatagcattttcttttgtatgataagggagttaaagctggcttaataatataatatgctttgagaccctgtctcaaaaataaataaaaataagatacggccaggcgcggtggctcacgcctgtaatcccaggactctgggaggccgaggtgggtggatcaccagaggtcaggagttcaagactagcctggccgacatggtgaaaccccatctctactaaaaataattagccaggtgtagtggcacgtgcctgtaatcccagctactcagaaggctgaggcaggagaatcgcttgaacccaagaggcggaggttgcagtaagctaagatcgcaccactgcactccagcctggacgacagagtgagactccatctcaaaaaaaacaaaaacaaaaaaaagcaagaaacacacttcacatatcttcaggtcttaaaactggaagttacagatggaaatatgaactcacatctacaatgaagtgggagctgaagtgttaaactaaagagtgaatgaaatttacagtgcatcctgtaggaagagataagaaccgttgatgctatgccaatattgataatttaagaatagtttccttcatttctgtctgggaacattgagaatctgttgttacatagtgttcagatttccgtttttattcattgagtgcttcccaaagctagtgagtgttctgaagttcccagacaacgctactactagttttgtatataaaaataaggagacattattattatattcttaatagatacagggtcttgctacattgcccaggctggtctcaaactcatagcctcaaacagtcttcccaccttggcctcccaaattgttgagattacgtgcttgattcactgtgctgggccacggagataatcttgaagattaaattctttttttttttttttacaaaatttttattttattttattttttgagacagggtcttgctgtgttgcccaggctggagtacagtggcatgatcatggctcactgcaacctctgcctcctgggctcaagcgatcctctcacctcagccttcgagtagcttggactacaggcataccccaccatgcctgactaatttttttgtattttgtagagatggggtttcaccttgttgcccaggctgctctcgaactcctgggtccaagtgatttcacccacctcagcctcctgaagtattgggattacaggtatgagccaccacgcctggcccctgaagattaaattctttattggatcatctgcaaattcaaaattcttttttcttttcttcttgtttttttttttcaaatagggacggggtctcaccatgttgcccaggctggtctcgaactcctgagcttaagcagcccacctgccttggcttcccaaactgctaggattatagacatgagccaccattcccagcccaaattcaaaattatttatttctaactatagattatagtacaaagtaagaattagttcagtaatttaattgggtcttggcttttttcctatgtatctacagagaattctgtatagaagacccttctttaaaaagcagtgctgaacgccatatcctgctttttgctcacacctgtaatcctagcactgtgggaggctgaggtgggtggatcacttgagcccaagagttcgagaaaagcctaagcaacatggtgaaaccctgttcttgtgtccacaaaaaatatgaaaattagccaggagtgatggcgcacgcctgtagtcccaactactcaggaggctgaggcagaagaattgagctcaggagctcgaggatgcagtgagccgagattgcgccactgcacttcagccaaggtgacagagtaagaccctgtctcaaaaataaataaaaaaggccacgcgcagtggctcatgcctgtaatcctagcattttgggaggctgaggcgggcggatcactgggaattccagaccagcctggccaacatggtgaaaccctgtcactactaaaaaatagaaaaattagtcgggtgtggtggcgcacacacgtagtcccagctactggggagactgaggcgggagagtcacttcggcccgggagacagaggttgcagtgaaccgagatcgcaccaccgcactccagcccaggcaaccaagtgagactctgtctcaataaaagtaaaaaaataagattaaaacaaaaggcaaaatacacttcacatatcttcagctcacttgactgaaccgtaatccttctgacatcttcaatagtgttttaaaattatattttctaatcttgttgaaaatactaaaccacatggggttttttgtatgtgtttgttttgttttgtttttgagacggagtctcgctctgtcccccaggctggagtgcagtggcacgatctcagctcactgcaagctccatctccctttacgccattctcctgcctcagccatccgagtagttgggactgcagtagctgggactacaggcgcccgccatcacgcctggctaatttttttttttttctttttttttctttttttttttttttttttgagacggcgtctggctctgtcgcccaggctggagtgcagtggcacaatctcggctcactgcaagctccgcttcccaggttcacgccattctcctgcctcagcctcccgagtagctgggactacaggcgcccgccaccgcgcccggctaattttttgtatttttagtagagacggggtttcaccgtgttagccaggatggtctcaatctcctgaccttgtgatccacctgcctcgccctcccaaagtgctgggattacaggcatgagccactgcgcccagccaccattttaaagttataaaatgctgtgaattccttgagttctgacattatggcatatgcttgtttatgaattgaactcaatagtaaatagaggttgattattcaaaattcaaaaatccgagatttgaaatgctccaaaatctgaaactttttgagtgtttacatgtcactcaaagaaaatgctcgttggagcattttggatttcagattttcagataagaaatactcagcatgggccaagcactgtggcccactcatgcctgtaatcccagcagtttgggaggccgagaggggaggattgcctgagcccagaaggttaggactgcagtgagccatgatcgcaccactccactccagcctgggcaacgggagtgagaccctgtctccaaaaaacagaaagaaagaaaaagaaatactcaacctgtattaagatgtgaaatgtgtggttatatctcttacaaagcaatgtttgatgtgggctcagtggctcacgcctataatcctagtactttgggagcctatgtcgggtggatctcttaagcccaggagttcaagaccagcctgggtaatatggtgaaacccccaacactattagaaataaaagaattggctgggtgtggtggtgtgtgcctatagtcacagctacttttaagatggatcacctgagtctgggaagttgaggttgcagtgagccacagcagtgagaccttctctgggggggaaaaaagggagaaatgtttgttgtacataagccctatattactgtcttacttagcttgcattgtatttgatatttagccttataataacatttttgccgtaatattaagtgcacattcattccatgtgagtcgcttacatctggagatgctttattaagtaggatggatacagtgtcttttagggaagaccggacaaacaaggcagaaatcacagaagtgtaattaatatactatgacaaaggaaactgcaggtgtgtggaatagatcaggaagaagtgatatggaaagtgaaacttgaagagtaggaattagttgggagaagagggcacagaggtatgttattgagaaaacaaatatgtatgaaggcccagaacaggggaaaagtttaatatgactttttgagcaggagagtggagtgtgggatagaggtaaaaattgagatttcaggagtagtctaaggccaggttaagagtgtgggcttggccgggcatgatggctccatgcctctaatcccagcacttagggaggccgaggcgggtggatcacctgaggtcaggagtttgagaccagcctggccaacatggcgaaaccccatcttgccatgttggcgctccaagatcgcgccactgcactccagactccagcctgagcgacagcgcgagactccttctcaaaaaaaaagagagagagagtgggcccacatgaagggaatgagaggtcattaatggtccttaaagcagcatagtgatgcaaatcagatttgttttaaagggctctctttagttttggtgcggaaaataaattggagggaacagaagggaaggcagtaaagtcaggagactgtgtagtaacctagatgatgaatgattgtctcctttaatgagaaggtggatggagagaagtaggtatctttgaaagtagtaagattattaagactgaaaagaatcaagcatagcaagaatgaaggaatggaaagtatcttattttcggtattttaaagtcattggcgaattaaagtgcctttttagattgaatatgagttagcaggaggtaaggaagtagaaataggtagtgtaaacaaatcaagaagtcacaaagagaagagagaagtggaaactcttagcttctttccataaatagcttaggagcatatattaaagagtccgtttttttccagttggtcgtgttctgttgcccaggctgtagtacagtggcacgatcacggcttgctgcagctcaacctttcagattcaagtaatcctcatgcctcagctccctagtagctgggagtacaggtgtgtgccaccatgcccagctaatttttttatttgtagagacatggtctcactatgttgcccaggctggtctcaaactcttgggctaaagtgatcctcccgcctcagcctcccaaaatgttgagattacagtgtgtgagtgctaatttttgtgaagttcttagaacattaattggcacatagtaattaatctactaagtgtcaaagaatatgggctcagctggtcattgtcatatgtgtcagagataggaatacaagatcctccaaaagttcatgagtaagagctgatgaactctttaatttcatggtgttcccctagagttttagcattttcacttgttggtttgttattcttccataatgagacaaataatgagatgattggactcagaatctggaatcagattgtgggagtttacattgtgctctgtttagctatttaattagatttcttaaactctaagccttagtatctcctcagtgtttgctacatcataataggcatttcaataataagaatttgagaaaaaattctacagaaaaattaagagaagcacagccacttactatttgtgcttccattcactggttttacttacttttttcctcaaacctattctgcaccctgcctcacatgaagaaaagtgccatttactatttatgtttttattttatgtactattttatttaccaaaatggattttattctctgttgtattctcatagcatctaccattattctaggtaaattgtaagctcctagtaattgttgggtttgtttaaaggcggaacatttattaaagagtttgaaaacaacatatgttagtgacaacattcagcttactggatcctttgtcttctacaccccttctttcacctaggcaaaatgatgtaatagatatagggacctttctttttttagtttgaagatttcattttcttgtagttctacttaaactgttttatttctgttactgaaaaactcaagtgtgctttatattctaggtccggtttatcactaaaatatggcatcctaatattagttccgtcacaggggctatttgtttggatatcctgaaagatcaatggtaagagattttgaattcaccttctctccttctcatatgaataccaagactgtaagagtgttaaatgtgtaattgcctcaaaacatatattatactttatcttgtttgggcagtaactttaaaagtctcttaagtgcataactgaaaatgcattataattgagatcacaatccatatttaaatagaaacttgttagataatgttagatgctagctttacactttgaaaagccttggatttcatttgttattttggtaaatttgattctttgctatcttaagaagatatttgtgaaagactaaaaaagtagaaagtaagtattgaagtagtcatatcccccttagatggaatgtaagttacaaaattgttgcaggttgtgttaattgagcacagttaagattttggtttatgaattctaacaaggagcacctttgtaggtgatgtcttcatttggatagcggtattgtgctttcactttttttgtctgatttgctctgcacagcattaaatgttttaagagttcctactctggagccaccaggttcacatcttggctctccagtttaccaagctgcatggttatgagcaaattacctaaagtctgtgtgccttagtgtcctcatctgcaaaatgggttgatacccacttcatagagctcagaggattaaataagttactttatgtaattcccttagaatagagctttgcttttgtttttgtttgtttgttttgagacagggtcttgccctgttgcccaggctggagtgcagtggcgcaatcacagctcactgcagccttgacctctaaagcccaagtagtcctaccacctcagcctcccaagtagctgggaatacaggcgcataccaccacacctggctaatgtttgtattttttttagagacagggttcctgttgcccaggctggaagctttgtgtagtctgacaatgataaagatgatagttaattatttagcacatgattttatagatggaaaaactaagaccaaaggtatgaaaagtaattggagtgggagaaaaccataaaactagaaaaaatcaattaagtgagtgtctattatgacctttccttctgattttactcttttacaagagaaggtataacagaacaaaatagaacagcagttggtaagaagacttggagccaaaactgtgtttaatgggcccagcctggctgcctaatcttctaaagattatatattatttttggtactagaatttttaagctatgtttttttgggtgttttttttttgttttttgttttttgttttttgttttttttttgagacagagtttcactcttgtcacccaggctggagtgcagtggcacgatcttggctcactgcaacctctgcctaccgggttcaagcgattctcctgccttagcctcccgagtagctgggactacaggcgtgcgccatcatgcccagctaatttttgtatttttagtagagatgaggtttcaccatgttggccaggctggtctcaaactcctgagctcaggtgatccacctgcctcagcctcccaaagtgttgggattacaggcatgagccaccacacccggcctaagctatgtgattgatttgttaagaaaggggagaaaaaaaggtacctgaaagaaaatcaaataggaatgacagtatttagtgtatggccagtggtttacttagtaactggatgaacagactagagttacaggttttgttttgttttttttttctattccagtagtatatctgagtaaatcctgtccctcagtagatcatctcttgggatctggtttcttgatctgtatttcaatatattctatattccatatagatcaagactttctaacataaagcagtgtggaatagacttactttttatcttctctgttactcttttgatttgtgacttttaccaatttattgaacttcttaagtgtcagtgtttttaatccattaggttatcgccaaggcctctaaaagctctaagattcagtgatatgaatacatatttgcagtattagagacattgtactgttttcacttggcttctaggacattagattttctattctccctttcctatgctcactcccagattccttaaccagttccttgcatctttgtgtattagaatgcctcagggataagtcttggatttctgctcctttctagctgcactcacttccttggtaagctcatctgatttcatcataacttcacctttacatactgcaaactcacaaattatcttccctgaacttgagactcctatcctgctgcctgcttatcatctttacttgactatataacgaacatatcaaacataaactgaactgatagtctcctaacctgaaacctgcttctatagtcttccccaactaagttattggcaaatacgtccttgcattttctcaggccaaaatcacatcatgatccttggcatttctttctctggtaccccatgccctgtctgcagatctattggcaaaacctcccaacatcttaacagcagctttactaccacacttttccaaacggattacctctagcctgcatgattgcattagtctgcctccctgcttctggcttttacctactcaggctattcccagcacccagaatgacaactttgaaaacaaagcttgccgccacgtgcagtggctcatgcctgtaattccaacgctttagaaggcggaagtgggcagatcgcttgaggtcagaagtttgagaccagcctggccaacatggtgaaaccccatctctaccaaaaataaataaattagctgggcatggtggtgcatacctgtaatcccagctacttgggaggctgaggcaggagaatcgcttgaacctgggaggcggaagttgcagttagcagagatcatgccattgcactctagcctgggcgacggagtgagaccccatctcaaaaataaaaaaaaaaaagaaagaaaaagtttgcagatgaaaacttcccattgacttctctttttgcccagagttaagccaacagtactattacttgtaattatcttcctatatagctagttgaaagattatggtgtgtatatatagagagagaagttgaatttttataccaaaacattttctcctaatatgatgtgcaggaacaaaacattttttacatcaactattcccttttcctaaggcaggtgaataatcttgttttttatctgtacaattgaaatattagaatataccaaagacacattagataaaataggtgagactagatattcatgaagtcattactttattcccagagctttactgaggtataattgacatttagtgcatatccatatttaaatgtggatgtttaggtttcagaactggaatttgatagagaaaaatacagagtcttaatcataggaaaaatgaattacataaataattttcagcaggcatactagaaaataattggttaatcttggtcttttattaatgcatctaggggtgatgatatacctttattaatatttaacttattttagtatatttgtttattattattatttttttttgaggcaaagtctcgctctgtcacccaggctggagtgcaatggtgccatctctgctcactgcaacctccgcctcccgggctcaagcagttctcctgcctcggcctcctaagtatctgggattacattacaggcatgtgccaccacgcccagctaatttttttctatttttagtagagacagggttccaccgtgttggccaggctggtctcaaactcctgacctcaggtgatccactggcctcggcctcccagagtgctgcaatgacaggcgtgagccactgtgcccggcccctggtttatttcttaattccacaacttgtgctgtgtggaaactattttctaatgttttccactgacacttactatgactaatggtgtctacttacctggggaagaaaatggcaacacataaaaatttcactcagtgacgctgcccttctaaaagacacaaacaggcacagaatatctgcctggtcgataaggtatgctcagcatcattactcatcagggaaatgcaaatgaaaatcacaataagataactactacatgcctgtaaacacaaatacctcatgcattgctggtaagaatgtggcttaaccaggcagggcacggtggctcatgcctgttatcccaacactttgggaggccaaggtaggtggattgcttgaggtcaggagttcaagaccagcctggccaacatggtgaaaccccatctctactaaaaatacaaaaattagccaggcgtgggtggtgggcacctgtaatcccagctactcgtggggctgagacaggagaatctcttgaacctgggaggcagaggttgcagtgagccgacatcgcgccactgcactccagcctgggtgacagagcgagactctgtcacaaaaaaaaaaaaaaaacagaaaaaaaaaaaaaaacaaataatgtggtttaaccacttaaagccagtaatatctaccaaagctaaacatacaccttcagtatgccctatcagcttcattcctaggtatatatctaaaagaaattagtgtctatgcctactttttaaaagacatgtataaaagaatatttatggcagatttattaatagccccaacgggaaataacttagatgtctcatcaacaagaaaattgatacattgtgatcacacactggagcactacataaacagtaaaaaagagcctatcattgacacaaacaacatggatgagactcagtcatgttgagtgacaaaagccagacacaaaagaatacatactgtatggttcaatttttatgaaattgaagatgaaccagaatttatggtgataaaaaatacgatagcccagcgcagtggctcacgcctgtaatcccagcactttgggaggccgaggcgggcggatcatgaggtcaggagattgagaccatcctggctaacacggtgaaaccccgtctctactaaaaatacaaaaaattagctacagcgagactccgtctcaaaaaataaaaattaaaattaaaaaaaattaaaacaaataaaaaaatacgatagtggtgagggtgggcaggagttgtgagtaggaggagcagaagtgaggctttgtaatgctaaaaatactctatttttatccaggcggtggttacatggatatatacagatataaaaattcatccagctgcatggtatcttaactttgcttaaactttaacaaaaaaatttatagcagctgggtacaatggtgcacacctgtagtcccagctactcaggaggctgaggcaagaggattgcttaagaccagcaagtctgggctgaagtgtgctatgccagtcaggtgtccacattaagttgggcataagtatggtgacctcttaggaacagaggaccaccagattgcctaaggagacgtgaaccagacaaggttggaaacagagcaggtcaaaactcctgtgctagtcaatagtgagataacacctgtgaatagccactgcatcccagccttgacaacatagtgaaacccaatctctttaaaaaataaaatctttagtataaaagctgccatcctctttaagtagcatttagtgttttgaatgaacgtggtttaattattgatgatctgttggaagatccttaacagaaaagttagtcaacggtatgaacaattcacatgattattctacatagtaaggcctgagtccttatgaatgaatatatgaatatttacatagccacattaactatgtcttactgatttgagacttgagcaaaatttatttaccggacatagatttatgaggtactgatttattcatattatcttctaaattataaagattgacacattttgaaatttcatattcctgtttgcctgttaggatttgttataatagatttaagttgattgtatatactgatcctaaagatatcagtacaatatagatttgatcactactttgtaaatagaagaagaaatggaacaaaagcatgttttcagttatatactttttcacattactgaatttagattagagcagtccaaaattgcacacatttctttatattatcgaagatacagtttctatagtattcattttttttttttaaagttttaggccggttgctggccggatgtggtggctgatgcctataatcccagcagtttgggaggccgaggtgggtggatcacgaggttgggagttcaagaccagcctgggcaagatggtgaaaccccgtctccactaaaaataaaaataaaaaattagccgggcgtagtggcatgcgcctgtaatcctagctactctggaggctgaggcagagaatcgcttaaacctggaggggcagaggttgcagtgagccgagatcgcctcactgcactgcagcctgggctacagagcgagactcccatctcagtaaaataataataataataataataataaatcttgaaatttattttatttatttacttattgtagagatggggtcttgctatgttgcccaagctggtctcaagcacctggcctcaagtgatccttccaccttggcctcctgaagtgctaagattacagacttgaccccctactcctggtctatagtatttagggttagaaaaataggtgtggtaggctgtttttgcattgccataaaggaatacctgaaactgagtaatttataaggaaaagaggttccatttggcttctgattcttcaggctgtataggaagtgtggtgccaacatcagctcaatttctggtgaggcctcagggagcttatgatcacagcagaagatgaaagaggagcctgtttcacatcatgagggtagaaaatagagtggaagcaacagagagcagggaagttgccacatacttttaaaacactttgtttgagacagtctcacactgttgagcaggctggtgtgcaatggcacaatcttggctcactgcagcctccgcctgctgggttcaagcgattctcctgcctcatcctcctgagtagctgggactacaggtgcgtgctatcacgcctggctagtttttgtatttttagtgagatggtgtttcactgtgttggccaggctggtctcgaactcctgacctcatgatctgccctcggcctcctaaagtgttgggattacaggcgtgagccacgcacccggccaaaaaacactttttttttttttttttttttttttttggagactgtcgcccaagctggagtacaatggtgcaatcttggctcactgcaacctccacctcccgggtttaagcacttctcgtgccctcatgcctcagcctcctgagtagctgggattacaggcacgtgccaccatgcccagctaatatttgtgtttttaatacagatagacttttgccatgttggccaggctggtctggaattcctgggctcaagtgatccacccgccttggcctcccaaattgctggggttaaaggcatgagccactgcatccagccttaaaacactttttttttttttctttgagacagagtttcgctcttgttacccgggctggagtgcaatgtcacgatgttggctcactgcaacctccacctcccgggtgcaagtgattctcctgcctcagcctcccaagtagctgggattacaggcatgtgccaccacacccagctaattttgtaattttagtagagacggggtttctccatgttggtcaggctggtctcgaactcccaacctcggatcatctgtgcacctgacctcccaaagtgctgggattacaggcatgagccaccacgcccagccaaaacacttaaaacaaccagctctcacatgaactcagtcatcaccaatggggtggcactaagccattcatgagcgatttgcccccaggatccaaacacctctccccaggctccaccgccaacactgggaattacattgcagcatgagatttggagaggacaaatatccaaactatatcaataggttttgtttggatatttatttttatttttattttttgagacagaatctcactctgccacccagactagagtgctgtggctcactgcagcctcaaccttccaggctcaattggtcttcccacctcagccttctgagtaactgtaactacagtcacgtgctaccacacttggctaattttttgtagagacagagtttcacctcattgcccaggctggtcttaaactcctgggctcaagcgatctacctgcttcagcctcccaaagtgctgagactgcaggcgtgagccatcgtgcctgacctcaattattgaactaattttcttacaattaattattaaaactggctgtgtgcagtgactcaaacctgtaatcctagcatttgggaggccaaggcaggaggattgcttgagcccaggtgtttgagaccagcactggcaacatggcaagaccctgtctgtacaaaaaattttaaaattagctgggcatggtgttgcgtgcctgtagtctaaggtgagaaaatcacttgagccttgaaagtcagggctgcagtgagccgtgttcacacattctgtgaaaattcaatcaggcagaaaagtgacaacgttttctctttgacattgttatgaattgtatctaaatttgcagctctagattttttttcaattttgagggttttgagagcaaactgcctttttttttttttcttttctctttttttcttttgcccctgccagacatggtttttctctgtcgcctaggctggagtgcagtgacaacgatcacagctcactgcagccttgaccttccaggccccaagcattcttcccacctcagcttatcacaggtgcacaccaccatgcctggctaattttttaaaattactttttgtagagatgggtcttgccatgttgcccatgctggctggtactcaagcaatacccctgttttgacttcccaaagtgctaggattataggcatgagccactgcccccggctgatttctttttctttaacctcctcttcattcaagtttctgattcttgaaatggtaatctagagtctgtagtagattgtgtcgtcacaataggaagacagtgcaaatagaggaaatagacagtatttataataaggatttttgaatctctaagaacttattaatttttttttttttcgagacaagagtctcactctgtggcccaggctggagtgcagtggcgcgatctcggctgactgtaagctccgcctcctggcctcagccattctcctacctcagcctcctgagcagctgtgactacaggcacctgccaccactccaggctaattttttgtatttttagtagagatagggtttcaccgtgttagccaggatggtctcaatctcctgacctcgtgatccgcccgccttggcctcccaaagcgctaggattataggcgtgagccactgtgtctggcctacttaaaactttttaagaaaatttttgtaaagtacacagcataaaatttactaggccaggcatcgtggctcatgcctgctgtaatcccagcactttgggaggccaaggtgggtggatcgcttgagcccaggagttcaagaccagcctgggcaacatggtgaaactccatctctacaaaaaatacaaaaattagccaggcatggtggcgtgagtctgtagtcccagctacttgggaggctgaggttggaggatcgcttaagctcaggaggttgaggttgaagctacagggatctgtgatcacaccactgcattccagcctaagtgaccgtgagaccctgtctcaaataagcagggccaggcgcagtggctcacgcgtataatcccagcactttgggaggccgagatggatggatcacctgaggtcaggagttccagaccagcctgaccaatatggtgaaatcctgtctttaccaaaaatacaaaaacgttagccaagtctggtagcatgcgactgtagtcccagctactagggagaatcgcttgaacctgggaggcagaggttgcagtgagccaagattgtgccactgcactccagcctgggcaacagagggagactccatctcaaataaataagtaagtaggctgggcgtggtggctcttgcctgtaaccccagcactttgggaggccgaggcggatggatcacctgaagtcaggatatatatatacatacatacatacatacatacatacatacacacacacacatacacatacacatacacaaaagccaaacattttgttgatccattcatccatccatggaaaccttaagttgcttctaccttctggctattgtgaataatattgttatgaacatttatatattaatactccagttactgctttcagttcttttggatgtatacccataagtggaatcactggattatatagtaactctgtgttttttgtgtgtgtttttgtctgtgtgtgtttttgttttttgtttttttttgagggactgccatactgtttcccatagagttttcaccattttacattcccacaagtagtgcacaagagttccatttctccacaacctggctaacaattaccattttttttatggtagccattctaatggatatgaagtgataggtcattgtggttccaatttgcatttccctaatgattagtggtgttgagcatctttttatgtgtttattgacactttatatatcttctttggagaaacgtctgttcacatcccttgtcgattttttaaccaggttttttttttttgttattgagttgtaggagttctttatgtattatggatattaagccctcaccagataaatgatttggaaatattttctcctgcaacacagaagtttttttgttttaagtagtggggtcttgctgtgttgcccaagctggcatcgaactcttgggctcaggtgatcctcccacctcagcctcccaagtagctgggactacaggtgtgtgccaccacaccagcttcacaggagtgtttatttttatttctaatttttattattttctttctttctttttttcgagacagagtctcgctctgtcgcccaggctggattgcagtgacacaatctcggcttactgcagcctctgcctcctgggtgttcaagcagttctcctgcctcagcttcccacgtagctgggattacaaacatgcaccaccatgcctggctaattttgtgtttttaatagagatggtgttttaccatgttggccaggctggtctcgaactcctgacctcaggtgatccacctgcctcagcttcccagagtgctgggattacaggtgtgagccactgcatgcggccaggagtttttaactttgataaaattgtcgtgcatattctcgtattttttgctttggtttcctgtacctttgatgtcatatccaaggaatcattgccaaattcagtgtcatgaagttttctcccttatgtttttgctttctagctcttacatttaggtctttgatccattttgagttaatttttatatatggtataatgtaagggtccagcttcactaatttgagagattatcagttttctttttttctgtttttttttttgtgtgtgtgttttgtttgtttgtttgtttgttttttgagatggagtctggctctgtcgcccaggctggagtgcagtgatcttgactcatttcaagctctgcctcccggattcacgccattctcctgcctcagcctccagagtagctgggactacaggcgcctgccaccacgcccggctaatttttttgtattttagtagagacggagtttcaccatgtttgccaggatggtctcgatctcctgaccttgtgattcacccacctcggcctcccaaagtgttgggattacaggcatgagccactgcgcccggcccaggattatcagttttcaagaaaagtgtttattgccttgttgagatatatgttagactacctatgtgatagtatgaaggacttgcaagatttagatgcttttattttacatgcctttatgtttttctttcaaattaaaataaatattatgagtttaatagttgccttagtattaaatacttcctttgagtgaaaatttttctttgctattcaggtaaatttcctttaaataaataattttattaaaaattacataagattttgtttcaggtgacaccatggattttaaaattagattgcttagaaagtccattggaaaattaaatagtgcacttaagtgttgtatatttcattggttatattttgtctttgtgttccttatgttatttttggtggtttaagtcagctttatgctgataacatctaggtagcttttgatatgtatgtgcctttaaacattctctttgaaattactcaaactatcaaatgaaattagagaaagaatttccccttgttattgtgagactagaaagacgggccattgcggtgtcttacacctgtaatcccagcactttgggaggcagaagtggacggttcacctgaggtcaggagtttgagaccagcctggccaacacggtaaaaccccgtctctaccaaaaaaaaaaaaaaaaaaatcagccaggcatggtagcaggcgcctgtaatcccagccacccaggaggctctgaggcagaagaattgcttgaacctgggaggcaaaggttgcagtgagccaagattgcaccactgcactccagcctgggggacagagtgagacttcgtttccaaaaaaaaaaaaaaaaaatgtaaaaaatggtgagtagaaagacaagaatgaacatttgaggactgagtttggctttttgttttgactcatgtcttaaaagaatattgtgcatttaaaagagatgaggtttcaccatcttgcccaggctggtctcaaacccctgggttcaagcgatcttcctgcctcagcctctcaaagtacagagattacaggcatgaaccaccgtgcctggtcctatttttaattttttgaggaaactccatactgtttttccataatggttgtactaatttgtattcccaccagcagtgtgcgagggtttcctttcctttacatcatcaccaacacttgttcattgtttttatagtagccgttctaacgagtgctaggtgatatctcattttggtttgttttttatttatctatttttgatggagtatcactctgtcacccaggctagagtgcagtggcatgatctcagctcactgcaacctcagccttccaaatagctgggattagaggtgtgcactatcacggccagaaaatttttgtgtatttagtagagatggggtttcgccatgttgcccaggtaggtctcgagctcctgacctcaagttcaggtgatctgcccacctcagccttccaaagtattgggattacagacatgagccaccatgcccaccctaattaacagtatttgtcaaattttaatgtgcatcagaatcacctggaggacctgttaaaacaaccctggagtttctttttgtttttttttttttttcgttttgttttttgttttttattttgtggaaaacaaaagtagaaaaactaaaaccccaaactccagaaaaaatcctaaaaaatgttttttcttaaaaaatactgtatgtctctactcctctccctccctcccaacagcccttcttgtgttcttttctaagtgccttacccccccacccccatgactatccattgttcttgctattgtgcccccacttcccaatatctatccaggatgtgcaccccatgttctcttacctggcgtcttacttttttctccctcaaatttcagcaagcctcatacttgcagtctcatttcgccagcatgcaagaactgtctcccccttccttttctgggactcaataatcttttccccttaccactccctcaccccaggcctattataagcaggagcatgtcctcctgccaaattccctccctgttcccacccacccccccacccttcttatctcgagaaatgtcagaaccttcccctgggcaggcttagccaggaataaaacatttttgtcttccctcgttctataggacccttttccctccctccacatacacatgcgcctctaagagaaggaaatctttctctgggaccccgtattcccctggcctactccaagaaccctgtcccccgctccagcttcttgcactctcaagagcaacaacagtcttctctccaaggaatcatcttccctctctcaggatgtgtgcatctgctcagcctcccactcttacctttctgccccagaccccccacccaccaattctcctgggccaaagagccctttccccacctagcccagggaccccagcctccgggcctccacgcctgcgcggctagcggatgaggacattaatctcggccacactggtctccagcacgttctcggcggtggtcttgccgtgttgctccttgagatgccgcctaatggcaggcttgtgggcgaagcgcatgtcgcagtaggagcagcggtagggctgcgctcccgagtgcaggttgaggtggtcgtgcagggtggacttctgtgtgaagcacttgccgcagatgccgcacgagtgtgacttgacaccacgatgcacgttcctgtggtggttgaggttgttgctgtggttgaactccttgccacagcgagggcacatgaagatgaagtgctgctgccgcatgtggaagaccagcttctccacgccctggaacacttccgggcacttggtgcacttgatgttctttaaggggtttccacctgagaagctcccaggcaggggtccctggctgccccccgccccccgggcaaccatggccgccgctgctgcttccaccaggcccgaggtggcccccacgctggcccggcctcccggagtcaacagcaggctctccccttctgcgttctccgacaggctatagcaggccttcaccacaccctgcggtggggccacagtgctggggggcacgctgctctgggccagctccccaaggtggccacccacggagcctccaatgcccaggccccctcccaggcctccagggggcttgagccggtgtgcgatgtccagggccgactccaccttgacgatgcagatgtcagatacgtcctcatcctcatcctcttcctcggctttcagctccaagtcctcatccagtgggaactccagcttcactggccgcaggagtggaggggatagaggaggtggggggtgggggcttcggggctggctttggggtcctggctggagggaggagggacttgttggcgctgacgctgctcacaaggctagcctcacggaccccatcctctttgaggcctattttgggctcagtgaactggctgagggcattctggcatttctccaccacgtgctccatctgcaggtaggaggtggctgtaagatagttgacgatgtccctaacagcgaattccagggtgcccgtgtagcaggagagaagcaggtcggccacgatgcgtgcactgtgcatcagggagacctgcagctccgagctggggttaagcaggaactggtcccgcaggaacggtgagcaggcggctaagatgaccttgtggcctcgaaacttgaggctgtcggccacaatggtcacgtcgcagaaccactcctctgcccggagcttgttcatgttccgtagcgtagcggcctagtggccgggcagctggaagcgcaggacttcaccccagaggccattgtggcgggggtgggcaaccctggcccggttccgcgcgctgtttttttttaatcccctattttccccacccccgcggggccggaagcgccccccacacacgggcagagccagggcagcatgtaggcgcagggcgggagggtgtatagggcgcgctcgcgctggcggggccggctccacgtgggcgtaaaggggtaggggcgggagcggctcgtgcggtgtgttccaggcctcgcgcgcgcggcgacggcgtcggctaggactcaaaccctggagtttctgattcagtagctctgggatagagaaaacttcccaagggatgctgatgctgctggttggatgaacaacactgagatcattgctttaagacatccattgttggttgttggcaataacttaactttttggctaggggtggaggtgtaggagacagtctggctgtctccctcaggctggagtgcggtggcgccatctggactcactataaccttcgcctcccaggttcgagcgattcctgcctcagcccctcaagtaactgggattacaagcatgtgccaccacatctggctaatttttgtatttttggcagacagtgtttcgccatgttgcccaggctggtctcaaactcctggcctcaagtgatctgcctgcctcggccttcctaaatgctgggattacaggcgtcagccactgcacccagcctaaattaacttttatcgtaggcatctagggaagtactatttatgtaccaaacttgggaaaattgagaaaacagtcactaattttttctattttgtggttcaaatcaggaacccagttgaaaaaggctggtttagagtaattggctagttgtcgtggctcacacctataatcccatcactttcgggggctgaggtgggaggactgcttgagctcaggagttcaagaccagcctgggtaacatggtgaaaccctgtctctaccaaaaaaaaaaaaaaaaaattgtttttaattagctgggcgtggtggtgtgcacctgtagtcccagctactcaggaggctgaggtatgagaatcacctgagccaaagaggtcaaggctacagtgagccttgattgtaccactgcactttagcctaggcagcgtgagaccctatctcaaaaaaagaaaaaaagaagaatgatctaatttacatggtaaaaatgggcattctctttacatgtaacatttttaatatgtccacatatttatacatacctctattaattgataaagcaacttttttttttttttgagatggagtctcgctctgtcgcccaggctagagtgcaatggcatgattttggctcacggcaacctccgcctcccgagctcaagcgattctccttcctcagccacctgagcagctgggattacaggcacatgccaccacgcccagctaatttttgcattttttgtagagatgaggtttcaccatgttggccaggctggtcttgaactcctgacctcagatgattgcccgccctggcctcccaaagtgttgggattacaggtgtgagccaccgcgcccagccagtgagacaactttttttaacagaaatgccaagaattattgctagacaggtagatactattttttagacaaatattagctttataaagatattttccttataaatacatttagaatcataaattaagtgatgtagtttaatccaaaaaacttgtcctgtttcagaatgttatggaatgatttcatattttcttgaaaatatggccgggcgcggtggctcaagcctgtaatcccagcattttgggaggccaaggcgggcggatcacaaggtcaggagatcaagaccatcctgtgtctcacggtgaaaccctgttctactaaaactacaaaaaattagccgggcatggtggcatgtgcctgtagtcccagctacttgtgaggctgaggcaggagaattgcttgaaccagggaggtggaggttccggtgagccgagatcgcgccactgcactccagcctcggcggcagagtgagactccatctcaagaaaataaaagaaaagaaaaaagaaaatatatttgtttcatagtatcttgtttttagagtgccattgaaagaaagcctcacatgctattagtactaatgatttatcactttaactttgtttagagaaatggatagaaaaataagtgagtggataaaactaacaagaaggtggctgggcgcggtggctcacgcctgtaatcccagcactttgggaggccgaggcgggcggatcacgaggtcaggagatcgagaccatcctggctaacacagtgaaaccccgtctctactaaaaatacaaaaaattagccgggcgtggtggcgggcgcctgttgtcccagctactcgggaggctgaggcaggagaatagcgtgaacccgggaggcggagcttgcagggagccgagatcgcgccactgcactccagcctgggcgacagagtgagactccgcctcaaaactaaactaaactaaactaacaagaaggatcttggcaacaagaaaaacaaggacagttcagaattcgagttgtcttaagaaatagaaaagctggccgagtgtagtagctcacacctgtaaccctaacctttgggaggccaaggtggatggatcacctgagctcagaagttcgataccagcctaggcaacatggcaaaaccccgtctttacgaaaaaaggaaaaacaaaaaaaatgctgggtgtggtggtgtgtgcctgtagtcccagctactcgtgaggctgaggcaggagaatcgcttgagcccaggaggcggaggttgcagtgagacaagatagtgccactgcccactccagcctgagcggcagagcaagacactgtcattaaaaaaaagaaaaaaggccgggcgcaggtggtttttcatgcctgtaatcccagcacattgggaggccaaggcgggcggattacgaggtcaggagatcgagaccatcctggctaacactgtgaaaccccgtctctactaaaaaaaaaaatacaaaaaattagctgggcgttaaggcgggcccctgtagtctcagctactctgaaggctgaggcaggagaatggcgtgaacccgggaggcggagcttgcagtgaaccgagactataccactgcactccagcctgggcgacagagccagactccgtctcaggggaaaaaaagaaaaaagaaataggcaaattgtaaagtaaggaagaaaatatatgataggcagatacataattataaatgtctatgacttaactatataattaagataaagatctaagtaacttttagctctacaattttttaatttttattaagaaaatactttgcttttgcctgcagagccctcttaattgggatattttcatgttttgcattttagggcagctgcaatgactctccgcacggtattattgtcattgcaagcactattggcagctgcagagccagatgatccacaggatgctgtagtagcaaatcaggtaagatggccgcttttgaaagactttcttatattatgtatgagtctctagccacttcagtggtttgcacattaacacatgagcatactctattgaaactaaattttgaaatggttttctttcttgtggtaggattattttgtcaggtgtaatagtgaaaatagacttttaacatcctagtttaattggatatagatgctgttttcctaacatgagtattttcaaacacataaagtcaaaagaattacatagtgaacacccatattcctaccatctagattctatgattaatgctcgtgtatgtgtccatctttttatccttcctttcagtgatgatccctccctgctaataattttaatcacctcctatcatgggacttatgtgacatggcacagtttccaatgaccttgtaatttgttgaacagaataaatatttttcatttcgctttctagctacagtggctgagtttattagttacaacggagactggacctaagttattagtatctgacctgttaagaaacagtttgctggccaggtgtgttggctcatgcatgtaatcccagcactctgggaggctgaggtgggtggtggatcacttgaggtcaggagttccagaccagcctgaccaacgtggtgaaatcctgtctgtactaaaaacacaaaactagcctggcgtggtggcacacacctgtagtcccagctacctgagaggctgaagtgggagaatcgcttgaacctgggtggcagaggttgcagtgagctgagatcacaccattgcactccagcctgggtgacagaacgggaccctgtctcaaaaaacaaatttgccaacacctactctaagccattggaatataatggacatttttttttttaaacttagaaagtttttcttctcttgacttctaagatattaccctcttttcttcctcacttcatagctgttctttgttagttcccacaattatttcccttcttactcgtctttcttaaatgtagttcctcagttctgaccttgttacctttactttctgtacacactcacacttggatgatcatatctgtactgatgttagtacctgtacattgataaaatgtttaggcttgccctctctcctaagcacgagagcctggtgtttaactaaattggtaggtgatggtatcatagaatgataggtttgtaggatttatgatactgcattcagttttggcagtgttacattcaggtatccaaggaacattcatatggttaaccacccaagtcacagcctttggagtttttctctgtgtctcctttgctcctgttgataaccattccctgtatcattctgtcactatatttacataattactctgattgccataggtcacttttaaaaaattgtttcttttcaactgctctgatagatctccttttctcaacctctttcttcctttctccatcttctacattgctatcaggtagctttataaagtgcaaatcttacttcactaacaaaaacttgttcgtagctctactgtcatctacttgagtccagattctttagtttgcagagtttttccatgatctgaactctgctttatttcctaaattcttgttttcttcaaactcatgctttttcaagcattgcattcatttttacatattgtatccaatctaccatatttcctctgcctgaggaaacttcctcttggcaaacttctttaacctataagattttaatttatatattatctttcttcttttcccttgaagatctgtttatgtatatatgtatatatccttgtcaatatattctgttatttgtctcagagtacttccaattagggttttccatgttttatatatgtgctatttgttcatatttgttgttataagcatggcttgtgttccagctttgctttcctattgagctctaagccttacacgttgaggttggactcaagggtttcttttagctcctaaaatagttcaataatttgacttatttccttgtgatgaataagtggtagaaactagatttatcgttttaatatgtaatagatttaaatatataaattacttttaaaagaaatattaaagtgaattgaatagttagtaatttatactttgctttactaagtaatggtggttccaaagtatttgataaatttacctctttccaatgcatatgggaagtcttttaataaaattactctattgtgagtttataatcatctcaagttatgtaataagttaggactttgcatgtggggtttccataaatcactgtacactaatgcagctgtaagaaaacagaagaatctagttgtattctagcctgggctgtgggtaatacaaaagctggttacatcgtaaaaaattattctaatgtccacatatttttataagctagtaatctgtgttcagttgtataatgtttgctgctttccagtgtttggaacatctcttaatacctcacttaacctaattttagtcttgctagttatatttgttgaatttggagattaaagtagattaatgttacttgtctttattattgtcaacacaaattgtgagtcgaagcttcaggttaagtggtcttttctcgagtgacataggttgtctataatgcaaagtgaatcacattttaaatgtagatttgttttatttggaaaagtaggattgtaggcgattaagagctgaaatatatcaaatattataactgtaatgtcatgtcaatcaatttttccccccatatagtacaaacaaaatcccgaaatgttcaaacagacagctcgactttgggcacatgtgtatgctggagcaccagtttctagtccagaatacaccaaaaaaatagaaaacctatgtgctatgggctttgatagggtaagtacataagggcatgttgattttgatatattgattgattttaaattattgcaaattcttggctgacaaaagtggtttagaaaataagagaaattcgcagcctgggcaacatggcgaaacccatctctacaaaaattagctggacatggtagtgagtgcctgtaattccagctactctgaaggctgaggtgagagaatcccttgggcccaggaggtcgaggctgcagtgagcgatagtcatgccactgcactccagccttggtgatagagcaagaccctgtctcaaaaaaaaaaaaaaaaaaaaaaaaaaggaaaataagagaaaatctagttttggtaaacatattttctgttttcaaagtcagtgatttttttatttttactaattactgtcattgattttagaagctttccatgcactgcaaatgtaaatcaacttacagaaaagaaacaaggtgttaattcccagtataaagagtgaatgattcagtattgtttaaatgtttccttgagatttaatttcctgtccccttttcttctctacagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttg

SEQ ID NO: 36142 - DNA, 167080 bp, Homo sapiens
ggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcaggtgagcgcggcgcgctttcccccggctctgcgcggccgggcggcctcgaagtgcaggcggaccgacccaccgacagaataccgagcctgggctgcccgacgcgcaggcgccctccccaggcccgcactgcagcccccagcgccccggggccccggcgccttcgacccctccgaggacagggggagagggagggcggcgctgcccgacccctcggccgggagagctgggcgcgctccctgcgcaggacaagccgcgctgcagccgccccggagtgccccgtgggggcgctgtggcacgcagcggggacgcccagaccccggccaccgcgacccagggaaagggagacctgttgagcgggtatgcagggtgattcctattccacggacagccgatggctcccccttccctcttcggaacctggtattttcatgcccgtgtcatctggattttgttcttgggtctctatggcagctaaacctccagcttccctatattgtggaagagggagagaaaggggaaggcattttgtggtagttgctagaaaccccagaacaatttggagccgtttggggagaggacagagaaatggggactgtccctggtagggtctccaggactgggggcacaggaaagtgctctcctcagggacactcgcgcccaccctgaacaaacccaattgaccaagtttcaatttgtcataaatcaggaagccacaatgcatctgcaccaagcacacttaaaatcggcctttaaggaatggggcagtcaagagacttcagggacccgtggtcgagagcagagactggggtcagcctgcttgggtttcaaccccagctgtgaagtttacagggttgataacttgaaggtacccaagtatgcctcagtttcctcatctgtctaatgaggatggtaatacccacagaactgtgaggattaaatgagatatggcggccgggcacggtggctcagggctgtcatcccagcactttgggaagccggggcgggcggatcacctgaggtcgggagttcgagaccagcctgaccaacatggagaaaccccgtctctactaaaaatacaaaattagccggacttggtggcgcatgcctgtaatcccagctactcgggaggttgaggcaggagaatcggttgaacccaggaggcagagattgcagtgagcggagatggtgccattgcactccagcctgggcaacaagagctaaactccgtctcaaaagaaaaaaaaaaagatatggcaagtaaagtccttagaacatttccaggagcattctaagattaggtgagttccatggcttgtctttgcagaaatagcaaggagctgctatgagcagtgaatgtacctcttccccagttcagaaagagaggctctccatgggtacgtgagggtggcagataagccacgtgtatgcaactggtagttccatgcaggagtccacacgggcgcagttctccctgcttgctcccaaagggccaacctcataaaaccatgtcaaaataccaacatgggtttatgacctggaatgtttcctctcagtccctgaaacttggcacttagaatcctctgtggagaatgagatacttatggctcttcaccttgcattttcctatctgtccacactttttacttttatttctgccaatagaattcaatctcaggcccccgagttaccaggacactgtcttctataaatcggggctctggggtttcttgttcccaggcaacccagggccaccaaggcctaagcttgcttgttggaggtgtcagagcagagtccaaatctgaaacaccctcgagcagctgtcatgccctaagctcttatcagcgagtgccatatgtccttgtttagcaaaaggtagttaaaagtgtggcctgagatttaaagaaaaggagagatgtttgctctttgaaataagagagccattggaggttctggaaaaataattctacagtttatttagaaacagttctgactggcacctaagagagggcaaggagtgaggtggggagactaaaagggggagagaccggcttaggcctcaggaaaagcaggccgaagagggtgtgacaggtctaacgctggcctgagcaaggtgttgggtatgaggctgggcaagcagtaggagaggtgagtggtttaagaccagtcaagttggcagagagcctctagtgctgcccctggcactcactgccctctgatctgtagcacctgcaggagcgtcccttccagggattccccgtcttctagggaagctatggaggactcccctgtttaaagcatatggcaagataactcaggagggccagggaaagagggaggctgagcatatgccaaggggagaatggggaatgtcattgctgttgctagtgaatggtgccagggaggtccttccaaggggccacttgccacttggagcttcagcccatgaggccatccttgaaccctgccatgtggctcggcagacagccaatactgcctgaagggggctcagatggaatggcagggctgggctgttgccagtaattggtgttaatgactatgacagtggctttgacatggatgagatggagttggggtacaacccaaagcacactgctcttggcacccgaaagacctgggttgcagttctagcccctcatacctgcaaagattttggaaagttacttagactctctgtgcctgacatctgtttcttcatctgtaaatgaagactggattttttgggagaattaaattagttaacaggtgttcagtgcctagctcagaataaatgctcaatatttgttagctatacttactattattgtctgagccttggtttatatcatctgtcaaatgggcgtgatactatgtcatagggttgttgtaagggttaaatgaaataattaatgtgaatttatccaacagtgtgtgaagggtgtaaagtactcaaagtgagtcaattgaaatggaaaatttcacaaaatacctgcatgtaaaaatcagcggctgagcaggtggatcagctaacatttttggaaagttattctaaaagtactgtcagaggaacctttatctacttatggaaagtggggctcactgcccatggggataccctgtagttattttatgttgttgtattagttgcctattgctgctataacaaatttcacaaacatagtggcttaaaacaaccctaagatgttatcttgcagttctgaagttcagaactcttaaatgggttttgtagagctaaaatcaaggtgtcagcagggctctgtggttccttttgtaggctcttgggaaaatgtctttcattttctgacttctaaaacctgactgcatttcttggctcttggttccttcttccatcctcaaagccagtaacagcatcttccaacccttctccccatcctgactctcgtgtctccctcttacaaaaccatacctagaaaatctgggctaatcactgcatctcataattcctaagttaatcacatctccaaagtccccccgtttttttttttcaagacagagtctcgttctatcgcccacgctagagtgcagtggcgtgatcttggctcactgcagcctccgcctcccaggttcaagtgttctcctgcttcagcctcccaaatagatgggattacagccatgagctaccacacctggctaattttttatatttttagtagagatggggtttcaccgtgttggccacgctggtttcgaactcctaaccttaggtgatctgcccactttgtcctcccaaagtcctgggatcacatgcgtgagccaaccgcacccggcccaaagtcccttttgccatgtaaggcaacacagtctggggattaggccatagacatctttgacatattattctatctgccagaaatattagagtattagattgggcatgatggtaagaaaaactatttagaaaaaagaaagaaatattagagtattagagaaaatgatctaaatcaaagagttttagctcacttctgtttagggcttctccctgtaccctcccagttaggtgagtttgttttcacatctctttttttcttttttttttttttcccagacagtttctctgtgttgcccaggctagagtgcagtggcacaatctctgctcactgcaacctctgcctcccaggttcaggtgatcctcctacctcagcctcccaagttgcaacaccatgccctgctaatttttgtatgtttagtagagacagggtttcaccatgttggccaggctggtctcaaactcttgacctcatgatccacctgactcagcctcccaaagtgctgagtttacaggtgtgagccaccatgcttggctgttttcacatgtcttaaagaccaaaagctcaagaccagaggggtcaaggctatggatcaaatgcttcttgaaactcagttcagaaatggctccttcctgtcctttttgggctttctccctccccttgagtaaccctcaaatttgtttcttttttagatttttgtaaaaactttttttttacagagacagggtctcgccatgttgtccaggctggtctcgaactcctgagttcaagtgatcctcttgcctcagcctctcaaagtactgagattataggcgtgaggcaccacgcctggccagtaaccctcaactttggcccttagaacagtcactgttgccccatcaacagcatttgttgacttttctagctgcttctcctcttccatttctagtgaaatagaaaaaatgccctcatgtccagagcaagatctctgtgaagcaaatcactctagtgacgtttgacctccctgagattcccagacggtgtctgtactagtttcctattgctgctgtaacaagttagcacaaacttagtgacttaaaacacagatttattatcttacagttctggaggccacaattctgaaatggttctcatggggctaaaaatccaggtgtcagcagggagaatttgttcccctgccttttccaacttccagaggctgcacgcattgctcggtttgcttccatcttcaaagccagcaatgtcaggctgcatccttctctcactgccacacctcagatctctcttctgccttcctcttcttcttcttcttctttttttttttttgtttgagacaaggttttgctctgtcgcccgggctatcatgcagtggtgcgatcacggctcactgaaacctcagtctcccgggtttaagtgaccctcttatttaggctcccaagtagctgggactacaaggattgtgccaccatgtctggctaaatttttttttaattttaattttttgtagagacagggtctctctatcttgcccggctgatcttcgactcctgggctcaagcaatcctcctgccttggtttcccaaagtgctgggattacaggcatgagccaccatgccctgacctcttctacttttttttttttgagacagagtcttgctctgttgcccaggctggagtgcagtggtgtgatctcagcttactgcaacctctggctcctgggttcaagcgattctcctgcctcagcctcctgagcagctgggattacaggcgcgagccaccatgcctggctaatttttctatttttagtagagatggggtttcaccatgttagtcaggctggtctcgaacttttgaccttgtgatctgtccgcctcgacctcccaaaatgctgggattacaggcacaagccaccgcccctggcccctcttctacttttgaggacgctcgtgattacattggcccacctagataatccaggatcatctccccttttttaaggtcatctgattagcaaccttaattccctttgccatctaacatcacatattcccagcttctgggaattatgatgtagacatctttggagggcaattattctgcctgccacaggacctgagaaggagttccaaatagtgtccgcctgggctgcctcattcttaataaccacccccttccagaatgtgcacaatggcccactcaagagagaacacctgttaaactcttcaaaatttctcccgcagctctcaggtctctcagtccctctgttggtggaaggatctgagggcaatagagcctggaactgcacactttatttgttaagttaatttttttcttttaaatcagaggaacatataaaaaggtgcacaaatcatgagggaaatctcaatggagttttacaagtgagcactctccactgtcatgtaactgcccccaagatctgcacccatagccccctttggaccccaaataaattatcgtcttcccctaaggcaactactattttaccttctatcaccataggttaattttgtctgctttatcttactttattttttatttttattttgctctctggatctgtgtagagtatttgcctgtttttttttttttttttttttttgaggtggagtctcactctgtcgcccaggctggagtgcagtggctcgatctcggctcactgcaagctccacctcccaggttcacaccattctcctgcctcagcctcctgagtagctgggactacaggtgcccgccaccctgaccagataattttttgtatttttagtagagatggggtttcaccgtgttagccaggatggtctcgatctcctgacctcatgatccacccgcctcagcctcccaaagtgctgggattacaggcgtgagccactgcgcctggccgagtatttgcctcctttttaagcaaacttctctttttttcttttgagacatggtctgactgtcgcccaggctggagtgcagtggcatgatcctagctcactgcaacttcctggctctagccaacctcccacctcagcctcccgagtagctgagactacaggcatgtgccaccacgcttggctaattattgtattttttttttttttttttttgagacagagtttcgctcttgtcacccaggctggagtgcaatggcgcaatctcggctcactgcaacctccgcctcccaggttcaagtaattctcctgcctcagcctcccgagtagctgggattacaggcatgcaccaccatgcccggctaattttgtatttttagttgagttgggatttctccatgttggtcaggctggtcttgaactcccgacctcaggtgatctgcctgccttggcctcccaaagtgctgggattacaagcatgagccaccgcgcctggacaattcatgtattttttgtagagacagggtctcacaatattgaccaggctggtcttgaactcctgagctcaagcaatctgctcggctcagcctcccaaagtgctagcattacaggcttaagccactgcgcctggcctacaaacttcttattgacgtatacatacaaaaaagtacactaatcaaggaagcagctggattagttttcatgacataaacccatgtgtaaccagcattttgatcaataaatagaacattgccagcacccagaatccccgctcaggctctttctgtgcactaacaagccaagtctaaccacaatcctgattcctatgattgtggatacattttttccatttttgaatgttattttgttcaatgttatatttgtaaatttctcatgtaattaatatgccgtaattaattcttttttattgctgcgtaatatcccattatatggccacaccacagtttttctgtactattgttaagggctgttgagattgtttccattcacacttctttttttttttttttttgagataaggtctctgtctgtcacccaggctgaagcacagtggcatgatcgtagttcactgcagcctcaacctcctggtgctcaagcaatcctcccacctcagcctcccgagtagctgggactataagtgtgtaccaccatgctcagctaatttaaaaaaaattttttgggggggccaggcacagtggcttatgcccataatcctaacactttgggaggccgaggcgggcggatcatctgaggttgggagtttgagacctgcctgaccaacatggagaaaccctgtctctactaaaaatacaaaattagccgggcatggtggtgcatgcctgtaatcccagctactctggaggctgaggcaggagaattgcttgaacccgggaggcggaggttgcagtgagtcgagatcgcgccattgcattccagcctgagcaacgagagtgaaactcagtctcaaaaaaaaaactttttttttttttgtagagatgaagtctcactatattgcccagactggtctcaaattcctgggctcatgtgcttctcccacctcagcctcccgaagtgctgggattacaggcatgagcttctgctccttgcctacttcattttgaaagggagtgactacctacccatatctcagttgtcataaatgcaattccacctgcagaaattcaggaagggaagattgtatttagcactggtgccaaatgcattcattaggagagacttaaaaacagtctactggttaggattaagttcagctgcaagttacagaaaaaatgaaatgacagtgggttaaagaaagaagtttatttctgtcttgtgttcaagaagtctggagacagtgagtgtccaaagtgtatgtggggtaaggccccatgccctgtgcctggttgcttttagcatgcatagcttccatttccatgcagtctcacccaggatttcgggatgactgctgagtactaaaccaaaaaacaaaaacaaaaacaaaaaaaaacaaaaccgatgttagagaggcaggtaaggcatttgaaaacattgttttatggaaaaaaaaagttatggaacatttataaaatgaaaaaagcagttttttctaaattaacacattattttataacttaaaatgttttaaatatgtatttgtgacttaactgatacattattataagtagatacttgatatttcatctatatcctttaaaatattcaagctgaccaagaaattgtatgtggggtcttccaatcaggaaaaataggagccaggcacagtgcctcacacctgtaatcccagcacttgggaggccaaggctggaggatcattgagcccaggagctcacggccagctggacaacatggcaaaaccccatctctacaaaaaatacaaaaacgtgggggtactggtgtagtctcagttactggggaggctgaggcaggaggattgcttgagcccaggaggtcaaggctacaatgagccattattgtgcaactccaacctgggcagcaatgcaagactctgtctcaaaaaaaaaaaaagaagaagaagtccaggcatggtcgctcatgcctataatcccagaactttgggagagcaaggcgggggaatcacttgaggtcaggagttcaagaccagcctagccaacgtggtgaaaccccatctttactaaaaatacaaaaaattagctgggcatggtggcgggtgcctgtaatcccagctacttgggaggctgaggcaggagagtcacttgaatctaggaggtggaggttgcagtgagccgagatcatgccactacactctagcctgggcaacaagagcgaaactccatctcaaaaaaaaaagaagaagaaggaagatgttatcctcctattacagtcgcctacattcaggcaaacatagtacgtagaggaagacatggacttgactttggtactttttggatgcagaaccagggccattttgcttcaactaatattttgttaattaatgaaagatcaataaatatgtttgttcaaattaataattttaaaaaaatttattcacacaatttggtacctagcacaagaagcaaacagaggtgacaaggtgcatgctgcagcagacaacaaacccattgtcaggggtctatgaagcagtcagttctcattagaaaaccgagagaatattttacagcatgagtgacatgtgagctgaggcttgaggactgaatgcaatttcgatgaatgtagaatgtagaaatttcagggtgagggaccggcatggatggaggcgccccgctatgacaagagtctgagttcttcaagccctaatggggaggctggggtggatgtgggggccaccatggtcagagaggtgggcagtggccagtcaaggagggccttgaatgttaacattgcacagtgaggccacaggcagattcaaaatcacaagggaagggccagtagatgagggacccaaggcagggagggcagttctgaggctcctgggagtctggctgagaaagggtgtgggtagaacattcgctgcagcagtgggaactgtcaggaggcctggacaggggagctgtgcagaggtgggaacaccagaatttatccactcacaaatgtgttgaggatacagaggacacgtggaagctggctcccaaatttctggcctagatggctgggcagatggggttagcatgaccatgaaaggatttgaggaaaagatgactttgtgtctggacaggctgaattggcaagcaggcctgcaccactgggtggaagttacagacagcatcaggtcaacatcgcggagaactgaggtctaacatttagagctgcctgaagattgtggatggccttgaatcctagccagaggttgtcttcccatttgctagggattccaggattaggtggaagacaggaaggtacagcctgaaattcacacagctccagtattgtatgattctctgtgaactcatagaacagttggtgtgcatacctggtatgctgacaaagagatctttggcaaaactattgagcctgatgtctaggaatttatcgttagaaaaatctttctttcttttttttttttttttttgagaccaagtcttgcattgtcacccaggctgcagtgcagtggcgccatctcagctcactgcagcctctgcctctcgcgttcaaatgattctcctgcctcagcctcccgagtagctggaattacaggtgtgcaccaccatgcctggctaatttttgtatttttagtagagatggtggaacaggaattaaaagaaattaaagaatatgtgtaagcagaagctcagttgtatataagaaaactcaattccccctgagaaagagaaagagctggagtcctttaaaaattaactgcctgtttttctgtggctagtgagccttatctctcctcctctcccaggcattgtgaagaccctgtttctctagctgtgcagctgcaaggttactagacagataaactcaagtcataaaacatgtttttccttggaaagtaagaaatgatgtaatgcatgtctctcaattaattgaattattgtctttgtttcttgctgtaatatgcttccccctgcacagatctccccacaccccacgaaatgcttaaaagctaacttaactctttgttcagggctcagtcctttggatgttaatccgactgggctgatgcacacctaaataataaatatcctcctcaaccccattggtctctctgattccttaaaaaatcctgctacaatgggatttcaccatgttgtccaggctggtctcgaaatcctggcctcaagtgatgcatccttcttggtctcccaaagttctgggattacaggcatgagccaccatgcccggcctgaaaatcttattcttaacaagtagactgactgcctgagaggtgccagggtagaatattgtctctgccagttaacaagttctgaggccttggagaggtctttccacctataaatcttagtgttccatccatcaaatttggaactcatccacctcacagaatgattgtggggatcaaatgagatgatactgtgaaaaatgcccagttcactggctgtcccatccagacacttaataaatattagtgtcctgtcccctttctctttttgtctggaggtggggttaccactggagaggggatcttgccaccttcttcaggatagcaggatcttgccaatggtctggtttagattgagaaacttggctcccaggccatgcctcttattttatggatgactagttaaagcccagagagttgttacctaggtgaggtcatgcaggtgtgcagaaccaggcctctggtctcaaggcccacaccatacagttctggctctggagggaattctattcgcctgtggatttacttgcaacagtgatgcttagaagaacccgtagttaagacagaataatcttctctctcttcccccacccccttggtgaagttaaatgaaaagactcattgtcccatggagaagagaaaaactgttaaaacaaaagtcaaagccgttgtattattttaaaatattctttccatgttcccaaatgcttcatggaatctgttcggactgaattaacctctctatttctcagcacagaaattcttctcagatgcccaaaaatgaaaggaactgttctcaaatatcattccattttccagttagaaatgggtcctgatcttcaaatgctgacagctgtaaatgccaaactgagaaacaaccattgagatggatacatgcactgacttatttttttcttgtttcactgccattgcagtttttaggaaaaaatctatcttgtctggtactgatattgccacactgattttatgttggcatctatatggtatccttttcccattcctttattacttatctttttttttttttttttttttttgagacagagtctcactctgttgttgcccaggctggagtgcaatggtgtgatcttggctcactgcaacctctgcctcccgggttcaagcaattctcctgcctcaccctcccaagtagctgggattacaggtgtgcgccaccatgcctggctaatttttttgtatttttagtagagacggggtttcacaatgttggccaggctggtctcaaacttctgacctcaggtgatctgcccgcctcagcttcccaaagtgctgggattacaggcatgagccaccatgcctgacccttattatttgtctttttcacaagcccacagttaacatcataattcctttttttaatgtattatttttaatttactttctttaaaaatattttatattaaaaatatttctacttaaaggaactttagaagatttcatgttagttttcaagtcactgtaagattttctttctttttttcttttttttgaggccgggtcttgctctgtcacccaggctggggtgcagtggcagtgatcatggctcactgcagctttgacctcctgggctcaagcgattctcccacctcagcccctccctcgagtagctgttctaagttttcttcctttgtgccaccatgtctggctaatttttgtatgttttgtagcgatgggatttcgccatgttgcccaggctggtctcctgggcagcatgacctgcttaccttgacctaccaaagttctgggattccgagtatgcaccaccgtgccgagccaaggttccagtttcttcacatcttcaccaacacttggttacgtcagtcttttaaaaattgtttttaaattttttcatattcctaggtcactattatactcttttcaatatactcttttcaattttatctattccagcagatttgttgtggcgtcttattgtgcttttaatttgtatttttctaatgactaaagatgttgaacgtgttttcatatgtttatttttcatccgtgtatcttctttggtgatgtgactattcaaatcttttgcacattctgaagtgggtttatcctcttctaattgagtgataagagtttacatagtcccggccaggtgctgtggctcatgcttgtaaacctagcaccctgagaggccaaggcaggcagattgcccgacgtcaggagttcgagactggcctggccgacatagtgaaacctcatctctactaaaaatacaaaaattagcctgtagtcccagctactcaggaggctgagacaggagaatcgcttgaacccaggaggcggaggttgcagtgagccaagattgcgcgattgcactccagcccgggtgacagagtgagactctgtctcaaaaaaaaaaaaaaaaaagtgtatatagtctggatagaaataatcgatcagatacatattttacaaatattttctactagtctgtaacttgtcatgccattgcactttgtttgtttgttttgagacagagtctcattctgttacccaggctggagtacagtggtgtgattatggctcactgccacctcgacctctcgggctcaagcaatcctccagtctcagcctcccaagtagctgggactgcaggtgtgtgccaaccttcccagctaatttttttttttttttttgagacagagtctcactctgtccccagactggagtgcagtggcatgatctcggctcactgcaagctctgcctcctgggtttacaccattctcctgcctcagcctcctgagtagctgggggactacaggtgcccgccaccacacccggctaattttttgtatttttagtagagacggggtttcaccgtgttaaccaggatggtctcgatctcctgacctcgtgatctgcccacctcagcttcccaaagtgctgggattacaggcgtgagccactgtgcctggcctaatttttgtattttttatagagacagggttttgccatgttgccctgccttcgcctcccaaagtgctgggattatgggcatgagccactgcaccccagccttttgccattacattttgataaaaagaaagttttaaatatttttagatactaatgtgtatttaacaattatgggtttgtatgtcattattaggataatatacataagtaagcataaaatctgtctaatatacattaagtggcttaatatgacaaaattagcagtgtatactttcttttttttctttttttttttttctgagatggagttttgcttttgctcttgttgcccaggttggagtgcaatggtgcaatcttggctcattgcagccttcaccttccgggtttaataaattctcctgcctcagccttccaagtagctgggattacaggcttgcaccaccatgcccagctaattttgtatttttagtagagacgggatttctccatgttgatgaggctggccttgaactcctgacctcaggtgatacacccaccttagcctccaaagtgctgggattacaggtgtgagccactgcacccagtcaacagtgtatactattgattggtttgattacagaataataccaaaaataataacagcaacaacaggccgagtgtggtggctcatgcctgtaatcctagcactttgggaagctgaggtgagtgaggagttcaagaccagcctgggcaacatgatgaaaccccgcctctactaaaatacaaaaaattagctgggcatggtgtggcgcaccggtagtcccagctactggggcggctgaggcatgagaattgcttgaacccaggaggcagaggttgcagtgagccaagatcgtgccactgcactcctgcctgggcgacagcgagactctgtctccaaataacaacaacaacaacaacaacaacacggaatagctaacacttaaattcagcactttctatgtgccaggcagtgtttgaagtgctttaaatatatctacatatgaaccgattgattctatataacaattaggtctactgttatctccgttttaaagatgaggaaactgaggtcaagagagggtaagtaacctgctcagggttggacagctagcattattttgctttgtttatttttaactcctcactcttcacctatcctcagtgccttttggttagcaatggtgacttgaaaatacaaacatttcttgaaatccacagtaaacccaaaccacatgcaatgatgtttgttttttggaaatgatcacacaccacatcatattccaagtgttgagtgcatatgcctcggagtggaagtgggccttgagagcatgttgtatacattttgaaacaaataagcctagactttttatctgctcggtttggagaaaggggaatagcaataaaatcataaatcacatataaatgatgtaacacactgaatagtgttttataaaataaggtgagggcatgatggtgcacacctgtagtcccagctactcgggaggcttgggtgggaggatcactggagttcaggagttcaaagagccagtgagttattgtgccactgcactccagcctagatgacagagtgagaccctgtcctcccaccactaacaaaaaccctgagatgataaatagcaaggcagcttgaaagtaaatagtaagtttaggatttgagaaaggggcaagatgttctaagttttcttcctttgttcagaaggaatctcagagttaaagctatgaaaagggatcaatctaattagtaaagagtttaaataggctgggtgtgttggctcacacctgtagtcccagctacttgggaggctgaagttgggggatccctcgagcctgggaggttgaggctgccgtgagccatgatcacaccactgcattctagcctgggtgagagagtgagaccctgtctcaaaaaaagagtttaaatggtttaaaaaggggggtgaggagagtagttatttgtaatgagctagtgcaggggtccccaacccccacccggaattagtccatggtctgttaggaaccaggccgcacagcaggaggtgagcagtgggcgagctcagcttcatctgtatttacagccgctccccatcgcctgtgttaccacctgagctctgcctcctgtcagatcaccagcaccgttagatccattagattcttttttttaaattgctgctgcacaaattaaggcattagattctcataggaacatgaaccctatcatgaactgcacactccttatgagaatctaatgcctgatgacctgtcactgtctcccgtcactcccagatgagaacatctagttgcaggaaaacaagctcagggctcccactgattcctacattatgttgagctgtataattatttcattatatattgcaatgtaataataatagaaataaagtgcacaataaatgtaatgcacttgaatcatcccaaaaccacccccacagctgggtctgtggaaaaattgtcttccacaatattggtccctgatgccaaaaagattggggaccactgagctagtgggttctggaacttcacctcttatgagcgatgtaaccttgggcaagttacttctctgagatactctataaattaaatcacttaatacgttgaaggcacttggcccagtgcctggcacataggagatgctgaataaacattcactatttttaatataatcttaatgcatagtaaaattatattaaaaagagtgagctagttcaatacagcaagtgtgaaaaactggactctgaaggttgacaggcccaggtccattcccaggtcaatttctggaagcaatttgctgaacaaacagttcgctgaaatagtgaggtttttttttaagttttgaaacatggtccctgccccacccctgccctgtccctgcctctgacaaagaaagaactatggcatttcatgacttgatttctggggattttcctttcagttttctactaatcaatgcattggaaaattgacctgctagtcctgggtttgaatttgttttacctttttttttttttgagatagggtctcgtgctgtcacccaggctggagtgtagtggtgcagtctctgctcactgcagtcctgggttcaagtgattcttgtgcctcggcctcctaagtagctaggactgcaggcacgagccaccacacctggctaatttttgtatttttagtagagattgggtttcgctgtgttggccaggctggtctcaaactcttggcctcaagtgatgtgcccaccttggcctcccaaagtggtgggattacaggtgtgagtcaccacacctggacttttttaactttttaaataaatttaaattttttttttgtagaaacgaggccttgctgtgtggaccaggctggtttcaaacttctggcatcaagcaatccttctatctaggcctcctaaagcactaggattgcagacatgagccatggcacctagacttgaccctgggtttgaattctggctctgacacttgctaactgtgtgtgaccttgggcaggccactgacccttcctgagccttatgggaatgtgggaataatattaggtaatggagcaagttaatataggtaaagaatttagaatagggcctggcacatggcctcagtctagtaccagagtccaagcccataaccactgtgccaacactcttgtaataaatgtatgtgggagacagggaggctgggaggctggatatgtgatgctactttatgtcaactacacatgaattttatatgtataatttatataaactaattgatgccatctactattattagactgaacaaatattgttacttggaactctcagatatgtaatagcttttttttattcaaatccaaaatgtaaaatgtgactatgagtaattgataatgaacttaactgataagaaacttcaggatagatttttctcaagttttccattcagtcttacagtgattaaagtgatgaaaaattccaactatgcatgccctgctcggagcgtccaagaagagcctaccaacgggggctacttaagctctcaaaggccaaacacacaaacggcattttgagtgcaagtggtctgtttgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctgggtgagtggtggtgctcacccccaaaagtgggcaggtgggggtggtttggggagggctcagggacagggattggtgactgtttgagaagctttcctttccctgggtccttgttggatgtgctgggcctggggtcctcactggtggtgaatgcatccggagttgagcacgtggttgcacacgagttttcaaaataaacttttctttgaagcctttaattgaatctgaggcttatggcttttctccaatattcagggcaagatttctcatctgaaaatgtccttgttgttggacctatctgagcaaaggtgttatgaaaattttttattgggtttgcccagctagatctgttaataatgcttccctgcatggcagcagggaagtaagagctgggccagaagagaggtggggacattgtgaactgaatcgaggtattaggaatggaaaatgccaggggtctattcatctgatccagtgaacatttttcctagaaaaaggaaatgtcatgaaaacacacggaaaacatgtaaatcagctgattctaaacaagggcattggtaagcctggcatgtggaggttataggaaggttgggcagtgccaagagaatgagttttggcattgacctgggttcaagtcctgcctctgctactttccagatgtgatataacctccctgaggctatagatgtgatataacgtaggtgatataacttccctgaggctcagttttatcatctgtaaaatggaagtgtgaatgccaaccttggaacatttctgagaaataaatgaggtaatatacatacattctaggtactcagtaagtaaaagctttaccacaactgtcattctattaagttctttgaaactgtatttgacatttataccttgttggccagccactcgaatctgaccccctgcaaaggctactaagagaactgcccagtgacctggtagcctcagtggcatccgaaattacaatcagggaccacagggacctaaagagccctgttttcagaggtcagaatctttattgatgttaactaagtgaggaccccagtgataggtcttccaggttcctgaaagtccttgtttccatagtgatgtaaacaacacttttgcaaatgtgaaaaggagtgggaagtgtttagtatgttaattgaaacgttttaaaaaagaaattccaagatgataaacaacatctctctctctctctctctgtctatatatatatatatatatatatatatataaaactgatgatgcacacaatcttggctcattgcaacctccgcctcctgggttcaagcacatctcccaccacagcctcttgagtagctgggtttacaggggcacaacaccacgctcagctaatttttgtatttttagtagagatggggttttgccatgttggccaggctggtctcaaactcttggcctcgagtgatctgccatctcgacctcccaaagtgctgggattacagacatgagccactacgcatggccaagatacctgatttctggatcaccagcagtaactgcccagttgggtttctgatggggctggtctcaggaaaagccaccacacacttgcctggaaaagcacactgcttctctaggctccaagtctctctctccctcccttcctccctctgatacacacacacagaccacatcacccccaccttccctggttgtcagcattcactgtcgtcctcctttgcctagaagcccattttgctaaaggcaccaaccctgcatccagcattgattccttcttctcatttttcaagagaatgtgtcagagacaaagaggaggatggggcacaacctatctttcccaccccaagactggaagtgggcatgggtgttttcactccgtgagctgtgcaagtggctgctcccagatatgctggagggctgcttggcttatgaaaatggtggagtgggccggacatggtggctcacacctgcaatcccagcactttgggaggccgaggtgggcggatcacaaggtcaggagttcgagaccagcctgaccaacatggtgaaaccctgtctctactaaaaatacaaaaattagctgggcatggtggcgggtgcctgtaatcccagctactcgggaggctgaggcaggagaatcgcttgaacccaggaagtggaggttgcagtgagctaagatcgtgccactgcactctagcctgggtgacagagtgagactctgtctcaaaaaaaaaaaaaaaagaaaatagtggagtgacaatcatgaaaccagaaagcaaacactatagctgtggcctggattctcaagtgcaatctgcttttttttttctcattttgatggggaacaaaaatggaaaagcatgctcattggtagtccttgccccgagggtatgaccttctcttcattcttagaataatgtagtgttttgtattttatgcatgtttgcttctcttggctcttggactatttgttcagaatatggcccaggccacatttcactttttaatggcaaatcattttggctgaagttatggcatccactggcatgatggattttactggttatttgcttgcaagtatgttcctgaaagtttaacagagtagaaacagcagaattgtttcttaggttaattttttttgaactttctgggttttaaaaatgtttatcttttatgtttaaattcaggtcagagtctcagtaacaacttgagtcagtttgaaaaaataacgcatgtatatatccaccatcctgtgaacatctgtgggctgttcactcggcagcctgtgatgtctgtccacatgggcttatctcttacctcattcatttatctggaatttctactctgtgccagatgccggttgggggtgtgggggtagtgtttaagatgaatagacaccatcaggaggtgcacagagtagtggaagagacaggcatgtgaaaagatcattaatttggtagaatcggtgtgcaaaagtagaggcatagctacattatagctcaactctgcctgctgagcaggcttagtgtaaggcagtggttctcaagctttggtctcaggatccttccttttacgctaaaaattatttttattttattattttattttattttattttgagatagggtctcactgtctcccaggctggagtgcagtggcatgatcatggctcgctgcagccttgacctcttgtgcttaagcaatcctccaacctcagcatctcaagtagctgagactacaggcacatgacactacgcctggctaatttttgtattttttgtagagacagggtttcgccatgttgtccaggctgatcttgaactcctgggctcaagcgatcctcccccctcagtctcccaaagtgctgggattctaggcgtgagccactgtgcccagccaaaaattattaaggatcccaaataacttttgtttgttttttaagaatcctgaggacaatcaagggagctttgtttatgtgggttagatctattggtatctacctgatcagaaatttaaaaataacaataataaaatcagaatgtgttaacaaactatatatgtataaaaaactatattttctggccaggtgcagtggctcatgcctgtaattccagtactttgggaggctgaggtggaaggatcacttgagcccaggagtttgagaccagtctgggcaacatagggataccttgtctctacaaaaataaaaaaatgaggccgtgcacagtggctcacacctgtaatcccagcactttgggaggctgaggtgggcagatcacttgaggtcaggagtttgagaccagcctggccaacatggtgaaaaactgtctctactaaaaatacaaaaattagcctggtttggtggtgtgcacctgtaatcccagctactccggaggctgaggcaggagaatcacttgaacccgggaggcggaggttgcagtgagccgagatcacaccactgcacttcagcctgggtgacaagagtgaaactgtctcaaaaaaaaaaaagaaagaaaaaaaaaaattagccgggtgtggtggtacacacctatagtcccagctaattgaaatgcttaggctgcaggatcacttgagccccagaggtcgaggctgcatgagtgagccgtgatggtgccactgcactccagcctgggtgacagagtgagaccctgtctcaaaaaaaaaaaaaaaaaaaaaaagaagagtagcaccgttttacagttttgcaaatcttgtaacggtctggcttcgtagaagacagctagattgtcatttcttgaccattcaatctgtcatgaaatgttttcgttagattatatgaaaatgcatggatatgtagttggaaaagggaagagcatttaaatagccttttcatataattgtgaatgttctttgatactacaccaaaacttgacaaagagtagtttcttaaagtttagttgcaatgtgaaatctaaaatcagatcaataaactttttgttctctatatacccacaagagaatgagagtatgaaaggcaaacattcatgttattatggaaatagttctgacctcatggatcctctgaaaaggcctcagggacccctagaattccccaaactacacttgagaatggctggtttaagagaattgttcccagtgaaggtcctgcccacggagagccctgtgggacagcaggtggcagaggcatgaggatggagtgtggcagtggggctccgatgtggcgctgggtctgccagacaggtggtctgagctggagataaggcagcaataatttaggacctcgagggctccaaggaaggagttttgagcttcattttgcaggggtaggagctgtggagggctttaagcagtcaacagtgggtgtcgctttgtctttgcacccactgtactctccggacagacttgaccttcctgggttgtggcaaagagcagggatctaaatagcaggctgcaacaggagaaggaacgagcacctgctctagcccaaagacccctccaggccacaacgctggcaggtagagtcggagaatctgactgtgctgtacccagaaccctttggacttggattcttccccttgaccagccttatcagtggcacccatccccttccacactcctcgctaggccctcctcaagggggcgctaactggaaggcatgctgccccactgctaatggccgcctgcttcgtttgtgcacactttttctctttgttaccccactttcctatgaggaggtggacctgtctccagaacaaccagtggggtatatcagcctttttggaaaccttaaccctccttgcccaaactcccagagtattcttatttatttatttatttatttatttatttatttatgatagagtcttgctgtgtcaccaggctggagtgcagtggtgggatctcggctcactgcaacctccgcctcccaggttcaagtgattctcctgcctcagcctccagagtagctgggattacaggtgcctgccaccacgcccggttaatttttgtatttttagtagagacagggtttcaccatgttggccgcctgcctcggcctcccaaagtgctgggattactggcgtgagccgccgcacccggcccccagtgtattcttgattccctccactccacaaactactctacagtcagccagcttgtggtctctggtggtggtctgtcttatgaggtcttgttgacatatgcattcttttctaaatttaccaaactggctcattttatttctgctaactaaacttgaaagccttttcttttcctattatagactctcctttggatcaatactacacactcagaagttatgtttgtgttttaagagagcattttgtggcaatatggcatcaattctagaagtgggagacaaagatttaaaaggaagttggccctgcagtctggtcaggggatggtagggcctgagctccctcccaccccacaccccaccacacacactgctggaagaattccagaggtgttccagggtagacaccacagcatttagtaaaatttactcataacagttaatttactacttaaaaactaatgaagaaaatctaagaattcacctttttttttttttttttttttttttagacaggatcttattctgttgcccaggctggagtgcagtggcactatcatagctcactgcagcctgagctcaagcgatcctcccaagtcagcttcccaactaactgggactacagtcatgtactaccacgcccaactaattgtttaatttttttgcagagacagggtcttactatgttgcacagactggtttcaaattcttggccttatgcaatcctcctgccttggcctcccaaagtgttgggattacaagtgtgaaccattcctcctggcagaattcaccttacacagccccaaattctgctcttggggaatcacagtgtattaagagacacttattttcatttttgcatgtatctctaaacctgacatcaaaatattcataaaattgcaatacgtttcatataatgagctgaaacctcctaagtgagcaatgtgaagttgttggctgcctggagaattaaatgtaagcatggcctgctctgtgttgctaatggaaatttttacctaggttgatatttattaacccccccttttttttttgagacagagtcttgctctgtcacccaggctggagtgcagtggcgtgatcttggctcactgcaacctccgcctcccgggttcaagcaattcttctgccttggcctcctgagtagctgagattgcaggcgcccgccaccatgcccggctaatttttgtatttttagtagagacggggtttcatcatgttggccaggttggtctcaaattcctgacctcatgtgatctgcccacctaggcctcacaaaatgctggaattacaggcgtgagccaccgtgtctggctccaacctacatttttaaggcttagctgccactcaatggatttctacatcccaaaacaatacctttaattgacttttattggcctcctctgtgaaggacggaaagcagatgccagaagccatgagaggctctggctctccgaccaacccgtggaagccactagtcttaaatttcctgaagccattttgccatgattaaaacttttgtctccttccctgagctttccagagctttgtccattctcttccttctacctggaatatccttccccagacaagacccattctcatccagggccaggtcaaatgccacctcctccctctccaggcaagacctccattgagggaccacacacattgcaggccctctgccaaagtgccaaccctctctgccttacattccaaggggtaatagtgatacttacctcagagggattcacattttagctatttttgcacttgtctcattttactactagactgtctcttcaagatagggactgaatatttttcatttctcatagcacctatgaaaggcaactctcatttactgagcccctgctgtgggttgggacgtgttatctcacctaatccatagcaggagcaaacactgtaaggtaattcttgttatattctattttcagacaaggaagctgaggctcagataggttaagcagttttggcaaatttgtcaagacttctgcaaacctagacagaaaaggtgctcaacccccagcccctttatggaaaggatgcatggcttaggggcagatatgcgttggagcaaagagaaagacacgcgtactcttgaatgtactattttagcccctgcttgctccttgacccagagtttttgtgtagaccatagaatgccctgcccatctgtatttggaggtgctgctgcagccggtcacacctgggttctactgacctccagccctggctgtggtcctgcccagggctcagtgtgtattgaacaagtaagtgaatgagacatgcagaaggctgatttcattcttatttgaatgatttcaatcttgattaaccttcttagcaagaggttattttcttctcctggacctcagttcattcatctctaaaagaaggaagttgaagtcaatgatctctcaggtctcatctcagatgtggtgatgtcaccaattcccctgacatcccttctatgtgggaaccctgatgaaatccgcagctttccctcactgtgtccaggtaggaaagccaaggaggaaccatattctggaagccaaggaaggagaagttttgagacacagggtggtcagtaggatcaggcaggacaacagggatggggcagtgggatcaggtaacacagcagggctgggcagtgggttcaggcagaacagtgggctgggcaggggatcaggcaacacagcaaggttaggcagtgggatcagataatgcagggctaggcaatgggatcaggcaacacaacagggctaggcagtgggatcaggtaacacagcagggctgggcagtgggatcaggcaacataacagggctgggcagagggatcaggtaacacagcaaggctgggcagtgggatcaggcaacacagtagggctgggcagtgggatcaggcaacatagtagggctggacagtgggatcaggcaacacaacagggctgggcagtgggatcaggtaacacagcaaggctgggcagtgggatcaggcaacacagtagggctgggcagtgggatctggcaacacgacagggctgggcagtgggatcaggcaacacagtagggctgggcattgggatatggcaacatgacagggctgggcagtgggatcaggcaacacaacagggctaggcagtgggatcaggcaatatggccgggctgggcagtgggattaggcagtgaagcaggggttgttaaacttcattgtgcatcaaaagctcctggaaggcttgttagaacacagattactgggccctgtgctcaaagtgtctgattcagtaggtctgggttggagcctgataagtggtattcctggaaacctcagtttgagaactattactgtagagaaacctacaaggttgggtgggaatgggcaggaggaaaagatactagaagaagatgctgtggggcatgagccggaaagacaatacaagatgagtaacatctgcagagaattgcagctgcagagtataaactaactgtaatctaggtccagcccttctgaagctttacaaataagctgctagcattgtccagccttatagggaattggcaaaaggtgagtttcaggcctacatgggagccagcctcttacagcacagcagttagcaatacacatctaaagaactaagtagctggcatgtgtctttatcatcagaatagattatacaaatgaaggtcgatgcattgagcttatcaaattgttttaaatatagcaacgtttgttttaaaatttttttttaaacctttgaagtaaaactgcctctttttcagtgctcagctgcagtgcatcacgggcagtacaatgacagctggaaacatggaccccatggaggcgctgtcatggccgccctcagcacagacctgctgttccctatcaaattcatcctctgtgcctatgctctgtttaatatagatttttataaactgtatgaagtaaaattcttcattcctatcttgtgattaacgctggaagaatccaaaaagcacagcgtctgacctccaataagccataaagttaaaagcttttctaggcaatgaatatataacctgatttttttctcctacagatcctctctctccccttctttctccctttctcctttgtgtgaaactctttctttatccctttccttttctataaacttccttgatctttccctctccagtaccccccttcctcattcccttcttcagttccaggatgttctctcctcagcttgcccatatattttgcacctgcaactcatgtgtgtgtcagggagtagaggtgagggattatcccttccgtgagtgacagtcacctttcttttctttgctggctggtgcttttaggagacaaggtgtacaaccttacccctaaggagccagtcctgtccttcgtctctctatctaatgctaataatgataacaatagtagtgatgacggccgggtgcggtggctcatgcctgtaatcccagcacttggggaggccaaggtgggtgaatcacctgagatgaggagtttgagaccagcctggccaacatggtgaaaccttgtgtctactaaaaatacaaaaaattagccaggtgtggtggtgggcacctgtaatcccagctactcgggaggccgaggcaggaaaattacttgaacctcggaggcggaggttgcagtgagctgagatcacaccactacactccagcctgggcaacaagagtgaaactccttctcaaaaaaaaaaaaaaaaaatagtagtgatgacaagccaccatgtgccaggcactgtggtaggcagctcacacttcactctgcatgtactattatcccttaaatgtctcatacaaggtcattcaactactgagcagccagaggtagaattcaagaagcgaacttgctgttttctctacttaaactcttttatcacccaggctgcagtgcagtggtgcgatcatggctcactgcagcctcgacctccaggcccaggtgatcctcctatctcaacctcccaagtagctgggattacaagcacgcaccaccatatccagcaatttttttttttcatatttttttgtaaagacagggtttcaccatgttggccaggctgttctcgaactcctgagctcaagcgatcctcctgctgtggcctcccaaagtgttaggattacaggcataaaccaccacaccccgccttcttgaactcttttctataaccccacccaccctgttttatccagttgaattggactcatctttcaggtctcagtggaagcgcttctaatcttctaggttgggatttaataccccaactattgcattcccatggagtgctgtatgtccccaaaactgcacttagcctgtacagcaattgcctgcttaattgtctgtgtagttcgtcactgtaccagcatagctgagcaaggtgcctggtacacagcaggtattccataaatgcctataggaaaagtaaattaacggactcttcctcaataaatatatatatgttctagaaatttgagttgtatattagtttcctagggctgctataacaatataccacaaagtgggtggttaaacaacagaaatgtattgtctcacagttctggagctagaagtctgagctcaaggtgtcggctgtgttggtttcttctgagccctctctccttggctcataggtggctgtcttctccctgtgtctccacgtggtcttttccctctgtacctgtgagtgtccagacttcctcttcttataaggacaccagtcacattgaattaggctcgccctaataacctcattttaacttaatcacatctttgaagaccctaactccaaatccggttacctcctgaaggcctgggggtgaggacttcaacatatgaatcgcgggcagggagagggacagaagtcagcccatgacaagctgctttgcttttcactttcccagtttgtggaggacagtgtgtcatctttcaacatgtttctaaatagcctctttttcctttctgattcactttatgttcccacttcagggtgatatgagaaacgctggggaagcatgttcaaagacttgagcagtgggtcacttattactttaccatggcatatttcagagtcattaaagcagctccagcaagcgcagtgggctgtgcagccggaatcccagggctgaagatgggacaggagtgcaatctaaccaggatgtgaaaccaagtccaagtaaggtttttcaaaagccaagaattagaacgactaactcagtcctgtttcagtatatccaggggaggctgatttatagggaaagatgaaaggaggacaatgtgtatattttggctgctcagaagaccatggggctagacatgggggaggaggaagttattataagcctacagccagccaatgagtaagaacatcaaagaggaaggctggttggccagatggaccaagagctggggcacaggcaggatctttgggagaaacaagatgaatggatgcttcggacaacctaagttcagagcccggaggggcctttagaaaggcatgatggattatgtgtactgtgggtcattgcgccatgagaagtcccatgggggatgagccccagaggcccttaaagtcagggtggaccattaagtaaactgcggaggaatttcttccaggagggctcagacttggcaaaggctgggaagggctgctttccatctccggctcttaatcccccagccctgacactggggctcgcttgttccagcctacttgatccatttattgaataaagatatactgagaaccagccgggcgtggtgactcacgcctgtaatcccagcactttgggaggccgaggtgggcggatcacgaggtcaggagattgaggccgtcctggctaacacggtgaaactccgtctctgctaaaaatacaaaaaattagacgggtgtggtggcgggcacctgtagtcccacctactctggaggctgaggcaggagaatggcgtgaacccagaaggcggagcttgcagtgagccgagatagcgccactgcactccagcctgggcaacagagcgagactctgtccccgcccccccaaaaaaagatatactgagaacccttttattccaaggtctgcattaggcccagtgaaagatgaggaatccttaaatctttgggacttggtggggtcaccggggatacatcctcctctcctaggtaccgttcatctgtttgcacccagatgtggcctgtcccatgtgattgtcccaccactgaccgaagcaggcctctccattctcctcttccagttaaagctgaatttgtctccaaagtgaagaagaataggaaaaccatcaattttatggagctttttaactatgccaaaatggtttcattctgatacactttttttttttctttttgagatggagtcttgctctgttgcctgggctggagtgcagtggtgtgttctgggttcactgtaacctccgccttttgggttccagcgattctgctgcctcagcctgctgaatagctgggattacaggcacgcaccaccacaccaggctactttttgtatgtttagtagagatggggtttcgccatgttggccaggctggtcttgaactcctgacctcaggtgatccacccaccttgacctcccaaagtgctgtgattacaggcgtgagccactgcacccggccctgatatactattttgtttcataatttgcttgggtaatcattgattcatccattcaacaaatacgtatgaagaagctacagtgtacaaggctttgctttgggtgccaaggatactgcagggtcaggccagggtcacatctggctcaccaccagtcaggctttagggtttggtacaaattccacggcctcaggcaccatgggtgcataggatcagcaaaataagtccttaaagagatggaaaactcactcataaaaccatctgggcttgatgccttttgtagaggggatatatttgacaacaaattaaatatcttcaaaatccatttgtgcattcaggtttttcatttcttcttaagtctattttggtcattgatatctttctgaaaagttttctcatttgtctacattttcaaatctgttgttataaattatagctcataatactgagttacgttttaatagggaacatgtattttataaatacatgtttataaaaaatagggtcccactatgttgcccaggctggtctcgaactcctgggctcaagcaatcctcctgcctcagcctcccaaagtgctgggattagagatatgagccactgtgcctggccaggggacatgtatttgttttttttttttttaacaaaaagtacacagtgttaggccgggtgtggtggctcacacctgtaatcccagcactttgggaggccgtggtgggcagatcacttgaggtcaggagtctgagaccagtctggccaacatggtgaaaccccgtctctactaaaaatacaaaaaattagctgggtgtggtggcgggcacctgtaatcccagctacttgggaggctgaggcaggagaactgcttgaacccaggaggtggaggttgcagtgagccgagatcgcaccattgcactccagcccaggcaacaagaacgaaactccgtctcaaaaaaaaaaaaagaataaaaaaaaagacaaagaaaaaaagcaaaaagtgcccagtgttttattctcatagatcacaaagctcttagcaaaaattctgaagaaacactgagacctgggggatgggtgtgtgttgccgggagaggagtcgctattgcctcttgggtttctccgataacacctggcttttgtagaagatcttcacagtttttcaaagcacccatcccttgccttacctctcctgtctcccttgtctgcctgatgcctccaacttctcagaagtgccagggccagggcactgctgggcccatggtgtgggtctacattgcagtaaaaggctcgttacccactcccctcaacacaggagtctcctgtttttaggcagcttaagaaagcagtcttgtctgtggaggaatgcccagccttcttggtgcagatgctgggtttggggacccagctgtttgcaggagttgtctaggaacgtcagtacccagggactgtgagactcctgggatgttatagtccccatgctagcagagggaagacactgggcccatgagaagttgagtttaggtagccagtcctgctgggagaaaggaaagcctcagatgccagcaagcttgctgtccagccattttctgacaaccctgcttattgcaccatgtacagtaatcaacacagacttgcatctgctctgaggggtgcaggtggtgctccatggaacacacacatgcacgccttcacccaccctttcctgtacctttggaattcgtggcataggaacactatatctattgcacttgggtgtggttataatgccagggtaaagataagtttctctgtggagtacctgaatgacaagatcatattttgtgtcagttccacatggaagggctcttcctcacagacattggaagggtaacagtagaatctaagctctaggaaggcagggtttttttgttttttgttttgtttttgtctgcacatgatagacacttagcaaatatttgctggatgggtggacaaatggaaactggaatgaaatggagatgcctaggtgagtgtgggaaggactctgcctctcctggtctttgccctgtagatgccaaatatcctaggcgggaactgggaagttggcagatgctgctgtgtagagagtcagtggagcaaagactggaaaaacatccagcctgtgtcagctagcaaaagaggggttttgggtctattttggggtcagaatattagaggaggtaacctgtaccctcaggcttcagagtgtggttgactaggaggctccaaagagtaagtgaaacccaaggggacggagataggaccacttgatccatccttgtaggttcagagctatgtcttatcaaatgttttcccttcatgtagtagcatgataatgaactcttcctactttggtttgataatgcaatggattatatggatagattttctagtgttgaaccaatccttgcattattgaggtaaactttacttgatcataatgtactttttaataccttactagaattattttgctaatctgtttttgtatttagattcataaattaaactggcagatattccctctaattttcattttttgcactctctggttttggtatcaaagttaagttagcttcatgaaaataagttgtttttgtaaagtaggtattagctattccttaaagagctggcaaatttgttcataaaaccatctgggttgaatcccttctgtaggggaaatatgtttgaaactaatttaatttctttaaaagccattagtctatttgacttttctatttcttttgagtctattttagtaattgatattttccttgaatgttagccatttgtctacattttcaaatctgttggcataaatgacagttcataatactgagctgtgttttaataggggacatgtgattctttaaccaaaggtgcccagtgctttgtttctgtaggtcacaaagttcttaggaaaaattctaaagaaacattgagacctgggggatgggtgtgtgtgctgcagggaggggagtctggattgactcttgagtttctctgataatatctcgcatatgtgaaaaagccgtacagtttttcaacacacgtattgcttgccttatctcttttgtcttctcaaagtccttgaaatgtagattttataatcagtctcaatttgtagataaggaaaggccaatcagacataccagtttatctataatatagatgagatcagaagccactcctagatcacaccattttaattagaagagagtttagagatcatctcattgagaaactcttaacctgggatccatgtccctcaaagtgctcttgggtagacttcagtggctccataatttggatgagaacaaaattacattatttttcactaaactctaagtgcagtttagcattcccttctattatgattgcaagcaacaaacaccagagtagtagcagtactgtgtctccagtagcaatcacagatattttcatggcacattgtagccatcagagataactcaaaatactgtttacactcatcactacttcaaaattacactagttagtagacccgcctcttgatcttgacatgttgtttttaaaagtacatgttactctataccaaatttttaaaaatattttgataactgcagttcaaataattggcctcctttctaatcctttgcattcatttacttgtttattgtgataaaatatacataagataaaattgactattttaaccgtttatagtacatgtttgatggtattgagaaaatttacaatgttgtgtaaccatcaccactatttccagagcttttcatcatcccaaatagaaactctgtaaataatgaagcaataactcctcattcttcccttccccaccccccagtaacttctattctacttttttctctatgaatttgcctaaatacctcatacaaatgaaattctatcatatttatcctttggttgttagcttttttcatttagcttagtgttttcaaggttcatccatgttgtagcatgtatcagaacttcattctttttgtggttcaaaaatacgctacattttactccattcacctgtcaacggccacaggttgttttcacctttggactactgtgggtttttttgttttgttttgttttttgtttttttgagacagggtcttattcctatcacccaggctgcagagcagtggcgtgatccgggctcactgcaaccttgacttccctggctcaggtgatctttccacctcagcctcccaagtagttgggactacaggcacacaccatgcctggctaattttttgtattttaagtagagacagggtttcatcatgttgcccaggctggtcttgaactcctgggctcaagcaatccacctgccatggcctctcaaaatgctgggattataggtgtgaaccactgtgcctggccacctttgagctattgtgaataaggctgctatgaacattagcacacaagtatcttcttgagttcctgctttcaattcttttggatatatactaaggagtagaattgctgggaaatatggtaattctatgtttaactttctaggaactgctaaactgtgttcaacagtggctgcagcatgttacattcccaccagcagtacacgagggttccaatttctccacatcctcaccaatacttgttattttcattaaaaaatattaattaccatcctagtgggtgttgcattttattttaggcatgtaaaaactttattctgagaaggagtcatgggcttctccagactgccatgggggtccctgatacaaataaaggttaggaagctaggatgagggaactcaagagctcagagatattgtcacatgtccaaggtgaggtgatggactagcagcagcccaggcattagaactaagtttcctgggtctcaaaggagcccttttccctcctaccagatggtctgttctcatgtacatgatccaccccagccagtggtcagaactgagtcagagctggagctaagccattgaccaaccagctactgaagctgaggccagcaccagacacagactagatagacataattaatccctgtttgcaaatcactgcaatgtagaactaccatgcaccaccacagctgctaaatccttatccagcctacaaacatccactgaatgcctgtgtgcagatcaaactccatattcagttggagtgtttgggggacacttacggggacatcaatggacaatttggtttataggtataaagttcaggagggagaaataaccctgtgtatgtttcatttaattacagaataggtgtcttgatctctcgtttctttgtggggaccctctatttccgcagaggcaggttcagatggcctcttgagtctcatcgcccattttcttactgagctctgtcagccttggctcctgaacctttccacacttgtcagctcagtttttaaaataaccatagctgactttttttttttttttttttttgagacagagtcttgctctgtcgcccaggctggagtgcagtggtgcaatctcggctcactgcaacctccatctcctgggttcaagtgattctcttgcctcagcctcccaagtagctgggataataggagcctgccaccacacccaactaatttttgtatttttggtagagacggggtttcaccatgttggccaggctgatctcgatctcctgaccttaggtgatctgcctgcctcggccccttaaactgctgggattacagaagtgagccaccatgcccagtcatcatagctcactttttttttttttttttgagatggagtctcgctctttcctccaggctggagtgcagtggcgcaatcttggctcactgcaagctccacttcccaggttcatgccattctcctgcctcagcctcccaagtagctgggactacaggcgcccgccaccacagctggctaatttttttttttttttttgtatttttagtagagatggggtttcactgtgttagccaggatggcctcgatctcctgacctcgtgatccacccgcctcggcctcccaaagtgctgggattacaggcgtgagccatggtgcccagcccatagctgacttttaatgagttttaattctagctctccactgtgcaaccatgaataagtaacttaaccaccctgaagttcagttgtcttgtttgtaaaatgaggataataatgatacctccctcatagagtggttatgaggatggaataagacaatacacatagagggcttggcacagagcctggcacagaggaagcatttcattagcgctgttattgttgattttaaaatttattattaaaagtcactttgacgcctataatcccagcactttgggaggctgaggcaggtggataacctgaggcgaggagtttgagaccagcctgaccaatctggtgaaaccttgtctctactaaaaatacaaaaaattagctgggcgtggtggcagacgcctgtaaccccagctactcgggaggtgccttgtggtaaaagatgggccaaggagtttttggttttaaagcgaaagcctgtaatcactgtgcctgctcacagggggattgctatggctaagttcatagataattgggtagttggctgaggcaggagaatcgcttgaacccgggaggtggaggttgcagtgagccaagattgtgccgttgcattccagcctgggcaacaagagtgaaactctatctcaaaaaaaaaaaagtcactttgtaagttgcaaagtatgactctactatgagatctttacaactaggaattaagccagttacgatggcccatgcctataatcccagaactttgggaggctgaagtgggaggattgcttgagcccaggagttccagaccagcctgggcaacatggtgagagcccatctcaaagaaaacctaggaatcagagcttctcatctctgggcctaaaacatctggtggagtagcttctcaggaactgtatactgaatgaatgagtgagatgacatttactaacagttttattaacttttatcttttatttacctatttgaccatctactgtactgacttaaatataaaatagcagtttttctctttcaacctttttttttgaggcagagtctcactttgccacccagactggagtgtggtgatgcaatctcggctcactgcaacctccgcctcctggtttcaagtgattttcctgcctcagtctcccaagtagctgggactataggtgcgccaccgtgcctggctaattttgtgtttttagtagagacagggttttgccatgttggccaggccagtcttgaactcctgacctcaggtgatccaccggccttggcctcccaaagtgttgggattataggtgtaagccaccatgcctgcaccagcccctccccgcccccttttttttttgagacagggtctcactctgttgcccaggctggagggcagtgccctgatcttggcttacttcagcctctgcctcccatgctcaagtgatcctcccatctcagcctcccaagtagctggggccacaggtgtgcaccaccatgcccagataattttttgtatttcttgtggtagagatggggttgcccaggctggtctcaaactcctcaactcaagcgatccacctaccttggcctcccaaattgctgggattataggtgtgagacaccatgcccagcctctttcaactttaaatcaagtatcagtcttagaatcaattctctgtagaatttgtcatatgagtcagtctgctctctatttctatgagtttggcttttttaaattccacatataagtgaggtcatgcagtatttgtcattctgtgcctggtttctttcatttagcataccatggggccaaggacattttttcttttgttttctttttcttttctttttccctgctccagctcaaaggatggggctggggaatctttagatgagtcgggggaaggcctcagtgagaaggtgactcttcttcacatacctgaaggcagtgacaggatgaggcaccagaataatgttgcaggcagagagaacagcaggcaggagtatgcttgaattgttcagtacagcagggaggccagtgtggctcttgccgagtgagtgaggggcccacggtaggagatgagatcagagaagtaacaagggggcctttagtggggccattgaaacagcttaggattttctctgagagagatgggagccattggtaagggaattacatgatttcactttttttttttttttgagacggagtctcgctctgtcgccccggctggagtacagtggcgtgatcttggctcactgcaagctccgcctcccgggttcaggccattctcctgcctcagcctcctgagtagctgggactacaggtgcctgcaaccatgcctggctaattttttgtatttttagtagagacggggtttcaccgtgttagccaggacggtcttgatctcctgacctcgtgatccgctcacctcggcctcccaaagtgctgggattacaggcgacttttttttttttttgagatggggtcttgctctgttgcccaggctggagtgcagtggtgcaatctcagctcactgcaacctccgcctcccaggttcaagcgattttcccacctcagcctccccagtagctgggactacaggggcgtgccaccacacctggctaatttttgtattttttggtagagacggggttttgccatgttggctggtctcgaactcctgacctcaggtgatccacctgccttggcctcccaaagtgctgggattacaggtatgagccaccatgcctggccgatttggtttttaaagaatcacttcttctgctggattgggaatagtctgcagagaggcgaaggcaagcagtgcttaggaggctaatgccatcatccaggggagggatgatggtagggttgagtaatccctggagtgtaacaaacactaaggattattttattttgtggcaaatgtcctaaagctttcttgaacagtaccaggttgctgggaatgtatagagacagcttacagagcaccctacagttttagcaagggaactttcacgtaatataaaggcatgcaggttgtactcttgtatagttgtgtgtacattggttgtttcctgtagcaaaatcatgaagagtatgaattctagagttagagtccctacattcaaatcatggctccaccagttactaactgtgtgaccttgggcaaataaattaccctaacttctctgagccttcagttttccctctagtaaaatggggacagtgggttgctatgaggagtaatgagttagtgcgtgtacaacatttagcattatactgatatataaccatggctcaataacatagtagctatcattatggatatgaatataaccatttgtaaaggtcaaggaacatctctatttaacttagtttatttatttattttttattttttgagacgtagtctagctctcttgcccatgctggagtgcaagggagtgaccttggctcactgcaacctccacctcccgccttcaagcgtttctcctgcctcagcctccagagtagctggcattacaggcatgcgccaccaggcccagctaatttttttttgtattttcggtagagacggggtctcaccatattggccaggctgctctcgaactcctgacctccagtgatccgcccgcctcagcctccaaagtgctgggattacatgtgtgaactaattaacttagtttatttagagccatagcatatggggctgaaaaagaactaagacacttcatttagtctaaccctctcattttacaggggagaataaaaactagagatagaaaattccatagccaaaataaaataaaataaagttatggtccgggtgccgtggctcacacctgtaatcccagcactttgggaggccaaggcaggcggatcacgaggtcaagatatcgagaccatcctggccaacatggtgacgccccgtctctactaaaaatgcaaaaaatagctgggcatggtggcgtgtgcctgtagtcccagctactcgggaggctgaggaaggagaatctcttgaacttgggaggcagaggttgtagtgagccgagatcacaccactgtactccagcctggtgacagagtgagactctgtctcaaaaaaaaaataaaataaaaaataaagttatgcggccagtgtcacctagctggtagcagagtggggactggaacacaggtctctggactcccagtctggtgctttctctgctatgccacattgcttccatagaaccctcagtgcagcaccaggtgggaataataataacaacaataaaggcttatttgactcttactttgcgccaggcactattctaagtacacatatttgctcattttatcctcatgacaaccctatgaggcaggtacaattattgtccccatcttgcggaagaggaaactgaaggagagagggataaagccacttgcccagggtggagaatgagtgtggtgtgggagacatgggcaggaggctgctgccccgttacactgcacgacctgcttctccctttatgtaacagggaaattgaatccagtcgttcaagtcctttttcagccttcaaatttgcagaccctaaatgcttttctattatcgggtcttgaataaataccattccacttcattaaaactgctgtctttttaacttgtcttcatcttaatgatcatctacaagaaagactatttgcagaagagcctagaaaccaagtcaccaagcctgtgagagattcctgaaatgttatttctggcttccatagcaaccctaacatagggcgttaagcttaacggagtcagcgagagcagctggagccgggcattgaagcgctgagagcgctgaggaaacaaatcgttggctcaatagttttccttttgtgtaatatactgtcccagtgtgtttagggagttacgacttctgccaagtaagaatggaggaaatgaagcattgtatcaaagtgtacagagtttccaagcaaattggaggatgagtacaagtctgtgtctaggggagtctctgcagaagatgagggtgggcctgcagagacgtaggggtggggaggaggggcagctctgctttccccaaccttgggtgactaggccttcaggtcagctttgtgaagaggactgagcatgcctggttgccttttctgttccaccccgtttgccgacctcagtagagagtgggggtgatacgtgagtgaggcatcaaagaggccaagatgctgaggatgacagaggcagatatgctgaggctgacggagccaccagggccagtgcaggaaacagagctctctaggtatttcaggaagaaaaagatttaacacggggaattcggttatatagttgttggaagggctggaggagtgggagcccagggaccaccacgcaagagcacctcactgggatcaggatggtgctgccaccagaactgacgtctgtgcagctgctgagcagacaccagaacacgaagtctggctgccgcaactaactggctttctaaaaccttgcttgctggcagagccaccatccaccccacttcatcctttgtgaatatattgaattggggttccccaattcttacccagaaccctagctgcctgaaagatagtctgggaaatatttgttttgtccttttagcttctgcaacgctggaagactcatggggagagttgggagttcatgccaagtgccaatggacatggacagcaatcgattttttttttttttttttgagatggagtcttgctttgttgcctaggttggagtgcagtggcacgatcttggctcactgcagcctctgcctcccgggttcaagtgattctcttgcctcagcctcccaagtagctgggattacaggtgcacaccaccacacccagctaaattttgtatttttagtagagacggggtttcgccatgttggccaggctggtcttgaactcctgacctcaggtgatctgccttcctcggcctctcagagtgctaggattacaggtatatgccactgcaccctgccatttttttttttttttttgagatggagtctcactgtgtcgcccaggctggattgcagtggtacaatctcggctcactgcaacctctgcctcccgggttcaagcaattctcctgccttagtctaccaagtagctgggactacaggcacgtgccaccacgcccagctaatgtttgtattcttagtacagatggggttttgccatgttggccaggctggcctcgaactcctgacctcagccgatccgcccgccttggccttctaaagtgctgggattacaggcatgggccaccttgctcagcctgatatttatttcatttgaaatttggattaaataggtagaggagttgaacaccaaatagagatgagttgaaagggcccatcgttgacctaaactatttgctccaccatctgaaagtcctttgggattaagtccagggttagataacagaggggcagaaactcaactcccagagacaaaggagtggccttaacattctctctggtgccttctctattagtatatacataaggaaacattaatttacacccaagagtaggctgggagcttggatgggaggggaagcagggttgggggtcaggcctggagagattggctttgggctgggccatagatggagaagactgaagtctgggctgtcaggaacccttagaataagcctaaaataggaagggcacatctaaaacccttcagtgctcctcgtttgtcctaataaaatccagaccttttttttttttttttttttttttttttttggaacagggtcttgctctgtggcccaagctggagagcagtggcacaataatggcttactgcatcctcaccctccagggctcaagccatcctcctgcttcagcctcccatgtagcgaggactacaggcctgcaccattacacccggctacttttttttttttaatctattgtagagagggggtctcaaactcctgagctcaagtgatcctcttgcctcagcctcccaaagtgctgagattacatgtgtgagccactgtgccctgcctgaagtccagacttcttatgcaggaggcacatgccgtccacccacatggccctgtcttccccaacttgtcctttaggacccagccttgccacatcacctgtggttacctgggtgcgtgtgcatcccactctgttctggcctccagcttttgcatacgctgcccttttacctaaatgcacaccccagcttgttgcctggtcaacacctgctcaccttataataacatcatcctattataatactcatcaccttgtccagggatcttcccccaccccctatcttgggactggtgatctactccaggctctagtcactcgtccttttttgttgttgctttgttttttgtttttagagacagagtctctctctgttgcccaggataaagtgcagtggtgtaatcatagctcacggcaaccttgacctcttgggctcaagcgatcctcccgcctcagcctcccaagtaactgggactacaggcgcacgccatcatgcttggcttgtgaaaaaacttttttttttgtagtgatgtggtatcaccatgttgcccaggctggtctctaactgctgggctcaggcagtcctcctgccttagccacccaaagtgctgggactataggtgtgagccatcgtgcctggcctgctcatattttttatgaatcttaatgaatctgtcttctctacagggttgtaagctcctcccaggctgagactggttctcatactctatccctagcacccagcacaaagaggggattcctgcaatgtttgtacaactcaaccaaaccaaaatgatgatagaattgtctccgaagacaaactttgcctttgctggcacagggctgtggaaccttgtgccctgttatctaactggccccttcctccttgtgtacctacacctcctcccctcctccttccagggaaaggccctgaggcgctgtgttttggggcctccacctccttcctctcctctcttgcagcccagccctgtgttgctatttattcacaggtctctgctctgctctggctttcacttgctgaattctcagaaagcagatgaagcaatttattcagttaaagtgcccctgtgggtcaaatgccagcttgctttttaaaaccttcctatgctgctttttactttgcagagagcagaaattacctgttttgtttcctggtgctttctgcactctcttgtattgagggatggttgtgtgtctgtgtgtgtgtgtgtgtctgtgtgtgtattacaattttaacgtacatgtcatttctcaatttgagaaaggaagaaagatagtgagggggtttgatagagaatatcaaaattattttgtatgtattcagtcagctcattttttaaaagaaaatgttttaatatcactggctatggtttttattttattttattttattttattttattttattttattttttgagacagagtctcactcagttacccaggctggagtgtagtggcgcaatctcggctcactgcaacctccacctcctgggtttaagcaattctcatgcctcagcgtcccaagtagctggaattgcaggcacgcgctacaacacctggctaatttttgtatttttagtagagacggggtttcgccatgttggccaggctggtctcgaactcctggcctcacgtgatctgcccaccttggtctcccaaagtgctgagattacaggcatgagccactgtgcctgacctgactattgtttttaattttaactttaattttaagttcaggggtacatgtgcaggtttgttatgtaggtaaactcaggtgtcacaggggctggttgtacagattatttcatcatccaggtattaaatctattacccattagttatttttcctgatcctctccctcctcccaccctctgatgggccccagtgtgtgttgttcccctctatgtgtccgtgtgttcccatcatttagctcccacttataaaaaccactgtttcacagcttatttgtacttctctttatcaattaagaaaaagactgtttgtatagcaaactccgagagaggacgtgaggggtattttttggtgagacttgagcaaactgctttacgttgcaaggaaattcaattcattggaaactttttcctccaggactaaactggggcagctttcattttggctctctcacaaagaaaattgtccagggtctggaaaccacagttgttgaacctcatatgacgtctcttttctttcagctcatgcaacatttactagaggagactggtgtgatgtggcgtgtttttcctttccttttttttcctttccattttgctggctcgttggtgcacacttcctgagggcctgagagggctgtcttcctggaggaatttatgacagtcagcagggacaactgaaatttgagctggtgtgaacccataatccctcagggccctactggctggagtctctttagggagcatccttgctacccaaagatgcacacccattccccagcaccttcataaaacaacaacaaaatcttaccatggcattgccaagcatattttgcatacaaacttcccaggatggattctatctccatgggcagatggaatccatcccgaaagcatctttctctgccagcacactcacctgtctctgctctgcaaatgcccttcttggtagtagcttgttcaagggtacgcagagcaaatttggcaattctgaaatttcagcttttgtttgtgaacttcggctctgctcaggaagaacttgtcagaatgaaggttgacattcagcctgtatgtcgagcattcttgagagaagcacacggtgcctggcatcttgaatggcatcagctgcttgctacccagttctttgggacaagtgggtccatgagagaaaatatacagagcagggataagactgcacccgctctggcaggacagggagcctggctaccccaacttccttttcccaagccatctgctacttttcttcttctgcaaccaggcattcaaagcagggtgtatgtgggggaagaccctggaaatcacctccatctgggtgtacattgttacttttatcctcagtagttggtcaagaagtagagtgtattctctatatatctttattgggttcatccccacttattcagaagtagaatctctaggccgggcatggtggctcacacctgtaatcccagcactttgggagactgaagctggtggattgtctgagctcaggagtttgagaccagcctgggcaacatggcgaaaccctgtctctttcaaaaatacaaaaaattagtcgggtgtggtgggtgtgcctgtagtctcagctactctggaggctacgttgggaggatcacttgagcctgggaggcggaggttgtagtgagctgagactgcaccactgcactctagcctgggtgaggctttgtttgagacccagtctcaaaaaaaggaaaaagtttttagaaagttttagaaatactaatttttaaaaaagaagaatctctagcgaccgttcagtgtgatctggagttaggctgttctggttaaacgtagattgtgcctatcgaataataatttctcttaccctgcctagctctacagtcgcctctatacttgtctcaatgacccctgcactgtgagcttcttgaggccaggacctgacgatacagcactaaccattgtattttgcctgtggtgccttcagtacagtgccttctatgtgccggccctgagccaggcatcgatgaaagatgaataagtccaagtcatgacctcaaaggtggcttatagattgatgggacttgcaggccagtaaataccataagtatttgtggggcgacatcactgcacattaagttactcattgggcttactgtcatcacgacctggtgctgagaaggcacatttgaactccggtaggtgcagcagatgaatcactggggcctgagcgatgcctcccagggcactggcctgggcagagggtgaagtggggagatttgcacttaggcgactgtgtcttgagttgagctttatctcctgggtcacattccaggctcagctgccagtcaatgtgttatctggtgatggggagggtaacagggctcttcactcttggccacctactgggagcagtgggtaaaaatgcaggtatgagagtcagaccaacttggggtttaaatccctgttctgccaccactcattaatcccctgactgtgcacttgtcacttaacctccctgagcctcagcttcctcatctacaagtggagggtaacagtgcctatcttctttattttctgaacctaattgaatgccagatatatctgtcatgcatatgatctgacaatggaacagaatatttgcatcaggagacaaaagagactccaggctgtatgattgccatattttcaaggccactcctggtttgggggaagaagatggcaggacatcagaatggggtgccctgccactatcttcttttctagacccttggcagatggtctctcaggctcacataaccctagagacagagttctcaaatttgttgtgcttaagaatcacttgtagcaattacaaatgcagattcctgggccttaatcccagagattctgattccctgggtctagggtacagctggagtgcagtggtgcgaccacagctcgctgcagcctctgcctctcaagttcaagcaattctcctgcctcagcctcccgagtagctgggattacaggtgcccgccaccaagcctgctaatttttgtgtttttagtagaggcagggtttcactatgttggccaggctggtctcgaactcttgacctcaagtgatccacccacctcggcctcccaaagtgctgggattacaggcatgagccacgatgcccagccgtccccacctctttctgatgttatcgagctgtcgagtatcccagctgcaacctgttctttattgtgtctctgctgaccagcgttcccagcccattccagctcatggcagggtatctgcaatctttctcttccctgccctcccaaacccccacccacaagctttacctggaagctcatgtacacaccaaagggaataagcaaggacccagacaggcagccaggtgcctggcactaggccgggtactagggattcatagaagatactgcttgtggccaggtagctgcatgtgtgagatactggtggaagacactcagacagaggtaagcagggagtgttggggctcagaggaaggccactgaggccagtggagaatggcccattaaggaaaggttttcaaaataggtgaccacagggctgagtcttaagctgaacagggagcagagggcatgcctagcagagagggcgctgtgtagggactacagacaggcagtgtgacattgtataaggtatagggcagggagtggtggctggtggagaaggctgagttcatgagttcattctcccctgaacatcagcaaccttgccattagtgacccttgggatggtggcttttgaagaaattgctttgatggaatagctccccaagactcatggatactgggagtttatgtatgtatgtatgtatttatttatgagacagagttttgctctgttgcccaggctgtagtgtaggggcgtgatctcgactcactgcaacctctgctttccatgttcaagtgattctcctgcctcagcctcctgagtagctgggattagaggggcacgccaccatgcctggctaatttttgcatttttagtagagatggggttttgccatattggccaggctggtcttgaactcctgacctcagatgatctgcccacctcagcctcccaaagtgctgagattataggcgtgagccactgcacccagcccgatactaggagtttaaagctgtcatttctggttcttgggactcagatcaatgaaactcactaaaatattcattcatgggaaagttctggtagaaaggggaagattaaagtccatttttgtcaggagagtctctctctgggaaagccattgatgagatgactggggcataaggtggtgtggtggtgtgtgcctgtagtcccagctactctggaggctaacttgggaggatcacttgagcctgggaggcggagtgattgggagtaattggaaagtgacatctggaagacaaatcggtttattttcataagctccctccagtctatgggtgatgggaaattggggtgctgtgtcaagaggaatcctgtggttggactttgattctgagaccaggactgattaggggtgtcggtcacagatgccagggctggggacatgggggtgacatgcaaggcttggacttgccatcctggctccatattttatcatgggaccagctgtctcccttcctttggtttatgcagttgatttcgaaccctacgtgcagggcttgacatttttaccaattacacttcatcttactagtttctactcattattccatccctcagaaaccctttctgggcctgtctgtgttactcagcttattaacagttcctcccagcatcgtatgcagtggtgtagggagaaccataaatgcctccagaatttgcaaaaatgtttggaaaatgttaccaagtgggaaatgatttgctaatgagttcacaatatgtcttagacccattaagtaatccagggtgtctccctaatatagtagaagcaagttttcagaatattccccagcggttttttcagaaaatgtgaatagagcacgactgagtcaaagaaagccctagctcatcaactgcattctacagtgtcaggcctcatgtgatgccgcagctggcgactgactaataagggaattggagaggggagaattgattatttcctggacaaggaccatggtgccttaatcaagtgccctaaatgcaggggactgcaggggaagtcgcactgtggtaaaaaaaaaacaaatatagtctaaattacatctgaagtagcctttcaattacccttaagcactgagagctggtcacagtctggaggcacacagggacagaagcacctgaggaggctcaggggccgcatctcaggtgtctgtggacatgcccctgagggagcacagtggtgggtgggatcccactgctgtgtcgcacggtcgtctttgctctcagtccatctgtctctctgtctctctttgacaagcccatgtagttcaagtctcataaataaaatgcgtacagccggggttcccaaaccccatgctgtggaccgatctcagtccgtggcctgttaggaaccaggccgcacagcaggaaatgaatggcaggtgagcattaccacctgagctccacctcctgtgagatcagtggcgacattccgttctcacacaagcgcaaaccctattgtgaattgtgcatgcaagggatctaggttgcacactccttatgaaaatctaactaatgcctgatgatctgaggtgaaacagtccccctcttccccactctgtccctggaacatttgtcttccattaaaccagtgcctggtaccaaaaaggttggggactgctggcttatcggatgcaatttccttgtattctgatgtgctagttttatattcttatagtggaggatccataccgctttcacggttttatgagaaatatctcttacaatctttctatttgttttgctctgaccccatgcccacctggcagccctccctcatgagtgcagttttacctggaagctcatgtgctgacccttcacatagccagccttgtctgcctgcccttatttctcactgaaaaagaatgttagcctttatagtcagacggtgtctcatatgattagctagtttacctttattcattttttcagacgtgggtaaaattgagtacttcaatctttgttgcagagcaccaggctctaagaccaggttggtagaaggattctatttcatgtgccagttctgacaaattgtttattggtactcaaagtgccatgttgaaaggatccaggctgagggggacagggccagaattgattaacaatgtctgccagggactgaaaaaaatggcattgttaagcttgccttagagcctgagacagtcaaccattccctctctcctctaccaaaaggtagtcaaccactccctcactgtccttctctctctcagcatgtatcattagagacctccttccagactggcttgatctgtttatatttatcaacaacagcacactgtatctttttggtctgcctgcttcattgtatcccgttattgtgtccttttcacagtcaggagtcttttccttcctctgtatccccaggccctggcatacaataggtatgttgaatgactggctcacaacctaagagttctacctaattgttctgcatgcagggaatctgccttattagggtcagtcgtttgccttgctgagatccatactacagagttccgtggatcctcttggtctgttccatctaggaataaaacgtacattttgcatgcccttttttttttctttcttaaactcctgctagctcattacgatcatggcttgctgtctctctctctctgttcttctctcatcataaaacagcttcaacttttctccccagtgtccctttgaaactgttggtgagctagttttttctctgtccctttaggaaattttaatcatgtttttaatcatgcttcatagtgttttgggtcacccttcggtaatttttaaaatcctctggttattcctagttctaagaacaattttagctcttggcttactgctactctgtccagcattacccttgtcataattgttggtgatttcaagatccacatgaatcatgaatcatcctttaatagctttgagattcttttctccaatattcttgtcttccaccagatctcagccactcacttctctctctctctctctctctctgtctctcttttttttgagacggagccttgctttgttgcccagattggagtatagtggcacaatctcggctcactgctatgtctagcctcccaggttcaagcgattctcctgcctcagcctcccaagtagctgggataacaggcgcctgccaccacggccggctaatatttgtatttttagtagagacggggtttcaccatattggccaggctgatctcaaactcctaacctcaagtgatccaaccgccttggcctcccaaagtgcggggattacaggcatgagctactgttcccagctagatttcagccaccttcttctcttatcttgaccctataattacagtaactttattcctgccataatttcagtttaaacctcctatcttcccagcttacctgtactagtattccaactccaacaattctgtgaccttatctggacttccagttaattgatcctgctattttttcactgtctttcacctcaattcctctatttcctgcttccccagcttcaattctatagggaatcactatagtcactgtcaactacctttgcccctttcctgattcatcgttctcgtttggctacatgataacccttgttaaattcaacttttaccagcctgccccccatatctgtgtagctgaatgtggctgtagcaaaacatgcaaccacctggattggtctcatgtaaatttcataattgcagcctttaagtaggcctttaatgtggcctggaaatcatactctagttccctaatcccttcactcttccactgtcctagaaactgttacagttttttttcacttgtgttattacatttttcatggttctcttgttaagtgcccacaaaccatctgctcgtgggaactttgctgggaattgatatggaacatcacattttctgaaatcaattttcctgggtatttgactactgtccagactgtagtccttctattccccacagcccctcaaagatcggtgacctctctctttccgtcacacctgtcccgtccttcattctccccctggcccttgaccgtactgaactctccgtaagcgcttgtcgaggagtaagaatgggaaccatcagtggcttgacttactgggctgctgctatccaggcaggcaagcatctgttttcatcatattattaagtgtttttttttttttttcagcacttggcaggaggtaggcaagtttgggccatagctttcaggccctgagtccaggcaaggaaagaactgaccccagagagccaatccagccctggtgcatcttgagtattctggaaatggcagatctaaaaggacaaaatcatttcatattcatcatgagtatagcttggtggttaagagtgcagactacggagccatcacgatgggttcagatcccagctcctctacttcctagtgataaaagaaaaaactcaaccaaattaaatttaaaggagtttaactgagcaatgaacaatttgtgaatcgggcagcacccagaatcacagcagattcacagagactccagtacagccacgtggtggaagatttatagacaaaaaaagggaaatgatgtacagaaatcaaaagtgaggtacacagcgggtggattggctacaggctggcgtttgtcttatttgaacacagtttgaacactcagtagtgtatgaatggttgaagtacggccgctgggattggccaagactcagctattgttacaggtgcatactcctaagttaggttttcaatcttgtgtacttataagcttggttgcagtttttccacaaagactgaaatatagaagcatggagtcattctcaggccatatttacttcacttttatactagataggagaactcaagcaagttatctaacctctctagactcactgtcctcatctattaaagaacagtaacaacacctactttctaaggtgtgttctttcctactttctaaggtgtgtgtgaagaataaacaagccaacacctgtaaaccattcagaacaaggcctggcactaattaagtgctcagtaaatattagctataaattacgattattttctcttttgagtctcacaacagtattgtaaggtattattatccctattttgcagaggaagagactgagggtcacacaggttaaggagaggctcaagatcatttggacagaaagtggcagaggctgggcttgcatgggatcataggactctaatactgtttcacttaggatttcagagccccctttggtctccagatgaaatgattttacccttgtcatggagattcatattcattccttctccaaatgtgtcctaacttccccatgcagatggcaccaaatatttacagtatgattacactgccatgattgaatttagccagaacgggagagaggctgattagtgacaaggctgcaatcttgagaggaggaaatagttctgatgttgcacattgtcattctgctggagtaggaatgttgcttaaaattgtcctggctcagttccctttctctggaagagtaaaagacactcatttgcccaatacatggactttggagtcaagctgacagtactggaagagctgttaacagagtccagatcatcactttatggttagagggatgacgttttattatgggcccacaaactgtcctccaactgtggctgaaaaccctgtcatgagaggccagaaggaagatcattgtatgttcttctcccaggccaaggagacaggatgtccttcatcagaaccagttgtcagcataagaagaacacacaccaaggaaatccatttcctggaaacatctctcaacagttcccatgtggagaaactgtgaagcttttcacagcaaatgttttagagtgttcccaggtatttgcaaagctcctatcataatgctggctgtactgataatttcctaagggtgcctgccatgagacgatggaaagggcatcaggtctgaccatggtgagccatgagggccttgcagagatagagtcaactctctgggcctcagttttcctttctataaaatgagtgacttggactctgttgggacccctctgcctctaagattctactagtctgtgattccatgagtcaaacttcagaagtggttatggtccctcataaaatggcaaagatttgggtcctagaatctatgactccattagcaggaccacatctcctctagaacattttggcttcgtgcttgtcatcatctttttgtactaactgctctgattcaatctctttccctgaagacttgcttccaccagaattccatttaattccacagatgttgaatgaagactttctgtgtttccaactgcatgcctacaaagataaatgagactagtttcctaaccttggggaattcccagtgagatagcaaggtcaagactttatagaacttcttttctccagagagctctctatttctttgacctgtgtgtgtccctagaccagtaatattgacttcaccagggagcttgttagaaatggaaacctacagaatcagaagctctggggttgtggtgcactggtcttagttttgttctgttttgttttgtttttgtttttgtttttgtttttgtttttgagatggagttccactcttgttgcccaggctgcagtgcaatggcatgatcttggctcacagcaacctccagctcccaggttcaagcgattctcctgcctcagcctcctgaatagctgagattatgggcatgcaccaccacacccagctaattttgtattattattatttttttttttttagtagagatggggtttctccatgttggtcaggctggtcttgaactcccaacctcaggtgatctgcctgcctcggcctcccaaagtgctgggattacaggcatgagccactgtgcatttggcctggtcttagtttttaacaagtcctctagagagttgagatgcacacttgagtttgagaaccattgaactagccctttcagggacaagctatgagactgtggttctgagccctcaagggacccaaggacacattttgaagaaaattcagttacttgggctgccaggacttggtgttttcaactcagaattacagctttcttggaacctccaacaacattttgaacctttgtggcgtttttgtacatgtgcaggtgttgtggaaactacccatttgttttgaagggagagaatccagtttagcacacaattctccatggaacttccaggcttccctttaaattgattgtgatgcttggatagatattgacaccatgactaagacccataataaaggcccaatccaaggaggctctgctacttccaaagatctccaaaggaagagagttctcagagtgcgagtcttgtgtgaatttccctcccttcaaaggtgccttaattaatatcctcctccatggcagggtctaagcctggcccctcttctcagcaggtaaagattattgggtcacactctccctgcagtaagttcagacatgaagggtcgggcaggtgtggctcttggagagggcctgcctgggtcttgggaatgctcccccttgtcctccttcctgggatctgcagatccatcatctactgccccaacccagggctatatgctaaaccacaggagccttcatgaaaattagaaaagcactcctgccttttttttttttttttttttttttctgaggtggagtcttgcactgtcacctgggctggagtgcagtggcgccatctcagctcactgcaacctccgcctcctgggttcaagtgattctcccgcctcagcctcccaagtagctgggactacaggtgcgtgccaccatgcctgactaattttttgtatttttagtagatttggcgcttcaccatgttagccaagatggtctcaatctcctgaccttgtgatcctcccgcctcggcctcccaaagtgctgggattacaggcgtgagccactgcacctggctgaaaagcaccccccttaaggtgcctcttagggtggctcagcccctggggctcagggcttggctggatttcagttcctctcacctccttgagcaggtgcctgtgtgcagcaccaaccacatagccatagctgtaaccctgcccctacccagcctggggctggacacgagtgagggctgatggaggggtggggagagcctgtacatgcagccagcacacgtcgggagttcccaagtgctggatccttcattacatcatttccttaaattcttacagctgcccaacgaggtggatattggttgcacctctgtatatttttttctttttctaaattatgaaagatttcaaactctcagtgctcccatgttctcatctatgcaatgggtatgatgcttcttgatcctttctcaaaaacttgttctgaaaatcaaatcacaccaagtgacaaagtgctctggaaatgttaggtttcatatagatcttatcgctgaaccctcaaaggctcactttctggggcctctgttttgagacactcaccctggactcacccagccctcagggttatgcatgggtatgtcagaacgttggtttcttgccaggctactggtatttgtgggtgcctcctcccctaaaatcattagacttgtgaggcggcaaggatgagttgtgtgtgcaggcactcagggacgagtcacagcctggcaagctggcctggacaggatgacttcatgggcctttcccacttctcatttttatgactagctttactgtttcattttggctttctctctctttcttgcagctgtggtgattaggatttagggcaagcatttgggatcccttttctaatacctttcaaatcctgattcagctgcaaagtccgggaagggagtagagaatgggggaggagggactcaccctggtgaaaggcagtagctcagaatatccgagaaactcccaacaggaatgcccagcctccacccactaaagctggaggcctctcatctcatccaatatcaccctcgtactagaaacgcaaaagggatgagtttgtctatggactcaaacctttacagtcttcttgcttagcagcttaaggcataattatggtagtcatggtggtaagggacttaacatttgcctttttccaatttaactgtgtcctttgttgaaatatttcttagtcaggtccccttttctctatttccactactgtcctaggattagatctgagtccccctctcaatgagattagtccagaaattgtgtataccatccatcttgcaaaccactgccagactctgttgacttttcattatgtaacttccctatgggagaggtgagttacataatatgatgctaagatgcccctcactggtggcatcatgtacatatttctcagtctgaaaggaaaggtctttttaaactggcttcaggccatctgtccaactaattcctgcctgcaactcctagtataccctctactacaaggtctcatcacttattctgttacccaccacattcattccgtcttgggctttggttcatgtgatccactcgatgtgctccttctctctaatccaaacaccacgcatctataaggtcagctcacgtcccatctccttgaccccagcccattcatatccctattctcttagcagctattgtcaggacgacacagttttcatgccagttattctttcatggttttattagttaattctccccaggtagattagaagctccttaactttggaccctgtcctaagcttctgttatattctctgcagtgcccagccaagcttatgtgtcatgcagtaaagaataaaataattttgaccctgatcaggtgtttggttacataaaaactgcattggcaactttctagaaactaatatattcatttatcttgcaaaaaggattgctatctgattatagccagtagtcatgatcttccagccatgcacaaatatacccttataactttcatgagtggggaggaaaattgatgaaggaggtttcaaaggtgatcatcagtcccaggatttccaacaatagccagtctgccctgggtccttaactctcttttaatgtttttattcttatttttatttttttaatgcagtctcactcttgttgcccaggctggagttcaatggcactctcttggctcactgcaacctgtgcttgctggattcaagtgattctcctacctcagcctctcgagtagctgggaatacaggtgccgccaccacacccggctaatttttgtatttttagtagagacagggttttacagtgttgaccaggctggtcttgaattcctgacctcaggtgatccacccgccttccaaagtgctgggattacaggtgtgagccaccacacctggcctctcttctaatgtatttgacctctcctctttccccagagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcagtaagtcctgctcctttgtcactcttctagaggaaccactagaattcattcattcatcttcaagtgttcattctgtgttactatgtcccaggtactgtgctggcaataggttttcaacaaaggccaagataaacacaacgtgctccaggggcttacactttggccaagagacacatgtttttatttatttatcttttagagacagggtcatgctctgtcacccaggctgtagtgcagtggcatgatcacagctcactgtaacctcaaactcctgggcttaggtgatcctcttgccttagcctcatgagtagctgggactacaggtgtgcaccaccatgcctggcttattttttaactatttgtagagacaacgtttcgccatgttgcccaggctgatctgaaactcctggcttcaagcgatcctcctgcctcaacctcccaaagtgctgggattataggcatgagcacccagctaagacagacattaaatatataattatacaaataagtaactatagttgtcacagtgtaatggaggaagaattcaggacatgaaggagtgtgcaaccccaggaccttatctaggcctggatgctcagggagattgccctggggaagggacacgtaagcccaaaccacagaatgaggaagagtagatagacagagtttttcttcagcacatggagctgccctggaattccctaagttggaattcatgagttggagtacggataggaatggaagggcagaaaaagtaacataatctctccttggatggtgtggaataccaaggcatttttgccccatggtggtgctggcaggggatgttttctcagctgacaaagaggtccagcgtatacagaggaccaaggtgtggtcctggcagctccccacctgttaagattgtaggggccactcctcacctgccaactctttctgcaggaagatgcctctcggagcccctgagctgcattcttctatgttggaagctttctttcctcttttgctttctaaccctcttttcacagggcttctctctcccttccttcccacgcactttccagttatctctacccctgctgctgcccccactcttctcagcaggtcagcctgcattctccccagtttcctgcctctgcggctgcctttttgttccttcctcctccgggagggcagggggccagccgcccaatccaggaaactcgcatcctgatttggtaaacaatgtcccaccctgacttgtccattcccagtggtccctgtcccctccagctaccatgaatctttggtggggaaataaagggaaataatctatttttaaatatctatttgtaaattatctatatgtaaatatctatttgtaaaatgtaaaatatcttcctagagcagagtggagaatgagctttagagccagactcagcaccaactccccaggagagggcacccaggagggggttctcagaatgtgacatattctagacctctaagatatagcccccagcgaagaacaatgtgcttttgatgtgtattaaacaaaatcccctgctgagaactaacttcaaaaagcacagagatctcatttgttcttgactccggaatcaaaagatttacttaagaaatcaatgccatgaagaaaaaaagaacctttttccttgccatgccacttggaaagtgttcagaagtgccatttccctggcactgcagaggctgtgttgttgtggtgtgttgtggcctaagtcagctggaacacttcaatcagcagaacacactgcaaacattttcaaggtttatgactttaaatgacttctgcagaatttatgtttcccctttcctgaaaatattaaaagggaaattggttctgtaaccattttgacagcttattcatttgtgttggaaaattttaatggaggggttctttttataagccttctgtatttatcagaaaatggaaagataacatgataaggctgaggagctacacaatgggactgaccgcccccctccccccacccccgcaatcctggtgtcgaataggatataccaatgtggacttgtctgtggaaaaaccatctctgtgtgctttctggcaaggcagcaaaatgaaaaggcagtttggacttttcctcccttcatcttctttgttataatctggaagctctaagaaaacattagcgttatcccgcttgttcctgtgcctgagaaatgaatcccctgtgagtccccccatccactctgcaggagacagggctgctgtctctcactgcactgcactgcccggctttgctcagcagactcagcagccgtcttgaaaggctgaagaggccccagggcctctttatcaacttcatggtaaagactgtagtaactaacatttataaagcactttcccttatgttatcgcagaaagccccaggaggcaggcagcacactcttgccactctctttttacaggttaaggaacttgctaagtgaatcacctgaaaaacaaatagccaagagatagttggatgctaattccaaacctcttgctcatttcactcctctgcatgttgggaattacaaattcctcttttaaggtaaaccattttctggtggccacctccacagtccagcctggccaggtaaacctactttgcaattggcattcacctaaaataggtgaaactctgaaggcagccttcgtaggaggaagaggagctgactctagttgtacaatcttgagcaaatcctttgtgctctctgagcctcagttgcctcatctgtaaaatggggattttatatgcagaaagtagatgagtgaacaggtgttgtaaatggtagagccctattcagtgtgcactgtgttatgtattattacaatcaaatacactgaggaccgatgggctaggcagatggcctcagttttgatctgcactcaaatgatcagacaaaaatggtgagcattttccaagttgcagatgacatctctgaggtttgggaagtctcatttgttccttaaacattcattgaacctgtaaaccaaaaagtatctgagacaagtcccaatcaatgtaaaagtttattttgccaaggttaaggacatgcctggagaaaaggaacacaaaatcacaggaacaatctgtggtctgtgcctttttccaaagatgattttgagagcttcagtatttaaaagggagagagggagggcatggtcacattactgaatccacatgttgcaagagaaaaggagcaggtaggggaacagtcaatcatgtattcctctagtgctcagtaaatcaacactttacataagataaggtgaacatagagtagctacttatgcagatatttaaccttttatctgtagctatctgcttaggaacaaaagcaaaggcagtttcttgcattactcagcttttagcttaatttttttccttttggcatagtgatttgggatcctgagattttattttcctttcacaaactgtaccccaataatagctaatcttgtcctgtgctaggtactttcaaatacagtattccacttaatacttaaaatagccgtttgagataggtactatcattatcttttttttttctttctaagagataaggtctcactatgttgtccaggctggcctcgaactcctgggctcaagcaaccctctcacatcagcctcccaagtagctgggactacatgtcactatacctggctctattatccctattttacacaactggaaattgtcagggtctgcctgggggctccaggagagctttaaagatgaggtgatactaataatcactaacatttcttgatattaatgtatgcatgtgttgtttcaggctattagtgtatgttaactcactttattcacacaacaaacctgtcaagtagatgctcttatagttcccattttatggaagaggaaattgagaaccaaagaggttaaataacttgtccaaggtcacaaacctgtaagtgctggagcttgtttttttgtttttatttgtttgttttattttgttttttgagatagggtctcactctgtcacccaggctagagtgcagtggcatgatcatagctcactaccgcctcaaagttccatctcagcttggactacaggtgtgcgccgccatgactgaataatttttactttttaaaaaagaaacaatgtcttactatgttgcctaggctggtcttgaactcctgggctcaagcagctctcctgcctctgcctcccaaagtgctgggactacagacatgagccactgtgcctggcctgtaagtggtagagttgagacgtgagcctaggcattctgcaggcagaactgaaaatcaatgctacatctgcagattgggacaggttctgtctgggtgtgatcaaggcaggacctttatcatacagtgaggaattgattagactctgcagccagacctcgctgggtgagagtcctggcttttttctctttggctgtctggctgtacaatcttgagcacagtggaggctttatacttgcaggcagggacttcccataccagccacagcaaggggaatcctgaggttgcattctcaggccacccttgagaccaccagggagaggccaggtgccctgtgaattgaggtcctgtctacaagatgaccaaaccccacacatcctggagtctgccatttttgccacccagtaagagaaaacatggaatctatgggctgaaaacgctgtccccagtgttctggtgattcttgccacctgggcgagattgcttttaattaacctctaggtgctgactttatcagcctcatctggtattttggagcagggagccaggctgttcctaccctaatagccccaccccacccaggccaggcacaatttaaggccctaatagtattcctaggacacacccttcatgaactggcctgggcagtctacactgatggcacccctttgaggtcctgatgtgaagtggggaggctggactgacttcacaaacgttgagtctactgtgcccagtaatacaagacctccagcccacctccctacactgaccactcctttagtcattcatacaatcattaaaaaaaggactgttcttatttcctagtcaacaaatccaatcccaccaatgacttaggctgctgattagttattcctccccgctgaacacaaggccttggctgagtgtaaacccagagggccttctgagaaatgaggctcataggactgtttccagcaggccggtggaggaggcaaggctgtggtctccccttggctctcaccgcaaaggcccatcccacagagggcaaggcatgaggcctggatgctctgaaagtcactcagcactcacccacagcattctacagatgggaaagttttattctagtttagtgaaggtgtttgagattcttttggttgaaagtgtcaggaattccatttttttctaaaaggaggggggagtgcattatattatccatggaaataaggatggcagttgtgagagtcctgctttcactgcatctcccctccactcctctccttctccagtccacagtcaggaagcatggccccaccagcccctgaggctcacttgttctcagtttgagcctccttttattcagttctggttcctaaatgccagtaaaggactctgattgtcaaaccctgtaccaaccaacagtggccaggagtgagactacctcagaccaccacggcagctccccgatgcaaggtgtctggagtgagaaggaagggcagtttctagaaaaaccaggtaccagattaaataataggtgtctgtactgaggtccctagaggctgtccatgcctttactctacaggtaaagaaatagcctacaagagctacctgatttcccagaacttccctcacttgttcgaggtagaggggaactagagcacagtcttctagctcccaatccagtgccttttccattacaccaagttataatcttttttagttccagtttctcttatggcacatggccaaaataagccttagtaacaagctgtcattctgaaacccaatgcaatagttcttttaattccccctccccactaactttttttttttttttttttttttgagatggagtcactctctgtcacccaggctggagtgcagtggcacgacctcagctcactgcaacctctgcctcccggtttcaagcaattctcctgcctcagcctcccaagtagctgagcccaccaccatgcctagcttatctttatgtttttagtagagatgggattttgccatgttggccaggctggtttcaaactcctggactcaagtgatctgctcacctcagcctcccaaagtgctggtattacaggcatgagccaccatgcctggcctaatttccgcaattgataggtgaagaaagtggagttcagagaaaccaagtcatttgcacaaggtcatagggagtggcgaagctgagccttcaggtggtctatttccggtagccatcctctccccacgatgctgcctgctgcccgccagatattttctctgcctcacatctcctgtcttcttattttgtctgttagggtctcaccaagaagacaggcaccaggtacatcacttgggcctcccactcatgacagtgggtgactgccgtgtagttggttgcctacacactacacttccttaattatggagagagacagtgacatgctgtgagtgccttagaaatgtcctctgcccgtgggtaatttgactccagcagtccaggaaaagaagagagtctttcaggatgcaaagcaaatgcaaattaaaagtgggataatgattacccctcaccatacgattgtcaaaacttgaagtttgataacaccaagtactgaagttttgaggggatgggaatcgttaggaccatcgttgctgacatgagctgtcttggaaggcaatcaggccatatctgtttaaagtgagacccagtcctagagaaaacatcgtacatgaattcaaggggacgtgttcaggaatgttcatcacaacactgtgaaagtgaaaacttggaaaccacccaaatgcttaccaatggggaaatggccaaataaaatgaggaaagtcatatgaccaatggataaaacaattgggagggataaactagatctaaggttttgattaaatctttaaatctaaaatacagctagttttcattattcacaataattatgttttataaagtcactgcaaacactgagttagagaatactaaaccattgctccatatattcctgatggaatatagggttaggttcctgcaatcctctggtgacaatattttttgtcaactaatcaatacgtagccttgttttatgtgtgtttctgtttaaaaacatcttattttttgtttgtttgtttattttttgagacagagtctcgctgtgtctgcagtggcacaatctcagctcactgcaacctctgcctcccggtttcaagcaattctcccgcctcagcctcccgagtagctgggattacaggcacctgccaccattcctgactactttttgtattttttttttttagtagagacagggtttcaccatgttggccaggctggtcttaaactcctgacctcaactgatccacccaccttggcctcccaaagtgctgagattacaggtgtgagccaccatgcctggccgaaaacatcgtatttgatatataccattgattcattaacatcagacccacagccaacggtaactcctgactgaatgaaacttacctaacacatgttttccctgtaaggcacatcgcagcctttctgcactgaggaacactagacggcgcatcaccattttaaaccgcaaaatcacttacagaaagcacagaaatgaaaaaacaaacaaacaaacaaaaaaaccacggtgctaagtagactgtgaaaaggatgcttgttcacagaatgaaagctgaaaaagaaggcagagtggctccttgttcaacctcagctgagaacatctgcaccaggcaacacatttttttgtagtctcagctacttgggaggctgaggctgaggcaggaggatcactggagccccggagattgaggctgcagcaagctgtgactgtgccactgtactccagcctaggtgacagagcaagagcctgtctcacaaaataaactaaatttagagatattttaaattgagtgctcatgcactctgagcatgtccactagtgaccgtgaaaacgctgtgagtattggtttgggcttacaaatacattttagtgagtaggcaaattcacaaatatggaatctgtgaagaatgaggatcaactgaacatgtcttcacagtttgatatctctgaaactggggtgcattttagattccatgaaatacagtacatgtatcaacattgatagaatctgtgattaacgttgagtgaaaactgaggtgaaggtcaatgtatataggatgaacctacagatgtaaaataagacaaaatgccaccataattctcctttgctataaaatggttagcaggtatcttcagcattccccaggcactattctcaacactctaccatctccattaatttaacctttttgaggttcttatgaggtaggtgctatttttattctcatgtcttataaagaagttaagaaaattgcacaaagggctgggtgtggtggctcatgtctgtgatcctaacactttgggaggctgatgtaggagaatcgcttcagctcaggagtttgagaccagcctgggcaacatagtaagacatcatctctatttttaaaaatgagaaaacttctattttatttaaaaataatgataacaataaaagaaacttgtacaaggtcacaaaaaaagctgtttgtttcaccctgaagtaaaaatgactgattggatctacaaactttcctagtgatatttgtatcctaacaggaaccaaaacacagacaatcaaactcagaacagtacattctaaattgtattgttgtgaaatgaaacagctttacttccctagttcatttattgcccaccatatttcttactccaatgtagagacataaacttcagatggatttaatcacagctgagttttcacaagcgctggattaatggaattgttctaagcttttgagagctccttttattttagcttcataaaaatatatttctacatatagacatcttttttgtttatgagaacacttgcataacttgttatgtttgtactgttgcttgttaattttaaatacaatcaagttacattgagtaaagtcataaattaggacattaaaaaaagagaatttttatgagctacagacagacttatgcaggaaccaatgtaccagaaagctgaggtacttcaagaactaaatgcagagggcaggcgtggtggcttatgcctgtaatcccagcactttgggaggccaaactgggaggattgcttgagcccaggagtttgagaccagcctgggcaacatagtgaaaccctgtctctacaaaaaaaattttaaaaattagccgggcatggtggcacacgcccatagtcccagctactcaggaagctgaggtgggaggatggctttagcccaggagtttgaggctgcagtgagccatgattgtgccactgctctccagcctggaagacagagcaagaccttgtctcaaaaaaaaaaaaaaaaaaaaaaaagaaagaaagaaagaaaagatgctaaataggtatcttaaattgagacataaagattacagaaacatgaaacgtgtgagtgcattttttactccaaaattgtgtgtatacttttgcatattaaaaatttacgttactcttgaaacatgattttgagaaactgttggttctttaacacattcttgcttatttaatagcttttcctccagccccattgctgcttcctaaaaatccacacttaagtcaaagtcccctctgatgctggcaaacttttctgattccccagcccaccacatgggtattattaagttgaattggaaatttcttgcttttttttgtagatcaaaaccaatcaagtatcagcaatttcatatagttcagcctaacactgtttctctttgattttccatggccctttatctggccctgtcttgtccaccttggactgtgagcccccttgagggtagggactgcagcttatttctctgagtcctgcccagaggagagagtaggcactgaataaatgcttgctggctggaatggagtgagaaagggcatcactgttgacttaccttcctgtgtcttccctttcagcggcccatatgtgcagcaccctggagcataactgtgcccacttctgcatcaacatccctggctcatacgtctgcaggtgcaaacaaggctacattctcaactcggatcagacgacttgcagaagtaagattgctttgctgatgtatttgtggtttcttcctattccctcatcctctcccttcttttatctgggctcattttattcatctgtgatgcctcacccaccccagttatcatcccttggggacagaaataaagtttggtattttctgttgaccccatcacagtgcctagtccagagctgggcacatagtaggccatcaggaagagttggagagataggtagaagcaccatctcagaaatagcctctttggatgtgtgaactggtctcctttacttccaagcttgttctttagcagggactactgaagagccttttcatccactgtctttattaactgtaccctaaggaactgtttccatattttattatcttctataaagtgtggatttaggaagagttgttaacctcggctgggagtgattattcaagttctgttttagaggggtgcagggacccagttgctttggtgtgggacactttataggtgtcctagattttaaaaagggggtaaacagatgtaagatattagaactcgcattctcttttttggctaagtgccaaagactagacagtatactgatatttgagccagcacgaggtagtctaccccttaaaggacagaattactcatacactgagtaccgtgtccttactttttaaagttatggataaagccactgagttaacctacagatgaccaggctaccaaaaacaagtcatgaggaagaccagcccacatggaagcaaataaaactcagctaatctgacacttagttcgtgcagtgcataactgttgccatgtgtaattgttgcagtgtgtcattgttgcaatgtataattgttgttatacctcatggcaagcaattaagcattaatggaaagcagtttgcacaaatggctgtaattagtgtcacatttatagaggccaaccacctttttcatgtttcttctcactgtttttcagttttggggttgagtggttggctggagttctccctgcccctcaagattaggtaacatctacttgaccctccgcttctgtgtggcctgtggaaacccaaagccctctggactctgaatcgcaggggtggggtgggcggtatgtgttcttagcctcctctaagaccccaggatcccaagttgagtgcagcctgaatcatcctcatcttccagttgaagatctgacgcttcctcaaaatccataacaaaaactcactcccaccgaatactcatgggtttcatagagtttcctaaagaactgggggagcctgggaaaggtcatctcacacactgctcagcaaacaacctagagatctctttagacacccccctctagacacctccacctcttcaggtgttctacctccccacaaccatcctctggaggcacccttcctcctcttcaggcatcctcccctctgccccggatgcttctctgtcccatctcagcttcccaccatcttgcccactcccttcctgccctttctccttctccttctctgtctccttctccttctccttctccttctccttctcctcctcctccacctcctcctcctcctccttcttcttcttttcctttgtttttttaagacagggtcttgctctgtcgtccaggctgtagtgcagtggcacaattatggctcactgtaccctcaaccttccgggttcaagcagtcctcccacctcagcctcctgagtatcagggaccacagctgcatgccaccatgcctggctaatttttgtagagatgaggttgctcaggctgctctcgaactcctgagctcaagtgctccatctgcctcaacccccaaagtgctgagatttacaggattgagccgctgtgcctggtgcccttctcttcttaggagcacaaggaattcctctccttgtctcatgtcccactgagtgactgggatctgggaatctgctgatatttattttccgtgggctggcctagccaagccagaggaattctgacaccagcaaataaaaaataaagtgttctttccctaattttatgagcaaggccttcccccacacagcagagtttgccagacccctgcctggtcctgccacaggccctgatgtcccccagatctcaagtactgctctggccttggattcctcctgcctagggatgtgccacaggagaatatgaagcagaccctgcctggacttcagacagactgaccagggggaggggcagggaggtccaggcggaggagggctaggagctcagggcaggctttctcaaacttcagtgactaagaatgagccaggaaactgacttctgggctcacccgcagagatgcagagtcaacaggtctggattttcaatgaaccgacgaatgactgccacactttgagattcactggcctcaggcagtgaggggtcccagggaagggcttagcagagctctgctgtcccgtctgacccagctctccagtcaccctgaagcagttaaaccatcttaaccttcagccagacttagcttaataaatgtgcagtgataaagaacagctctctctctttcagaaggggataatactaataactcttttgctttcccaaaattggtgtaccaggggccttggtggaagaacaaggccttcactgtctgcagatctgggcttgaacccgaccttatcacttaccaactatggctgtctcactctgagctggttatttaaacttcttgactctcagtttcctcgcccataagatgggacgggtggtaacaaatcaatacctgtctcactgattatgtccttgttaggccctgtttttggtctaggggacagttaaaagctgtgccaagtgaaggctgtgccatctactgacccctgctgatgagcagggacctgtgcctgccaacactgagagaaactcacagtgggcctggagaggaggcatgtactccacttctggaagctgtttccacttaatttccatgtcctgggcgtagctggataatctcccagatgaaaagccatgtgggtgacacctcctccccaaagcacctcttactctctaagaagtgcttgccattcattcttccatacaatcattgattggttcatttattttttcatttaacaattgtttttgagcataaaaatgtgccaggcagcatgcaaagtactggaaataaaatagtgaataacacagcaatattctttcttttttggagctcacatttttgcatgggagtgaatcaaataaacaaccagggtaattgcaaccaaaagtgactgcaatccacgtccacctcagtgtgcaacacatgaggtcaagcctaactatagccacttgttaggtgtttaccatgtgccaggagctttcctgagtgttttatatctgctgtctcatttaattctcacaatgagctcttaaagtgggttttatcactctcattttacagataagcaaaataaggaacaaaaagtttagacgatttacccaagctcacatggctagcaatgtgatcaaaccagaatccaaatcctgttatgtcctcactcttggccatcatttgagactgtcccatgaccctagaggaccccgacatggcagcaggacaacccttcaatcagaaaaccttctccaagccgggaagacagataggttcctcagcccactaatccaggggagacttagaactaattcaggactaacattcaacagattgttacttccccaagtccactgctaattgctgtggtactgtcatcacacaaaataatagtgggagggcctcttcagcaactgccttcaaatacacacacacatacacactatagaaaaaaaaaaaaatatatatatatatatataatctccccaccattgtatatttgtaatttgtgtggagagggaaagcagacacagttgatccacacattctttgaatggtgatggaccttggctattagacttctggcttcctctcttatggaacttcagaattctgtcccctcccagtgtcccagaggggtgatggttcttacagaatcaggttattacaaaacacctgaatcccatattcagacagcttggatcagcggttgagctgaaatcctacttgtctataatttccacttttatcctatttctgctatctgaagccatataccaaaaagttatttccttatccaaataaatagagaaagcccttcaattattatacagtgttattcccacacactgaccccattcctatcaattttctcttcttcaggggagaaacacatcttttgatgacctagttttgggtctcttcactgtccaggtaaccctcttctgggtggatattagttgtctaaaaagggcctttccattcgaagactagatcaaatgcattaaagaattttagcttccatcacttcttggccttttggctaagatcaaggtgtagaattttatcttccaagttgtgtctatatgggcaattttgaacatactggacctcaacattgtggattccttctgcctttcaaaaagtcttccctgtcaaataccattatatgagatatatgcaagagcatcagcataatactagaacaatggaattttatgttccttccttttcccatttaaaaaaaatggggggaaagaaaacctcatgaagtgtgcccgtcttcacatgctatttccccttatccttccccttcccagaattcctgtcctactaagaaagaactttatcttgtttctttttcttgatatattttcaaaataaggaattttccctttcttctggaacatttaatctatctggaagctgatgataatgcagcatttagaaaactccatttggcagaaaatgtagactttcttatccagcttaaattttttttcttctctcaagaacgataccaaatgcattttactgctttcattctttggaaatgttcccaacattatttttcccaagctacataagtgatttaatagatttatgttagagtttaaacaaggagcatgacccagaaaaaccactgaattattagagagagataactataaccaacattctttgtgaatttagatgtgaaaattcttaaaaatttagcaaatagaattcaacaatatatagaaagaacaatacatcaagaccaaatggagtttattccaagaatgcaagtttggtttaacattcaaaaatcaatcaatataattaatcatagtggcgaggtgtggtggctcatgcctgcaatcctagcactttgggagactgagttgggcgtatcacctgaggtcaggagtttgagaccaacctagctaacatggcaaaaccctgtctctactaaaaatacaaaaattaccctggtgtggtggtgcatgcctgtaatcccaattactcaggaggctgaggcaggagaatcacttgaacctgggaggtgtaggttgtgagccaagattgcaccactgcactccagcaacagagcgagactccgtctcaaaacaacaacaacaacaaaaagccactaaaactaataaatgagtttagcaatgttgcaagataaaaagtcaatatacttaaaaaattacttcattgtatttctgtacactggcaacaaaagtcagaaattgagattttaaaataccaggtataatggcatcaaaaatatgtaaattagggataaattttaaagatgtgtatgatttacacattgaaaaatataaaagatttctgagattaatttaaaaaaaacctaaataaatggagagatataccctatcatggattggaagacttaatatggccaagatgtcaattctttccaaattgatccatagattcaaagcaatccccttcaaaatcctagcagacctatttttttagaaatcgacaactgattttaaaatatacatgaacatgcaaaaaaactagaatagtcaaacccagtcagttctcattattcccagtagttatcatccataaaatatccataaacactaaattgcaaattctgaatcattgctcctagatgaaatacagagttgggttcctgagagcttccaatcacaacattcatcaatcaatacataaacttgtttgatgttctgtttaaacacacgtttttgagtatatactgttaattcattaacattgaaagctatcgttcatattttgaatgaagtacttaggaacaatagacagcagatcagcattactcttgggggccattttcaacagcaaaatctccaacaagaagtacaaaaaggcaaaaaatgtggcactgcatagaccacagaaaggatgcttgttcatgggatgagagctgaaataagaagacagaacgttgccttgtttgaccttacctgggaatatgtgtcctgggtgactcaaattttttgccactctgtgtatgtccatgaatggctgagaaagtgtcatgggtattgacttggggttacaagcaaattttagcaagtaggcagattcacaaatatggaatctgtgaatcatgcacattaaacaaagctttgaaaaagataaagttcatctttaaattttgtttaaactacctgatttcaagactaagtataaaacaacagtaatcaagacagtgtggcattggtataaagatgaacatatagagcaatggaacagaacagaatcgagaaataacccatatgtatgtggtgaaatgattttttgacggagtgggaaggcaatccaatgaggaaacaataatgtcttcaacaaatggtgttgcagcaattgaactgccatgtgcaaaaaagcaagcaaacaaacaaaaggaacatagatcttgtctttacctcataacatgtataaaaattaattgaaaatgtattctaagcctaaatgcaagagcagacactattaaataccatgatgaaatggtagaagaaaaatcttgatgacctcaggttggcaaagatttcttaaatagtacacaaaaagctacaaaacataaaagaaaaaaatcaatatatttaatcacaatgaaaacatttgctcttcagtactctgctactaaaatgaaagggcaagccacagattggaataaaacatttgcaaaacatatgtccaacaaaggactttagaatataaggaattcttagctcagtaccaagtaccaagtattcagtaccaagaagacaaacaccaccataaaaatgggcaaaatatttgaacagacactaaaccatggaagacatatgggtagtgaagaagcacatgaagagatgctcaatgttatcagacaggagatatcactatacctccactagaatggattttttttttttttttgagacagagtcttgctctgtcgcccaggctggagtgcagtggcgtgatctcagctcactgcaacctctgcctcctgggccaagcaattcccctgcctcaacctccaagtagctggatctacaggcacgcaccaccaagcctggctaattttttttttgtatttactagtagagatggggtttcaccatgttggccaggctggtcttgaacttctgaactcagatcatctgtccacctcagcctcccaaagtgctgggattacagtcttgagccactgtgcctgaccagagtggataaattttaaaagattgactataccatgtgttcgcaaaattgggaactggaatgctcatacatcaccagtggtcatgtaaaatggttcagccactctggaaaacagcttagcggtttcttacaaagttagatatttacctatcatgtgacccagccattccacttttaagtatttactcaaaagaaataaaagtttatgtctaaaaaaagatttgaacacaaatgttcacatcagctttacttgtaatagccccaaactgaaaacaactcacatgttgattaacagatgaatgggtgatacactgcaatacacgcatcctgtataatactcctctgcagtgaaaagaatgcactattgaaacatgcagtagcctggatgcatctccaaatcactatgctgaatgaaagaaaccagacccaaaaaaaccagaacataccatgtggttccatttgtataaaatttttggaaatggtgcctactcagtaatgacagagagcagattagtgggtgcttggggccaaggagtggggagcagcagggagagggattacaaagcagcatcaggaaacttgggggggtgatgactatgctcattatcttgattgtggtgatgatatattgataagcccgatttatcaaactgtacacttgaagtatgtacagtttattgtatgccagttgtcactcaataaagctgacattcattaatcagaacaaggtttcggaagtaagtagtggcgctggaccagactgcctttctggaatagtttgtttgtggcatcagtggaggatgagagaaggaatgtaagcagggataaagtatggagcaatttgattctcaagctaagttccaacagtgtcctttgttgagtaggggaattgaacacagggtgtcaagggcaaaaccaggtcattttagtaaattggggctggcaataatgtatgtgctgtattagaggtagagagtggggcagggatgccttcactcatccgctcattcattcaatacctgtggattcccctctatgggcctgatactcttatggggtatttttcttacatattagggacccaagaaacattcagatcttggcttcccttttaccccccacacagagagcagaatataaaagatggaatcagagaacaattctaatcagtccagtcaattcagtgtatgtttcttacgcccgcagaattaagtaggagaccacggcaaccatcccagccccagggaggagtttatgacatcagataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaaggtcaggttgtgagctctggggcagcccacagtcagagggtgggtcaaagctagaagggcgagcaggccgcacgcacacacacgcaaagcagctgccttcactgacaatcaatggcagccacctgagctgtggctgagctgctgtgagccgaagcagtgggcttgctaaatgccgtcatccagcttccccttgaccctggctgtcaggcctgggtctgggagcttagggatcattttgtgcagtctgctcaccctctggctgtgccagggcacaggattttctacaaaagaaggaatctggggtgagtagagccccatgggagaactgagctgactaaatgtgagtggagaaatgccaattatgaaaaaaatgtacatatcaggggaacatgagcttgaaccttgcacagcttttcctccgcttggctgtttttatgaggacccaggcaagtggttctcaaagtgtggtccccccggaaaacaatatcagctttgcccggaacttactagaaatgcaggttcccaggcttaccctagacccactgaatcaggacctctggaactggggcccaggaatgtgggttttcccaagccctccaggggatgtcgatgtacgctgcagtttaaggactactgacttagatgttttaaataagatctctccctggcagcatccactcaaaagggggtttatattaagaacataatgtgacaacggtttggaaattgaaaagcactctacaggagtaggacattatttttgtttgtttatttattatttttgtcaacctcattcactcagatttcactgtattttagaacttgtttcagagattccccccttcctccttttcccttccccgaggaaaaccaaaatcttgttagtgaacaggagaattgattgaaaaaaaattcaactgctgcgggaaaggaggagactaggcacagctggagtttgcctgaaaggataattttctcagtgacattgggtttgttttgtttctttcagtgtagaagcacgaggctgatgactcatttaccattggaagacttcaaatccaaactgcagttgtcaaaataagattagtgctttcagacatgatgaaagagagggcatggtctcgaaaaggcaagcttgggttttgcctgcatttgtggagccctaactcatagcaagctttcctgtgggagtgggcagagaccccatcgtttacccagttgagtgaaatggcagccctaataacccacttctccttctctcttgctgtgataaacaatttctgatttctacatctcagattaaataacagcaagagctataaaaagtagagggtgtctcctaaaggtgttcatttgctttaactccaaagatgagattaaactgtcattggtgtcaacagcgtgcagtgcagcttgtctaaaattctgaaacgttggtgaaaccctttgatttagccctggatgatggccatagcctttgccccatgctccgtgctcccccctcagttctgcctccttccggtgtaagcagatgaaagtttccaagttctctggactgagatgcaggcgccagggtttctaaaggaaggcacttacatctagggtgcatgggagtctctggggaaactggttgggtttgagcacagctttggggctcttggcagcaaatcttcactaattagtttcacctgggaagactgagttatccctcttaaaattctccaggcactgaaacaagcgagcagattttgctgactgtcagatacatgctaatggtagctccctggcaaggtgtatctcaaatttggccaggtctttttgttatgaaattccaaattacctactttgctgtatcacttcaatttagcatagaactcaaaaaccaaacttggccagagataaattttagaacgttaggatctaatattcatgtttgtagggattttttttttttttttttttttttgagacaggatctcgctctgtctcccaggctggagtgcagtggcgcaatcatagcttactgcgacctggaactccctggctgaaatgatcttcctacctcagcctccctagtagctgggactacaggtgtgtgccactgtgcctggctaattttttaattttctgtagagacaagatgtcgttctgttgcccaggctggtcttgatcctcctgcgttggcctcccaaagtgctgggattataggtgtgacccatcgtgccggcccatgtttgcagcttttataggtacccaataaagtgaaactattagaattgggatgtgagcaaaatttggttgaagttcaactctctgccatgcttaaataggtatgtgccactgacacttttcttttcccccttgatttaggaaaggagaaggatgctaacatttgttgaatacttactgtcagccctgcacttcgggaggccagggcgggtagatcgcttgagctcatgagttcaagaccagcctgtccaacacggtgaaaccctgtctctacaaataatacaaaagttagctggtattttgctgagcgtggtggctcacgcctgtaatcccagcactttgggaggccaaggcgggcagatcacctgaggtcaggagttcgagatcagcctgggcaacacggtgaaaccctgtctctacttaaaatacaaaattaggcgggcatggtggcacatgcctgtaatcccagctactcagcatgagtactgaggcatgagaatcgcttgaacctaggaggcggagaatgcggtgagccaagatagcgccattgcactccagcctgggcaacaagagtaaatctccatctcaccaaaaaaaaaaaaaaaaaagttagctgggtatggtggtgcgtacctttagtcccagctactcgggaggctgaggtggaaggattgcttgagctcgggaagcagaggttgcagtgagcctagattgtgccattgcactctagcctgggtgacagagccagaccttgtctcaaaaaaattaaaaataaaaaaataaaataaaaatatcttctgtgagacagatgctttgcccatctagattatctcactcaaccctacaaataagatatttaacctttttatgaaaactgaatctctcaaaagtcccttacttgaagtcgttacccagctggggccaagtctggctccaaagtcgatattcttttcacctgcctgcctcacccctaccctttctgaggagacgtaactgacatcctgccctcccccagtggtggctctcttcatcatttttcatgtcacctctttcaggtccaaataaaaatttggagaaggtcaaaatcatcttttcagttcacactgttaaaaatggaagcctgctctctcaccacgctcaactcccctttcctgcttataacgtatcacagatttttacctatttgctttgtttactatcaatcttctatcaggtatgtgctgctaaatgtttaacaatcaggtctccaggagacaaaagctctgatttgtagatttgccaatttccatggtgtaaatactcccaccgtggacatttcaagctaccaacgtggcctctttgaatgcagctgtgggaagagatgcacatcattgtgtgagtcagtacgagctgcctctagcacatgactggcccctcactggaccatcagctctataagggtaggaatttttctgttgttgtccactgattcactgttgttttcccagcactccgaaccgttccatcgttgaatagatttattaattcagtcatccacaaatcagccacatggcagatgctagatatttgaactagcatgctgagcaagacaagcactgtggctgccctatgtggcaggtgaaatagacatgaaataattagttgcaaattaagcattaaattataattgtgttgaggattacaaatggaaactctgagggaggacttcacccctagtggcaggtcagagcttcctgagaaagcagactttcaggtgagtactaaaggaggtatgagagttaggtaggggaaaaggaggtcaggaagaggcttgagcattctaggcagaaggaatgacctttgcaaaggtcccaagacatgaagaagcttgatttgaaaatggagagggccatgtaaatggagcagagaaaataagaggaggcttgagataagactggagaggtgaaggggtgggtcttgtagcccccttgaccatcacattagagtttttggactccatcctaaagcagtgataagccattaagggttttaagcagaagagaggcaggagcagattactctggctacaggaggatgctaggctgggatgaatacaggaaaaccagttaagaggttgccacggctgttcagccaacagatgatagtggctccatggtggcaggggagatgaagagaagtaaatccaggattgactgggtctgaggggtacaggagagggaggaatcccatgactttcaagtttctgttcccatcttcgaccccagggtaaaagttagctattctaaaaattcatctttgctaaagagaaattaaagaatacttcagaatcatccccagctgtcccatttctgcccagtgacatttattaattgagacagagctctaggctgcccagcaagggaggctgtcaagtcaacaatagatggctactaagcaccaactgtgtgaagtgcatggcattatacaggcaccgtaaggaacaccaagacttagagacatggctctgtccttcacagagcttacaagagtaggtaagagagatgagttaggaacacctgacaaccctgtgcttgtgtcacatgagcatgagttcattcatccattcaacaagtacttgttgagcaaggacaaagtgccaggcactgtgctagataccgggatgcagtggatagcagggcacacaggttccctaactgtcatgacagcttttctggtgtccatagctgggggctggctctgagatgtcattgtgttcttgatgcaggacaagtgagccccaaagtggggcttagcccatgagggttcttggctttatccaggagagaattcaagggcaagcagaggtagatgtaaacagctttattgaagagacggtgttacagccctggcagtgttacgcctccgtgactgctcctgcagagcagggctatccttataggcagagagtaggtagtagctcagggcagttttacagtcatatttatacccacttttttttttttgagatggagtttcccaggctggagtgcagtggcgcgatctcagctcactgcaacatctgcctcctaggttcaagtgattctcctgcctcagcctcccaagtaactgggattacaggcacctgccaccacatctggctaattttgtatttttaatagagatggggtttcaccatgttggccaggctgctcttgaactcttgacctcacatgatccacctgcctcggtctccgaaaatgctgggattatgggtgtgatcccagtggcctatacccacttttaactgcatgcagattaagaggcagtttatgcaggaatttctagggaagggatagtagctcttggtttgtcaggtcattgacacggaggaggtggttactcccaggtgttgccatggcaatggtaaactgacatgtcacactggtgggtgtgtcttatggaaagctgcttctgccccagccctcaatttgatcctgtgtccaagccctgcctctggagttaagctctgcctctggagttgagtcctgcctcctacctcactctgagccctcttctggtgtgtgaatacctcttgctgaggatgaggagaggcagagagacttggagagaattttgttcccatctcagtcatcttctgaggaccccacatctaatggaggagggtattcttaggactttagggccattcctcctgggaggcagggcatctgggcctttttcattgttcattcagcaaatgaactcttatggagaccaaatacatgtgctaggacactgtgctagactctggagagtcaaaactgaccctcttataatggggcagatagccgtgatcaagtccttccaataccatgggatcagtgccgaaatgctagagcggagccatgtctatagtgctgtgggggcccaggggaagaagccttaactccagccaacttgaaggaggcttcccacaggaggtgacatttgactggggttgtgagccattcatgggggtcaccaggtggagaaggtggaaggctgtgccggggcagggggagctctggacacagtgcttcttatccttcagtgaaatcctcctggcctcagagagaaagaagggctgtttttcaaaagcataaggaatcatccaaaaaacatctgtatttgtttcaaaaggaaatggccactgccagaaaaacagcaaagttgttttgtcagaacccagtctgtatttattcctttgtctttgtttaattagattaatccctgaatggtttcccttgggtcggtacaaatcgctcgtggccataaatccccaacaattctaaaaacagtaagaaaggacaatccgcatgaagccaactggcaagcttgctgtttgtgggacagttctgggatgcgagcagtaatcttgcacccgcacataggtgtttggggttcttttagcctcttggagaggggagcaaggacaacaatcactcagatttgtttagaagaggaaagctgaaccgtagggtctcatcattaaagggggagactgactcctggatctgggcaccttccccagggaggattgtggggactttttatctgttaggttcaatgacattcagcctggctgcacactggggctacctgggagctttgacaaacaccactgcccaaatcccaccccctgccagtctgatttaattgtggtggggagtaccttggcatcaagattttcaaaggtcgctgctgcttctgtagatgggagcttgcagttactcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtattcacaccactacttggtaaccatggtaggtagggttcctgccagacccctgatggggcaaggcagcatctgcagtagagattgggaggacccatgtggagaagctgctgccacccttccagagctggttccagcatgctggagcgtcacctcccagccatcaggacttcatgcagggacactgcccacccacttagggagcttagagtctagtaagagagacacagtacatccatcgctctataaacacatacgtagttaacattatgattcatgccaggagggaaaagtgcaggggtgggctgacagccgatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagttcagcctatgcagcctgtgtgcagagatccctctgcctctggtgtcaatggtctttcccatcctctcttctgctacttcccctggaatttccagagcagaattcagctgccacgcctctcctgcttccctcttctgtttactcacgcgtcccaagcctggagtgctgtttctctttctccatacctgccagcctttcccagtccttgctagacttgcagtaatctgtcccaattctgaactcccatagttttcttggcacttctcttagggattcttatcatgtcctacctcgcatgttagttatttaggtggcatctaacaaccactctggcctttctgttcctcaaataggatcagtttgttcttcaggacctttgcattcactgttcttttggccgaaaatactcttcctaaaggttcatgttattaactcctagtaggatacaagctgcgtgacagcagaaaccccttgtctgttttgttcaccatgatatccccaatgcttgggacatagtatgcgctcaaaccgtatttattgactaaatgaatgaatatcgtatgattcagacatttcttatatctggcctagctcatttaggttttgtatttctttgattactcactacgatttttgtattagctgaagttttcttccggttatgggtgttttccttacatctgaatccactgaaaatctacattggactttctggttggagttctcaattggaaatgtgagatataaacttactggtgagaggtaaaagaatctgtgtctataaggcttttttttccatctactttattgatttgggagtgaaacttcttttaggagtttaaaaccagaattcttatttgtagactcttagacctaagcgtttttaaaatgtgatgatgtaagttttaatgtttaaaattgtttaatgcatttaatagagatgttgaatcaaatcagcttttatctttttaaaaatcaatttggatattttatatttatgtaaaagcataataaactatgaaactcaaagatctagaagatgatatgaaaatgtagccattggattcaggaattaatcaagctttctaggtaattaagtttttttaaatcatacctgttgtagtgatagcttttttttgtttgagacagtcttgttctgtcgcccaggctggagtgcaatggtgtgatctcggctcactgcaacctccacctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaatatattcaacccctttaatgctctctgattatctccagttttaatggcaaaatcaatggtacagctagctgtttcatggtatccaagctgttctccttgctgggaaatagtgttagagactgagtcagtgatggatggaagatgcctttaatcttttcatccaccaacatattcttagttctgttgcagtagatgcatactgcaattccattcctacgttgcatgtgaataaacaggcagagcttagcacttagtggacatgtaataaatatttgaccaaaataagaccacgaatagacatgtatctatttctccctggcaatgtttgttacctctacctaacctcttttggcttctccattttcctcgtttgttattagaatgaatacatagagcacaaagagggttttcaaagagctttgtctcattccttcttataccagcaacagagtgagattctgtctcaaaaaaattatttaatgtatttcaaagtaattccaactttgaaaaatgtgttttttttatgttatttatttattttgagacagagactcgctctgtcgtccaggctggagtgcaatggcacgatcttggctcactgcaacctccgcctcctgagttcaagcgattctcctgcctcggcctcctgagtagctgggattacaagcacacaccaccacactcagctaatttttatatttttagtagagatgaggtttcaccatgttggccaggctggtctccaactcctgacctcaagtgatccgcccacctcggcctcccatagtgctggaattacaggcgtgagccaccgcatggctgaaaaatgtgtttttatatacatgcagaaactcacctggaaagaaaactcaccaaaatgttaacagtggttgcctctgggtagtaggattacagatggggggattacaggtgaattttcttttatctatttttttatgttttccaaattttctactatgatcacgtatcaaaccttacaatgtttttaaaagttactttggtgagggctctggagttccctgttgcctcaccctgggctgggagcattctcaggtgtgcctgacgttgtgttctaacatcgtgactttgcctcagtccaggatctgtgtgccatggaggaccacaactgtgagcagctctgtgtgaatgtgccgggctccttcgtctgccagtgctacagtggctacgccctggctgaggatgggaagaggtgtgtgggtgagtatccctccagctgggcttggtagggaaggacaagttaagcatggtgaggaggaggggagactcacgtgtacctcccacatatttgtttcctcacctttgggtttccacaaagtgctcagttgtttggtgtagttgttaggcagaatttgaactttaaaggcttcatttatggctgaggtcagcgttttcttattctgggtctccagtaaaaggaacacttatgataatccatgcaaatataactgtgtgttactgcatctcttgaaaaggatcgggtggattttcttcaactttggaggatatgtttggaatggcctgacttatatatagctcaggtgttatacatgaaatttacttgggtgggttgctgagtgacacctcaaagacaacgggcagccttcctccctaatgtcacctatagctcagtgacaggccaaagtgactgccaggtgaaagagcccagccatatgggctcagcgtaattagacggcgtggtcagaggaaactagcagtagcctcaaaccctcaaacacaagcccaggtaatgaggctcaagggcagtgcttgatgctgcagacatcccccctgtttatctacaaagcctttgcaacttaacatggtctcattcctccttataccaacaaacagtgcctggtggatagtaggtgtttcataaactgaactgaatacttatgaggcagaaaatctagaaggaaaagaacttgactgacatcaaaactggaatgtaaattttctgctaaatcctgcattttgtcttccgtgttctattgttttcaggaccctattttattttgcttcgcacaaacagggtatgcttatatttttgcacatagaatttgcattttccagcacaccttaattcttagctagggatgtggaaggcaaaacaaaacaacaacaaaacaaaagttaggtggtagcctgcaattggcaggtgagtgatgagagtatcgtgggtttgtttttacacactgataggaatgaaagcaacctctgcctctgactctcatcaaagggccacaaatgcagctggtctcctgggccttagggttgtttttcttcttaatctgctggtggtggccatgatagagtggcagggttccacacccactaccactagcaaaaaagaagccaacatatatacccatggttatttttgcttcattaatttttattatgcaagtaatacccgttcatagagaaacttaaacagatgagaaaaatcactattaataggttattgtattttctaccagactttctccatataaatatctactttaaaacattttgttggacaggtgcgatggctcacgtctgtaatcccagcactatgggaggctgaggcgggcagatcacttgaggtcaggagtttgagaccaacctggccaatatggcgaaacccggtctctactaaaaatacaaaaattagctgggtctggtagtgtgcccctgtattttcagctagttgggagggtgaggaagaagaatcacttgaccctgggaggcggattttgcagtgagctgagattgtgccactgcactccagcctgggtgacagagcgagactcatctcaaacaaacaaacaaataaacaaaaaacattttgtaaagatttaacaaaatgaggtcacactgtctattttgttttacaacctgctttttcccctctactatttgttaaatgggtagaaactctgagtgctgtttggtcaggaggaaatcaagccattgtgagttaggctggtggaggagcttcaggaaacaggatgagggtaatgggttgattaggacaaggggagggacagtagaacacagggcttgcattggtcacagggagtagatggggcaggaagcccaccttggcccatgggaaactggaggccactgaaaaacccatttctctgagtgtttccaaataattacctgcttgtccgtgtgtagtagagaacctttgtatctctgaggattttgctgtaacttttgggatttgacatttattgaagagctacaagcgtgggagggtagatgctgtcattgccagagagctttggcgtgctgtttatcggagatgggcgtttctctgcggctgcttgactgcatataagaatgtctgcattttctcagtggggatccaatccaaagagtgggaaaatgggagagactgcatcccattgcaacccaggtctcctccgtcagatgatcctagcatcaccagccttaccaccttttccccaatgccctttacagcggttcactaagcactcgatctgttagaggctgggagtgagatgattaagcaggcagtacttttgttgccagtagcctttcttagggactccagacaaaatcctacaaggttagttgctgctcaatagggctatggtgagtacaacgcaaatgatagagaaaatattggccacggaaggtcagagagagacatcctaatggctaggctggaagatctgagtgtggaaggaagggtggcaattggacaaatgtccaaggcagggggagagatgaagggcagtgactgtggaggtggcaatgctcttcaagcattagggctaagtctggcctaggagtggcagggccagctcctgggagctggtaggtcagagagagactgttacagtgaaaaggccaaactgaaagttaaccaggtggcctaacctgagggccagaaggcgcttatcaaagatggagactccaggtaccagacttagagcaggaaatttagaggagaggctggtgagaactctggacatactccattagtagctgatctggggtgccctgtgtgtagatggccagggaacattaagaacagagtgattatgcctcccagttaatacaggacaatcccagtttatgccctgttggcccaattcttttttttttttttcttttttttgagattgagtcttgctctgttgcccaggccatgatcacagctttgcagcctcgacctcctgggctcaagcgatactcccacctcagcctcctgagtagctgggaccacgtgtgtgcaccactgtgcccagctaatttattttttgtagagacagggtctccatacattgtctaggctggtctcaatctcctgggctcaagtgatcctcctgccttggcctcccaaagtgttgggattacaggtgtgagccacctcgcctgatgccatttctttttatttttagacagggtctcactctgtcacccagactggagtacagtggcgcgacctcggctcactgcaacctctgtcccccaggctcacatgatcctcccacctcagactcccaagttgctgggaccacaggtgcataccacacgtctggctaattttttgtatttttggtagagatggggtcttgctatgttgcccaggcaggtattgaactcctgagctcaagtagtctacctgcctcggcctcctaaagtgcagggattatagacatgagccactgcgcccgactgaccccatttcttacccagctggcctcatttcttgatggcacatcttttcactttgaaaggggttccagtttggatgataaattacataatcaccctagttaaggctgtccaatttgacttaaactgttaagttcagcagagaattcctgtatacatgaagtaggagatgaagttgaagacagcagaaggaactggattgttcagggctttgaaaatcagacgtaaagcctagattttatctctgaaaaagagccaccgaagggtttatatttgggtgacaaatgcaaagcttcatttttaggaaactcaacctcatggggaactgcagggtgtattccaggagaaggatggcaagaagtgggaagaccagataggagattgtagcagttatcgggtgagagaggataggaaccagccaggatttgaggtgcaactgtaggaaaggagagggagacagtaaggaatgaaagaaggtgctgtacataaagggaacaaggagaagtcaaaagtgactctaggccaggtaccgtggcacatgtctataatcctagtactttgggaggccaaagtaggaggattgcttgagcccaggtgttcaagactaacctgggcaacatagtgagacccccatctctaccaaaaaataaaaaaattagttggacatggctggatgtggtggctcatgcctgtaatcccagcactttgggaggctgaggcaggcagatcacctgaggtcaggagtttgtgaccagcctggccaacatgatgaaactccatctctactaaaaaaaaatacaaaattagtcaggcgtggtggcagtcacctgtagtcccagctactccagaggctgaggcaggagaatcgcttgaacctgggaggcagaggttgcagtgagccgagatcgcaccattgcactccagcctgggcaacaagagcaaaactctgtctcaaaaacaaaacaaaaatattagccaagcatgttggtgcacatgctggtggtcacagctacttgggaggctgaggtaggaggattgcttgagcccaggagatcattcaaggctgcagaaagtcatgttcacaccactgtactccagcctgggcgacacagcaagaccttgtctcaaaaaaaaaataaatgaataaaattgaaaaagactccatgatcttgagcttccatggctgtgagagtgatggcaacagtgatggaagagtgatggaatcgattttcaaaaagataaggccaagcgtggtggctcatgcctgtaaacctaggactttgtgaggccaaggtgggaggattgcttgagaccaggagttctagacaggcctgggcaacaaagcaagaccctatatctacaaaaaaattaagaaattagctgggtatggtggtgcacacctgaagtcccagctactccagaggctgaggtgggaggggtgggaggattgcttgagcccaggatgttgagactatagtgagccatgatagtgccgctgcactctagcctgggcaacagagtaagaccttgtctcaaaaaaaaaaaaaaatgttggggtgataattagtagtcattgacaaggtgaattttgaattcaggttagacaccacaaggacacgtcaagaggaagcagaaaactcggcattaacatgacagagagagtagaatcaatgctgtagtcaggaagcagcatagtttatttcttaacttccagttattttctattttaaatatttatgtgtcagttggtttgttttgagggcatctagacctttaaaacagtgctacctgagctgaaatcccaactctgctacttgctaggtgtgttaggccatttgcgttgctataaaggaatacctgagattagctaaaagaaaaggtttaattggctcatgattctgcaggctgtataggaagcatgacaccagcatctgcttctggtgagggcctcaggaaacttccaatcatggtagaaggtgaaggcggagcaggcatgtcacatggtgagagcaggagcaagaggtagggggaggtgacacactcttttcagaccaaccaaatctcacatgaactaactgagcgagaaatcacttatcaccaagatgataacactaagccattaatgagagatccacagctatgatccaatacctcccactaagccccacctccaacattgggaatcacgtttcaacatcagatttggaggcaataagcatccaaaccatattattccactcctggccccccatatttcatgtccttctcacatttcaaaatacaatcgtgcctttgcaatagttccccaaagtcttaacttgttccaggcttaactcaaaagtctcaaactccaaagtctgaagtgtcatctggagatgagttccttccacctatgagcctgtgagatttaaaaaaaaaaaaagaaaaagtttttacttccaaggtacaaggtgttataggcactgggtaaatattctcatttcaaaagggagaaattggccaaaacaaagggcaataggaccatacaactttgaaacccagaagggcagccattacattttaaaactccaaaacaatctcctttgactccatgtcctgcatccaaggcacacaggtgcaaggggtgggcccccaaggccttggttggctccgcccctgtggttgcagggtatagcccccaaggctgccctcacaggttgttgggtgcccatggctcttgcatgctaaggttgcaaactgccagtggctctaccattctcaggtctggagggtggtggcccccttctcacagctccactaggcagtgccccagtagggactctgtatgagagttccaaccctacatttccctttggcactgacctagtagagtctctctatgaggcttcacccctgcagcaggcttctgcctggacatccaggctttccaagacatactctgaagtctagggagaagctgccaagcctctttcatgcctgcattctgtgtgcctgcagacttaacaccacatcgtagccactaaggtttatggtggcttgtactctctggagcagcagcccaagctgtacctgtggccctgtgagccatggctggagctggagcagcctggatgtgaggagcagtgtgctgaggctacacagggcagtagtgccctggacctggccccccaaatcatttttttcccctaggcctctgggcctttgatggggagtgggtgctgcctagaagatctctgaaatgcctttgaggcctttttcccatgtcttggatatttgcacttggctcccttttagttacactaatctctctagcaagtggttgctccacagcctgcttgtattcctgtcctgaaaatgccttttctttctctgccacatggctaggctgcaaattttccaaactcgtacattctgcttcccttttacatataagttccaactttatttctttgctccagtatctgatcataggcttgaatgctttgctgtttagaaattttttccatcagatagctaccttaggtcatccctcttaaattcaaacttccacagatccctagggcatgaacacaacccagctaagatctttgctaaggcatagaattggtgacctttactccagttcccaataaattcttcatttctatctgagatctcatcagcctggcctttactgtccatatctattagcattttggtcacaaccacttaacaagtctctaaggggttccaaactttccctcatcttcctgtcttcttctaagccctccaaactcatctgacctctgcccattgcccagttccaaagctgcttccatactttcaagtgtgttaatagcaacaccccactctcagtaccggttttctgtgttaggctgcttgcattgctctaaaggagtacctgagactgggtaatttatttgaaaaagaaagagtttaattggctcacagttctgcaggctgtacaagaagcatggcattggcctctgcttctggtgagggcctcagaaagtttacaatcaaggcaaaagccaaagggggagcaagtatgtcacatgacaaggacaagagtgagagttgggaggtggggaggtgccacacttttaaacaaccaggtctcatgtgaactaactgagcaagaactcactcatcacctaggggtggtgctaagccatttatgggggatctgtccctgtgatccaatacttcccaccagggtccacctgtaacacgggggatcacatttcagtgtgagatttggagggcacaaacatccagaccgtatcactaagcacatatctttaagtctaatttctgagcttattttcctcacccataatgtagaatagtaatatatacattgtaaggttttatgggattaaataagatagtgagtgacattcccaatatactctaagaacttagcattattattacaacacctactattatcgtaatttcctgtatatagtgaagtatggagtgagaagagagtgaaggactgagccttggattgcagtcacatgtagggagcaggaagtaggggcaggaaaaatattcatgaagaagtagcttaaggctgggggagagaaagaagaatcatggaacatgataggaagataatttcttggccaggtcaatattaatgtcatgcttcagcatggccaaaggtaacaggacttagagaaaaagccatcaacttgagtcacagattcaccgctgcaaacatttcagaactctgccagggactttgctaggcttgaggagcacaaaggtgaccaggaggccattgagaatggcaaagggggcatgggtaaagggcagatttcaagaggcagggagtgggtgacaagaaagtgtgggcagcaggttcaaactatttatttaaagaaatttggtagaagttaagcatgtccagctgatgcagggcaggcaagtcccaaagtggagcttagcctacctgggttcttggctttgcccagggaagaattcaagggcaagccagaggtagaagaaaacagctttattgaagaggcagtgttatagctccatgactgctcttgcagagcagggctaccctgtaggcagagaatagcagcttaggcagttttgcagtcatatttatacccactttcaattgcaggcacgttaaggggaggtttatgcagaaatttctagggaaggggtagtaatcgttgggtcattgcccaatgatagtaagggatggtaactcccaggtgttgccatagcaacagtaaattgacatggtatactgattgaagtctgattgaaggctgctttcaccccagccctgttttagctagttctcaatcaggtccgatgtctcagccccacctctggagtcaagtcctgcctcctacctcacagctactagtgaatttatgcagtagattttcagtttcaacactttcatagctactgctatgaaaagcacttcttttgttaccaaaacattaggggttcagtctaggtcctgttgcttgttgcacagaaagccaatcactgagacaacaagtattaccaggaaagaaggcttcagtcaggtgccatagccaagaagatgggagatcagtctcaaatccatctccctgactgactaaaattagggatttaggctggatgtggtggcttatgcatgtaatcccagcactttgagaggccaaggtgggaggatcacttgagaccaggagtttgagaccagcctagacaacatagtaagactcctgtctctacaaagaataaaaaaaaatcagctgggtgtggtggccaacacctgtagtcccagctactcaggagggaagattgcttgagtctgggaggttgaggctgcagtgagccatgattgcactactgcattccagcctgggtgacagagtgagaccctgcctcagaataaaataaaataaataaaataaaaattaggggtttatatagcagggaataaatgtaaacatatgggggaaaacaggaattagggaggagtatggaagaggagttggtcaacacgcagcaggtggttggttaggcagtcataaatggggaggggtctggcatgtcattgtgcagatgcagtgatctggtaagtttcagccccttgatactgtcagagagtcctgacggtttggttcttgagaagggttctcagataaaacaaatgtaactttctcaagtttcaagactggaaaggtaaatttctatgtttattcaaaataaaccataaacatcagttctgtgggacaattgggccggtttcactttgattcatccctgaattattactgtgacctgcatgaaagttcagttcttagtcatggactcagcatttttttatagatttccacacatttgagtaagtggaacgttcaattccagcaccagagttccaactccctgacagctcatttcaccattgagagtcctgaatttattccgtattcaatggtggattgctgactaagaacctcctctgctttagtggagtccctgaatttataattcatcagctgccactaaagtcatgttcattgccatccaaaactatttttcaaagaccatttatctagatttctgaacatgaattttctgctgtacttactcacctggtgtttacaaactgtcttttattttggggtaactttggtcctgtttgcatcttatctacccaggcagattgtaaacccttgagggcaaaaccacttgtacttttcatctttcacagagtggacttgaaatacattttcttgaagcactgactgaggttgattgcaatctcatgcattcatgttttgtaaaaaatatttcccccattgactggtttttaaattataaagtcatttttgcttattaaaaaaaaaaaagtcaggccaggcatggtggctcaagcctgtaatcccagcacttcgggaggccaaggcgggcagatctcttgagctcaggagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggctgaggttgcagtgagccgtgatcatgccactgcattagagcctgggcgacagaatgagaccctgtctcaaaaaaaaaaaaaaaaagaaaagaaaagaaaagaaattttctctgggttttaaatcctgcatttggaattccagttatgccttggagaagagaggttttgtgagtctgactctgtgtgtgtgtgtctaatgtatgctcagcaagtaaattggttctaccatttctctaaatgacaaatttggtttttcttactttgttatcagcaaactttaaactccaaatgctcctctttaaaatatactatttctgctaatgccattcccttgcagacggagtcctgctgagaaaacgttagaattggaccaggttataaaacagaaatcattgattttagggttttattacctgcagcaaggtatcatttattcttagagacagtggagtgatttctcacatgttgggcagagaatgaatgtggcaagactgacttctgactctgggatcttagcacttgtgatctggagggctaaagagctacagctggagaattactctttccatttgtaaacaagaatgtagacattttaggcataaatgactgagaacagattttgttgaagtagatgagaacttggaacaatagagccatcattgagttatacaagaggtcacctccatacatctgcctccctaatcttgacctctctttttatgagtacaattttgcaaccaagaaagttatgcaaacaacccaaaccacttggcaaataacattagagctgaatgccctagaactctcttggccttaaaaaactgttagattcacatgcctggcagtgggttcttccatgtttaaccactgcactgatggcctcatctgccgtctccagaagcctagcagtgtgtcagtgggtggatttcaaattgagatgggatttgacaccttggagttttacagactggagacttgggacccaggaatgcgtgaatcctgccttgccaatcacatcctcccccttagttccccagagagctgtgtacacaaagaacaaaaacattatgagagtcaagatccagagaagctctcttatctcatgaattgggcctgtggttagctgataaatggaaaacatcattcagagaggggaatcctaaaaaactatatatgcaaacccaccttagtcattttatttttatttaaaacacataaatgtatacttagtaaaaatcacttttatgcttttaaaaaatgctaattttaagttgaagaaaaaagtatgatatttacaaatcttttttttttttttttttgagatggtataattctgttgcccagattggagtgcagtggcatgatcttggttccccgcagcctcaatctcccaaactcaagcaatcctcccacctcagcctcctgagtagcttggaccacaggtgcatgccaccatgcccagctaatttttgtattttttgtagagatggggtctcgctatgtatcccaggctggtctcgaacccctgggctcaagcagtctgcctgcctcggcctcccaaagtgctgggattatataaaaatcttttttgcataaaccatacccataatgtgttgtctatgattttttagttttggtttctttaaattggaacaaggatttcaagacatctgtaaagcagtctaacagcagaactcttgtaaattttaatgggaaatttcccaatgttttacatttgtttcatccatgcctggttctatagcaattttggttagcaaattgctttaattttttccaaagctttcaacaaaatttttatttttaaaaactcagtttcttttagtgcttatattttattggtttttattttatttatttatttattttgagacagaatttcgcttgttgcccaggctggagtgcagtggcacaatctcagctcactgcaacctccacctcctgggctcaagcaatcctcccacctcagcctccagagtaaatgcgacaacaggtgcccaccatcatacctggctaatttttgtatttttagtagagatggggtttcaccatgttggccaggctggtcttgagctcttagactcaagtgatccacccaccttggcctcccaaagcgctgggattacagatgtgagcctttttgttttgttttgtttttttgttttgttttgtttttgagatgtagtctcacactgtcgcccaggctggaatgcagtggcacgatcttggctcactgcaacctccacctcccagattcaaatgattctgctgcttcagtctcctgagtaactgggattacaggcgcctgccaccacgcccagctactttttatatttttagtacagatggggtttcaccatgttggccaggctggtcttgaactcctgaccttgtgatccacctgccttggcctcccaaagtgctgggattacaggcttgagccaccgcgtccagccccagcccagtttttataatatttaaattacttacaataacatgtacaaatgacacatacaggtttggaaacaaaagcaaccttgactctaacaatggctcttaagttttagcgtgcctcagaatcacctggagggcttgctcaaacacatattcctgggtcccactcccagaacttctgatcagtaggtctgggatggagcctgagaatgggcattactgacaagttctcaagcgatggttgatgcagttggttcacagaccacactttgagaaccaatgtttataagaatacatctcagtcaatggaaaaagtacacaggtgtcctagagcccatgtgttccaccaaggctgctttatcagcatacaacccagccaatgtgaggcgtgtacaggtgttttaaaacacaggtgttctaactgccttgagtgtgtagcatgccctgggttatcaggattcatatggtcagagggaatgaaagcgttgcttgatcaggagttgcttaaggagtgatcagttaaaagagcatcttagtacaacttttttcttgaaacacccgagccaatttggatactctattctataacattctggaaaaggggaaagtttggagtatgtggcttagattcaaagcctaagccaagccttcaacacctctctaaattattacattagtctaaattacggggccagcataattatgggatatccctctgagagacagaaatggccgggctcagattataccccatggtgtaagagaggacattcaagagaaaaggtagagtgtgagtttctgacttttaggtatagagacctgaccactcattgttgcagcaccatcaatgtcctacaatttggaagtcagatcagcagctcctctctttgtaggggatactaagaagtgggtggccatagataggactggctgactgatggcaggcacccatatccaggattgggagattttcatcatggtgaatcaagcccagcatgaggaagttgaagctggggattgttgactgctaacacgggcccaagcaggctctggcatggccaactcctgtgacaaacagactggaccgtgtgccagggtttagccttcctcgatctcagtgttcccagtgtcaccattgattcttttgatgatcccttggttcttgagaaatgagaaatgaactattagaaggatgtggtgctagctcagtctttatgttatgactcaactctagcaaccagctgatatccaatgacgttgagatcctgagatgacatgaatgccctatccccaacataatggcttgtgaattaaacctgcaaatactaggttctactagaactctttagggagctgaagttacaaaaacaatatttagactgaaacttttttttttttttgagacagagtcttgctctgttgcctgggctggaatgtagtggtgcaatctcggctcccgggttcaagcagttctccctgcctcagccttccgagtagctgggattacaggcacctgccaccatgcccagctattttttgtatttttagtagagacagggtttcgccatattggcaaggctggtctcaaactcctgacctccggtgatccaccctcctcagcctcccaaagtgctgggattacaggcgtgagccaccatgcctggcctagactgaaacttaatgaaactttgaagcaaaagaataaacgtaacacaggttattaccctttacaaatcttcagtgtccctttgcatctttttattgctatgctaaatatgtcattatcttctccatgcatggttttgctttttaaaattttacatatgtattacttttgtagattctatttccttgttattatttacacacttttgatattaatataatcctaaaacattgtagggagtacttttttttgaaaagggactggtcttaagctcctgagctcaaatgattgccctgcctcagtctcccaagtagctgggatttccaaaaacttttttttttttgagacagggtcttgctctgtcaaccccagagttgaccctaggtgcactctctttttctcatttcacctctaatccaacaggaatcctgttagccccaccttcagtatttaccaggtgtattagtttgctagagctatgctgtggtttggatatggtttgtttggcttcaccaagtctcgtgttgaaatttgacctctgtggccaggcacggtggctcatgcctgtaatcccagcactttgggaggaggctgaggccagtggatctcttgagctcagaaggttgaggccagcctggcccacatggtgaaaccccgttcctactaaaaatataaaaattagccagatgtggtggcgcacacctgtagtcccagctacttggatggctgaggcaggaggatcacttgaacccaggaggttgaggctgcagtgagcagaggtggtgccactgcactccagcctgggagacaaagtgagaccctgtctcaaaaaaaaaaaaaaaaaaaaaaaaaaaaaagacaagaaatttgattcccaatgttggaggtgggacctgctggaaagtgtttgggtcgtagggacagatctcttcttataagaacaccagtcatattgaattagagcacgccaccctaataagcacattttaacttggttacttctgcaaagaccctatttccaaataaggccacattcgtaggtaccagggtttaggactccaacatgtctttttaggggacataattcaacccataacttccagaacaccactccccctcatcccctgcaacatcctggtttaagcctccacccttcctccctgggattactggagtcactttcttactggttttctactctcagatttgccctgtcagtctattcttgactcatgggtccagaaccctgcagtgactcccaactcattcagactaaaagctgaggtccttgcatggcccatgggtccctcctgactgcccccttctcatctcccacctctctccctcctccagccaccctggcctctttgctgatcctccagcccaccaggcagagtcccacctcctggccttcgcacttgctgtttgttttgcccaagataccctctcccagatatcctcacggctcgtattttagtcaacactcttcctaaccacccaccttctcagagaggcctctcctgaccacctctattacatcccacctgctacccactcccccactgaccctactcctattcattgttttgcttttctccagaattttctttatctcctaatagactatgctatttacttattttacttcttatctgctccccactcccagcatcattatccaaatatacgctccttgggggctggaattttggattattttcttacttgttctatccctagcacctaaaacaggacctggcccgtagtaggtactcaggaactaatgaatacatttttgttcattacacatatttgtgtaatgaacacatatttgtggaactaatgaaacaaatgaaatatttgtggaacacaggaacacatttgtggaactaatgaaaaatcagccagtgtattttctcatacattgttaaatcatttacccttattcaatgttcatcttattttctaggattttttgttgttgttgtaaacaatgctattaatagtttattgtatataatttcacccttttcctggctatttctttgggtttcacgtccagggtgaacattgtcaaattgccttccaaaaggatctttctcaatttataatgcccctaccattaataacgctgctgcctttctaccactgggttttatctcatcttatttttgccagtttactaggtgtaagtgcaccttgtgatgattttgatttgcaattctttaacttttaaatacaattgttcacatgttctttagtttacttcctatatcttcctatatgaattgcctgatatagactcctgattttttttgaggggggcagagaccttgggttcataactgtttatcctactcttttggggggcaataatattaatcctaattaatatctgttatcattttgccctcatcctaccattcccttttcctctgtttgcatttctaattctgaatgtgttttattctctccagctgtggactactgtgcctcagaaaaccacggatgtgaacatgagtgtgtaaatgctgatggctcctacctttgccagtgccatgaaggatttgctcttaacccagataaaaaaacgtgcacaagtaagttacacacacatgcacacacagagaaatatttgctgttactgctgtggtgactgtgaccatggaactctctcaagtatagattagcaatataattatgtcatgggggtctaataccttttgccccattcctcctctgtcaggactttcatgacttggcttaagaccatagaccactgtatctcaacatcactattcaaggaatatgatgaaggcaccatgtgtaggactgttccttcagcatctgctgagcatgctgacaatccgagcaacttacttcctgctaactcagcctgactgtgcccatcagcactaacagggcttgagatgttttcattgaagctttgtggcttgtgggctttagctctgactccacgcaagaaaatcgctgagccaaaaagaatcataagtgatttcttctggtggaccgcagtttgcaaagaactgctcatgttttgtttgagctatttagttcaattggattttaactgtatacataaaaatcagaattaatttcagctcccaaaatttgaacataaaattcgataaactaaagatgatcattagttttgcaaaaaagataataactagttacaaaaagattccaaaagtgttctattaaatataaaggtacatcaggagacttaagggattgtgtatggattattatccttctatagggaggatcacttgagaaaagcttgcttgttaagtattagggccaagcatttataaaaagtggactttaataacaatctagaatagggtaaggcacctcagagacatgcatcagtgagaaaacaggattttaattcataaaaagttcatgtacctacaacctttctaaaatgtattcactatgtaaaacaggatacatctgcacaaaacctttttcaacataaacttacttcctactcttcaatacctaaatatcagcagcttacaaacaccagagctggaggtttgggtgatgtatggaactataagggacacattaggtcaaaagcatacatttctggagccccaaccatgtgccaatagaaatgagtacggcaaggtccttaagggagaagataactgtggctgagtcttggaggtggagctgtcattcactaggcagaaaagggtgaggtgggggttccaggagaaggaaagaagttgaagatgtgaaccaagcagagaactgtagtctccatgccccgtgcatgactggcatatacagtggtttatttgttttgtttattgaaagagtaagtaaatgaatgagtgggctgctgtgtttgtggtctcccttcccttctgaatattctgaactgtaaaatagcagcctgtgctgtcgtcgtggttggggagttgtggttgttgggctgatgagtcagtgttcctcatcaaagaggaggccgtgggctgccagcagcgggccttggttctaatcccagcttctctgctttttctcttggtgatcttgggcaagttacttatgcctcagtttcctcagttacagtacaggatgataatgctgcctactgcatagcattattctttccttttttttttttttttttttttttgacactgggtcttactctgtcacccaggctggagagcagtgatgtgatctcggctcactgcaacctccacctcctgggttcaagcgattcccccacctcagcctcccaagtggctgagactacaggctcgcaccaacacacccagctaatttttttggtattttttgatagcagtggtgtttcaccatattagccaggctggtgtcgaatccctgacctcaagtgatccacccacctcagcctcccaaagtgctgggaatacaggcatgagccacagcacccggccatagcataatcttgaatactaaatgaggctgggcacagtggctcacgcctgtaatcccagcactttgggaagagaagcaggaggattacttgagcccaggagtttgagaccagccctggtaatatggagggaccctatttctacaaaaactgttttttttttaattagccaggtatggtgacaagtgtctgtactcccagctacttgggaggctcaggtgggaagatcactagttgggcctgggaggttggggctgtagtgagccatgatggcaccactgcactccagcctggaggacacagtaagaccttgtcttaaaaaaaaaaaaaggctaaaaagggatgatgtgggtttcaaagactttatttattatcattatgtttttttagaaataggatcttactctgtcacccatgctggaatgcagtggtgcaatcctagctcattgcagcttccaactcctgggctcaagcaatcctcccacctcagcctcccaaagtgctggaattatggtcatcatgagccaccacacctggcctccaaaactctaaaaaaatgagtatttaactgtgcatataccacgtgcctgggctacatttaaaggtgcaaaaaacattcaagatttccactgcaagctggtgagggaccttagccatagccacactgagtagctgagtcatggtgccaggagttatgtgaccaagggcctacagtgtgatgcagccaggaccacagcaggagttagaggaaggagaccagttagaccagaacaggtgagatgctgccttgcagggatgaggactggagaaaaacacatatcctagccagtctcctacctgcctctccagactgcacacactggctggggtcacctgatttccaccccagcaccagccctagttcccagagtggcaccatcttccccaccctgtggctcagcatgcctcctgtcccagatccccagcccagggtggtgcaggcaaggagggtgttggagccctggaatcagaccctggaagtagataccgcagcatagtgggactgggagaggaggtttggctaggagccacgggaggggctgatccagctgtgaggtctcaccagctaggcagcgagcccagcagtgcagttgtcagaatcaagatccagaagtgggccgccccaatgcgtgtgcagggaagagtgctgggagactggagggttcgtgcaggcagcctcagggcagtacatcccttagaagagccctcttcccaccatgcttggggtgggcaggagccagacccaggaggagggagacaagaggaagaaaggagacagagtacttggaaagctaagagtagaaaataaggcaaaagcccagtcgtaagaatgaaacactcaggagtgctccagatctgtggcagggacaagaactgagaaatagagactagttaaaattacagaaacaggatagaggcagaagctcagaaccgaagcagccaccctgttttagtgagtaccaaggcctcccaccagcttccagccaagtcggcctggttactgctgtgatgttgaaagatttttttttaaaattctacttcttatacacttgcaaaaaatgaaagaaactcagtttctcaaatttcagcctatatttttaaccaaaagtatatttgaaagcgaatacaattagtaagtgtgcaactattatctcaaaaaggtagactagtcaatgtaataaaccaagcatggttaatttatgattaagcaaaaatgtacataatagggctttatgttcatgaaccagtactataatttgaaatatgtaagtggtgttcaaaaaagcaccacctttatatcaatttcttaccctagagcagcccatccaaatctagacgggagaaaggtggaaacacacaggtaccatcagtttgcaaaaagttagcaagacttttctttttctggtattgttataaaacatacataatagaaaatttaccactgtactcattcagtggcattaaatacactcacattgtgaaaaacgcatatcctagcctgtctccttcctgcctctccagaccacaccccctggctggggtcacctgatttccacccagctgtaactatcctcaccatccatctccagaacttttcatcaccccaaactgaaacgctgtacccattgaacaataactccccattgcctgccctgtcaaccaccattctactttctgtctgtgaatttcaccactctcggcacttcatgtaagtgggattatatggtatttgtcctttgccgtctaacatatttcacttagcataatgtcctcaaggtttatctgtgttgtagtatatatcagaatttccttcctttttaagactgcataatattcaattatatgtatatatcccattttgtttatccatctgttgatggacgtttgggctccttccaccttttgcctattgtgaataaagctactataaagatgagtgttcaagtccttgctttcagttcttctgggtttttatacccagaagtggaattgctggtcctatggtagcaagactttttgagatctagattgaaacccttattcttgagccaagcatgagaaagaacactctcagatatccagggtcttttcaccagaaagatctatagaggacttcagtctgctggacagggattcatgtctttggtagcaaggagactgtgggctttgagtctaatgcttaatcatctaatgcctgtaaggatgaataaaggcaattgcggacaccatcttttgcatgttgccatttattattttcgtgcttggaggtcattatactcattgtttttcagtctccagtaataacttggttgacatttccatccttatttttcaaataagaatgctttgcacagagtaaggcactgaatgaatatttttgtgtttgcactagaaacaaaacacagaaggaagtaaactttttaaagtagagatggggtctgctatgttgctcaggttggactagacctcctgacctcaagtgattctcccagcttggcctcccaaagtgctgagattacaggatgagccaccattccggaaataattttatactgaatcagcaatagaagaactacaaagtatcggttgtcaggtttcttggccagagcatagttaacatactgagtgccactaccttcctacagcctgtaatatgccacttttgtgactccctatgtggataaatcaaacactttcagctggaagaggctttaaagttcaacctagttcttgcccaactatccatcctacaatattctcactgtgccatcatccaacctgcatttgaatacccccactgacaggatattcactataccccatggtagttcattccactttgtatagctctgactcttagaaagtgattccctagactgagctgatatctatttccttgctcttagaaatgaacaaaacaaatttggctacttgcgttctttgtggccactaagagtgagtcatatcagagtaactttatttcacttagtagactagccaggcatggaaaatgtagtagtgaccatctaaattttaataggcatttgaccaatttgtgtgtggaggaatttgtgctcaatgaatgattggttggtttgtaactggccgaatgtctgtaaccacaggatgctaattgttgaactgagatcctcctagaaggaggtttttaaacagcttgctgggaagaagccttatggagggatgagagctatcttccattcatagggtcccccgtgtttcttcatggtgtgcaatgtgtatgtatctaaactctcaaaaacacactccagtaagagtaataccaataaccttttattcattccacaaatatttgttgagtatctactatgtgtcagatatgattgtagacactgggcatgcagtaataaattaaacagaccaaaaagaaaccccaccaatatctgtccttatggagcctacattctattggagcaggataagagaatactacaggtctcaacagcaaagtaatactagtctttgattaaagatttgaaggcagtgagagaaggaggaaacctttgaggcagaggtagaaatgaaattctatgaaataaaatgatctgtgatactatcacacagcaccagtacaaaatggatatgttttagtccatttgtgttgctataaaggaacacctgagactgggtaatttataaagaaaataaggtttatttggctcatgattctgctggcgggaagactgggcatctagtgaaagcctaaggctgcttccactcacagcgggaggtgatgtggagccgacctgtgcagagatcacatggtgagagaggaagcaagagagaaaggatgaggcggtgctctttttaacaaccagctctcatgagaactaacagagcaaacgtactcattactgtgaggacagcaccaagctattcattagggattccccaccatgacccaaaaacctcccattaagccccgcctccaacactgtggattaaattttaacatgaagtttatgggatcaaacatccaaactgtagcagatatgcacacctgaagctatatatatttattgtttttagcaatgttccctgattatgttcttctccaaatcacaggacacttcccacattgttcttttttgtatattatttgggccgttttccatggcaactagtttcacaaagtacaaatgtacaaatgtgtacatttatttttagtactttttctgattacaaaagtaatacaggttcattgagggaaactggttcctatagaagtgaaattctatgaaataaaatgatctgtgatactaccgcccagaaaaaaccactgtttttgtgtttgttttgctttttgagatgggtttctcaccatgttgcccaggctggtcttgatctcctgagctcaagcagtccttctgccttggtctcccaagttttgagattataggcgcacactactgcacctagctgataaccattgtttatgccaatttggaacatttctctccagtctttttttaatgtatgtgtatggatttatttttatagagttgagatcatgcagtataataataaatcataagcattttgacatgtcacttaaacgttatcaaaaacattttaatgtctgtgtaaaattctattatatgtatatgtcagaatgtgttcaggtttttttggctgctcaaataatattgtgataaacattcttatgcttgaatctttttttctgatcattttcttaggaacacaacaaaaaaggaaatttattgagtcaaaggcaattaacattttaagtcttttgatacatattcaaaattattttctaaaaacgttttaccgatttatactctaccatcagtgtttaagggggcaatttttatttttaaattaaattaaattatttatgatttcaataggtttttggggagcaggtggtgtttggttatatggacaagttctttagtggtgattctgagatttttggtgcaaccatcacctgagcaggatacatagtacccaatgtgtagtcttttatccctcaccatcctcccaccccaagtccattgtatcattcttatgcctttgcatcctcatagcttagctcccatttaaaagtgagaagtgggatatttggttttccattcctgagttacttcacttagaataatggtctccatctccatctaggttgctgcaaatgccattcttttgttcctttttatggctgagtagtattccatggtgtatatagacactgtattttctttatccacttgttgattgataggcattgggactggttccatatttttgcaattgcaaattgtattgctataaacatgcgtgtgcaagtatctttttcatataatgacttaatttcctctgggtagatactcagtagtgggattgctggatcaaatagtagatctacttttagttatttttttttgagacggagtctcgctctgtggcccaggctggagtgcagtggcgcgatctcggctcactgcaagctccacctccagggttcacgccattctcctgcctcagcctcccgagtggctgggactacaggtgcccgccaccacgcccagctaatttttttttttttttgtatttttagtagagacagggtttcatcgtgttagccagggtggtctcgaactcctgaacttgtgatccgcctgccttggcctctcaaagtgctgggattacaggcgtgagccaccacacctggcctacttttagttctttaaggaatctctacattgctttccatagttgttgtactagtttacattcccaccagcagtgtaaacggaatttgtccatttcatcttaacacatggacacgtgatagggagcaacacacaccggggcctgtagcaaggagtggggagagggaaagcatccagaagaacagctaatggatgctgggcttaatacctgggtgatgcgctgatctgtgcagcaaaccaacatggcacacatttacctaacaaacctgcacatcctgcacatacaccctagaacttaaaataaaagttgaaggaaaaaaaagtgtttcttaagggagcaatttttaaaaatgttgctgattttctaggagaaaatttcttcttcttgcttttttatcatgtctttaatacctgttcttcataaaattatccaattatatatatctaatttataaatgtatgtttattggtgttattatttgattaatgaatattttccagtataagtgattgtaagggactcttacaaatttcatgaagcaagggactgtgcctctttgttcaacactgatcctagtgcctgtcccatggtaaatgctcagagaatatttactgaatgaatgaatgaacagggaagttaacatgtcttcatatattagacattcaagagagagggaataataaagatctgagctaaaataaaaggaatagaagacataaatcaatagagataattggtaaaaaccaaaatgtgttttttttagaagattaataaaattgataaatgtctaaccagactagtcaaggaagaaaaaagagagaagacacaaattactaatatcaggaatgagaaagtggacatcaatacatatcctacaaactttgaagcataatacaggccaagcatggtggatcatgcctgtaatctgaacactgtgggaggccaaagcaggaggatcacttgaggcaaggagttaaagaccagcctgggcaacatagagcccatctccaccaaaaaaaaaaaaaaaaaaaatatatatatatatatatacacacacacacatatgtatacacacatacatatatatatatatatacagaaaaatcataaacaagtttatgccaataactatgacaacttagatgaaatggacaaattccttgaaagacacaaactactaaagtttacccaagaataaatagaggctgggcatggtggctcatacctgtaatcccagaactttgggaggcttaggtgggaggattgcttgagtccaggagttctagatcagcctgagtaacatagcaagaccccatctctacaaaaaataaataaattaactgggcatggtggcaagtgcctgtagtcccagctactcgaaaggctgaggcaggagggttgcttgagcccaggaggttgaggcttcagtaagccacgatcacaccactgcactccagcctgggcaacagagtgagactctctccccagaccgaccaaaaacaaaagaatatagtctgaatagatctctatctattaaaagaaatggaatttgcactttaaaaccttcccacagagaagacttcaaacctagttggcttaactggtgaattctaccaaaaatttgaagaaaaactcatactaattctacacaaattattccaaaaaattgaagaagaaagaacaattttcaactcatcctatgaggctatcagtaccctgatacccaaaccagaaaagaaagacataaaaaaagaaaactatacacaaatatttctcatgaaatacctgcaaaagttatttaaacagtttctagcaatcaaatttaacaatatattaaaaagtacaatacatcacaaccaagtgggatttattccaggaattcaaagttggcttaacattcaaaactcaatcaatgtaattcataatattaacatattaaaaagtcaaaaccatatgagccatctcaatagatgcagaaaaggcattggataagatctgacattcattttttctttaaataaactttcagcaaattaggaatgaaggtggccaggcgtggtggctcacgcctgtaatcccagtactttgggaggccgaggcgggcggatcatgaggtcaggagattgagaccatcctggctaacacggtgaaaccccgtctctcctaaaaatagaagaaattagctgggcatggtggcaggcacctgtagtcccagctactcgggaggctgaggcaggagaatggcgtgaacctgggaggcagagcttgcagtgagccgagatcgtgccactgcactccagcctgggcaacagagcaagactccatctcaaaaaaaaaaaaaaacggaatgaaggtaactgcctcaatctgataaagtgcatcagtgaaaaaactatcagctaacatcatacttaatagtgaaagacaatgctttctttatcagatcaggaataaaacagaatgtccactcacaccactgctatttaatattgtactggaagttctagccagtgcaataagacagagaaagatcaataaatggtacctagattgttaaaaaaaaacaccatctttattaacagataacctgatcacctgtgtagaaaatccaatggaatctattaaaaagctactagaactattaatagcaagtgaatttatcaaggttgcaggacacaagatcaatatacaaaaataagttagttttatgtacttacaatggaccatcaaaatatgaaatttaaaaaaataccttttcaggctgggcacggtggctcatgcttgtaatcccagcacaatgggagaccaaagcaggtggatcacttgaggtcaggagtttgagacaagcctggccaacatggtgaaagcttgtctctactaaaaatatgaacattagccaggcatggtggcaggtgcctgtaatcctagctacttgggaagctgaggcaggggaattgcttgaacccaggaggcagaggtttcagtgagctgagattgcaccactgcattccagcctgggtgacagagcaagactctgtcaaaaaaaaaaaaaaaaaaaaaaagacaagccactcaataaaaatgggaaaaatatttgaatagaaacttcaccaaagaatatatagagatggcgaagaagcatatgaaaatatattcaacaacattagtcattaggtaaatacaaagtgaagtcatattgagataatcatacccactagaatgactaaaattaccaagtgatgatggggatacggagcaactggaactctcataaattgctggtgggaatgtttaagcagttaagcatacatgtcccatatgactcattcattatgcaaaaggaatgaaagcatatgtccacacaaaaacttgtgcattagtgttcatagctgctttatttgtgatagccccaaactgggaacaggtaaccagcccttcagcaagtgaatggataaacaaattgtggtataatcacatagtgaaatactactctgcaataaaaaggaacaaactattgacacacatatgaatctggatgaatctcaaaataattatgctgaatgaaagaaaccagacaaaaaagaatacatactatatgattacatttatttaaagttccttggggagataaaaaaagaagataaaaaataaaattctagaaaatgcaaactgatttatctggatagaaggtaaatggttatttgggactggagagagtggggaagaatgaattagcaagagacaggaggaaagttttgagagtaatgcatatgcttattattttgattgtggcgatggtttcatggcaggatacatatgcaaaatgcatcagattgtttttcttgagtatgtgcagtttggtttttgtcaattatacctcaaaaaaactaaaaacaagtagaagagactgtattattccaaaatttctatgtcataaaacacaaagagaggctgtggaaatgttctggcccatcactatcctatgggacactctggttgatggaaattctctgtttgcatcatacaatacagtagtcaggagccacacgtggccactgagcacttgagatacagccagtgcaacccagtaactgaatttttgtttcgttttgttttgtttgttagagacaggctcttgctttgttgcccaggctggactgcagtggtacagtcatagctcatagctcactgcaatcaccaactcctgggctcatgagatctcctggcctcagcctccctagtagctgggactacaggcaggtgccaccatgctcagctaacttaaaaaaattatttttctgctgggcacagtggctcacgcctgtaatcctagcactttgagaggccgaggcgagtggattgcctgagttcaggagttcgagaacagcctgggcaacacggtgaaaccccgtctctactaaattacaaaaaattagctgggtgtggtggtgtgtgcctatagttccagctactcgggaggctgaggcaggagaattgcttgaacccgggaggcggagattgcagtgagctgagatcgtgccactgcactccaccctgggcagcagagcgagactctatctcaaaaaaaaaaaaaaattcttttttcagaaatggggtcttgctatgttgctcaggctggtctcaaatttctgggttcaagcaatcctccagcctcagcttcacaaagcattgggattacaagcatgagccaccacccctggctgaattttaattgttatttcattttaatcaattttaatttaaatagacatattaggcagcatggttctagattaagggagactaagcagatatgaaaacgagatacaatctctgaccctagactagatcctgtactggaaggtgaaaaatgctatgaagaacataattaagtcaactgacaaaattagaatatggatggtagattaaatataagtattgtatcaatgtaaacttatgaaatttataaccatactgcagttatgtaagagaatatccctcctcttaggaaacacggactgtttttaagggaaaggaccagaatgtatgtaatgtaccctcacataggtcagagagatgaccaagtaatcacaggaatggggtaaaatgttaacaaaggtgaatctgggtaaagagtatttaagtgtttcttgttttatttttatgtttgtaactttttgtaagcttgaaattgttttcaaagaaaaagattttttaaatgcctttatatatgactatggtattacaattatattgtttataaagactcccagtgttttaaagctacattatgaagcatttatggacaaaataatacaatgtctgggccaggtgtggtggctcactcctgtaatcccagcactttggaaggctgaggcaggtggatcacgagatcaggagttcaagaccagcctggccaagatggtgaaaccccatctccactaaaaatacaaaaattagctgggcacagtggcaggcgcctgtaatcccaactacttgggaggctgaggcaggaggattgcctgaacctgggcggcagaggttgcagtgagccaagattgcgccactgcactccagcctgggtgttagagtgagactccatctcaaaaaaaaaaaaaaaaaaaaaaaaattactcaggcatggtggcatgcactggtaattccagctactcaggaggctgaagcaggagaattgcttgaacctgggaggtggaggttgcagtgagcctagattgcgacattgcgcttcagcctgggcgatggagcgagactctgtctcaaaacaaacaataataataataataataataataataataacaacaatacaatgtctggggtttgcttcaaagtaatgtgggatcttactatagagagtggggacatagctgaaagccaagcagccatagattgattctcctgaagctgggtgatatgtacatggatttattatactactcagtccatttttgaaattggacattattgtatattttgcttaacatttccataagtttaaattgggaaaaattggcatctcactcaacattttttcctttcaagaatattgtatatctttcccttactcagtttgtttcctctggtatggactgggaactctcatttataccaaattatttgttaggaagattatttatgcagttcaaatgttccttaaaataataaaaaccctcatcaaaacaaagactccttttaagattccatcagtggtcatttatttcaagcaattttaaacaatgtgtccaagttccactatgggaaaatattttgctcagattctgcaataaaagtttctttccatatttaaaaatacttatacaaaaaatacaaaaaaaagaaaaagaacaaaaacaaaaaaataaaaatacacaagtaaaatttcattatgaaaaatttcatgaaatacttttaaaaaaatattttggtttaaattaatgtatccctagagatcacattctctgtgaatcttgaggtaaaaatcctatttatgtgcagctgagcccaatgaggtaaccaggaggtgttttgaactcagagtatttatgcctttcactcctaggccttatttttcccaggatatgattttgtgtcttattgtttggctcattgtttgatgggtttaagtggtttggagtttggctttgggaacgtttaattgttttaattgcttaaattcgataaaacactcagctaaaccattctcagcctgcagtctggcaaataccccatcttcattttagtggctcttacatgaatcaagacaaggaaagcatgttcacaaatttgtttgttgcataaacgttttgtaatatgtcaggaagtttgtctttgcctagcagaagagtccaggtataataataataataatagaagaagaagaaggaaaggaagagagaaagaaagaaagaaagaaaaagaaagaaagaaagaagaaaggaagaaaggaaaggaaggaaggaaggaagggagagagaggaaggaaggaaagaaagaaagaaaagaaaagagggaaagaagaggaggagggaggggggaagagggaagagggggaagggaaagaggaaggagaagggggaggaagggaaagagggaggaggagggaagaaggagaagaaggaaagaaggagaagaagtttctcttaggagaggccatatctctaaacatggaagtagctttattgggagaccccttcatggtgtgactctttgaggtgtgggattttacctgtttgggaaaatgaagactggaaatccctggttttcctatgctagctttattgattggtttgccattcttgtgatttttccttcttgccagagatagactactgtgcctcatctaatcacggatgtcagcacgagtgtgttaacacagatgattcctattcctgccactgcctgaaaggctttaccctgaatccagataagaaaacctgcagaagtaagttacagtgggagttggagaagggcttgttctgctaaatgctcctctagttagttttcctttccgtgcaaatcttaagcaagatgtgcttgtattcagcattgtgtctattaacattattctcccctttattttactttttggctcactagatcctattatgtggatgatttttaaatattgaataggtctggccattagattcaattagccaagtggacccaagctgaagctcccacctatgtgaaatgcaggtgcagtctccctcccccttattcccatagcattggggtcttggaaaaagaaaagaatgggcccagagatgagaggtagaaggagttggtttcttctactcctacaagataagacacttgacggatgctaagagggaggacattgcagctttattccctttgataggaaagaagaagaaaaatgagactctaggacatcccagcaatattcaaggggtacagggtgtcagcgggttgatattgtggatgtactgagtgcctcaaatgcctgtcatctagcacatcaaagggcatgattggggatctgagcacaggccccagagggcacctgcttaagacaaaccattcctgagagactgctagaatggacggcccacaaggacagagacgattatctttttctcgctgctgaattctcaaaagctcaaagagtgcttggcactcatagatgtgcacaatgtttgctgaatgggaatgagtaagtgaatctttctatgatgtatcatcctggagaaattgaagctattttttttttaattcttcaatcttgttagaaagatagccttttttaggcgtgcaagttgtgaattttttttcagaaagtctttccctagttagtccacacttatgcacactgaattgtttggggtctgctgacaatgtcattcgtagaactctctggagcttccattgagggatgtaattttctgtatgttccttcacccatttcttcctgatggtgtgtacagcagtgttctgcctggcaagactgcgttttgaaaggtttcacatatatcttttttgaaaagcaccatgagctatttaactgaatccagatgagtcacattctgctcatagcacagattaactttcatactcattctagcaagtgctaaactgtgtatagtggcagatggttgcaaatcctggattttgaaacggagcctgtcttataaaactattctcactgccttgtgagggtacaaaccctgcacacattcaagcattaaatgaaaattttaatggagagcattcagaatgtgaaaacaattagataagctatttttcataagaccacacatgcctgcaataggtcagagggccaacttttctggtctggccactcctctgtgctatttacaccttttgctaggagtgggtgtgtgagggactggctgcacccaggggaaatcactcccaggtggactcaaatttgcagacccaaagctcttcagtgggcggtgattagatctggttcagctcagatgctcattgcaagcttcctcatgtgttactaatggaggggaaaaaggaaacaagttaggcttggggccatgggcggaggacattttcttgacgttctgcatgtcttaccaaccatctgagtcccttaatttctgctactccctccacacccttcctggagaggcacttggaataagagaagatccaatgcaatgcaggcatcattatcatgggaaggagaagactgagaaaggaagagcgagtagagagggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaagatcaaggcagaatcctactgaagaaaagattcttggccaggatttgttcttgctcctcatctgggcacaatttctcctcatggagagtgctatcatcagtttaaggcatgaattattaaggcagtagtgcaaagcacagaaactgcgactgccttgcctgcccaggtagagccctagggccaaatcagatgtgggttcatcccctgtgctgggctccaggatccctgattctggtaccatgatgagtgctctcaaaaattggtgtgaagcccacgggttcgactgagccaagagacgtgacgtccaggcttggcaatgtcactcatattggttatgtgaccctgagcagctactttctacttctcaggacctggatttcctaaactgtaggaacaggacttcctgccttaacaccctgttgcctctccagtttttttgaaacttactatctgtgcactcagctggaatcaaaatgtactacctggggtcactgatctttcatggtttcagtcttacctgctcagggctccaactctttcacaagttagcactcagaaagatcgtttgatttgttttctgacagtcctgtcatctgacctcacagagctttagtggacactctgggccttaccagattaagttgtgtccatcctgtgggtgccatgtcagagcacctatcatggtaccagatataggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccatttggagaaggtttttttttttttttttttccagacagaatctcattctattgcccaggctggagtgcagtggagcaatcttggctcactacaacctctgtctcccaggctcaggtgattgtctcacttcggcctccctagtagctgggactacaggcgtgcaccatcatgcctgactagtttttgtatttttagtagagacggggtttcaccatgttgtccaggctggtctcaaactcctggactcaagtgattctccctcctcagtctcccaaagtgctgggattacaggcatgagccaccacgcccagccgaaaagggtggtatttgaatagctgcctgccagattgctgggtgataacctctttaagaatctaaatggttttcagttgaattatctcatgtgtaaatcattctttaaaaaaaaaatcttgctgggcgcggtggctcacgcctgtaatcccagcactttgggaggccgaggcgggcggatcacaaggtcaggagatcgagaccatcctggctaacacggtgaaaccccgtctctactaaaaaatattaaaaaattagccgggcttggtggcgggcgcctgtagtcccaactgctcaggaggctgaggcaggagaatggcgtgaacctgggaggcggagcttgcagtgagccgagatcgtgccactgcactccagcctgggcgacagtgagactctgtctcaaaaaaaaaaaaaaaaaaaaaatcttgcttgaaacattatttactaatttattttaattttttaaaaatgtttttctttttatatttttattgtatgtgctgctgaagcgagagcttcagcatatttttttatatttttaaaattttaaaaatttttttttatatttttaaaattgttacaacatagttgtacctctttttggtatttatttattttttaaaattgacataaaaattgtatacttgtatacaatatgttgttttgcaatacgtaaatataaatttttcttaaagacaacattggcttttttagtgtggcaaaatatatataacataaaatgtaccattttaaccatttttaagtatctagtccagtggtattaagcacattcacattgttgtgcaaccatcaccaccttcaatctccagaacttcttcaccccaaactgagactctatacccattaaacaataattccccagctcctcctcctccatctcctggcagccaccaatctactttttgtctatgaatttgactattctaggtgcctcatataagtggaatcatagaatatttgtccttttgtaaccagcttatattgcttggcataatgtcttcaaggttcgttcagttgtaggacgtgtcagaatttccttcctttttaaggctgaataatattccattgtatctatacatcatcctttgtactcatcctttgatagatccctgggttgcttccaccttttgacttttatttattaatgcagctatgaacttgggtgtgtatacccagaaatggaattgctggatcatatggttaattctatatttaattttttgaggaaccgccatgctgttttccacagtggctgaatgctgggttttaaaaagagagttgactaaagatcatttcacctttccctgatggtgtaatggagtgattcctacaggcagtagactgcgggcccttcctgttctgtgtttgtctgtctgtctgtgactggtgttttattgccaggcctattttcctccatcaaagctcttggcttgtttcctggcactcagttatggcctgcacaggtgaggctgctgatgagtttcaggtagatgaatagaaactgcacacagctaacaatatcctgcctctcctcacatgggagtgagctccagagagagtgccaagggtcagtgacacagcaaggtgatgtcttttcttctacaccagccctgcatgttgtgaccttctctccatgcactctgtctgcagccattctgctcatactctgggcatgaagcaagctccagccaccagtcacctgggagggcacgtcacggattctttttttttttttttttttaattttttaatttttttaaagacggaatctcactctgtcacccaggctggaatacagtggcgcgatcttggctcactgcaacctccatctcctgggttctagcgatcctctcacctcagcttcccaagtagctgggactacagatatgtaccaccatgcctggctgatttttgtattgttagtagaggtgggctttcaccatgttggccaggctggtcttgaactcctgacctcaagtgatccatccgcctcagccttccaaagtgctgggatacaggcatgagccactgtgtccagccagatcctttaagagaccctttgaggggtccttcaggtctgggtcccattcacatttccatttttactagcagtggatcttgatcaagttattaacctcgctaaacctcaattcctcagctttgaaatatggataacaggccaggtgcggtggctcacgcctataatcccagcactttgggaggctgaggcgggtggatcacaaggtcaggagatcgagaccagcctggccaatatggtgaaaccccgtctctactaaatatataaaaattagccgggtgtggtagcgggcacctgtagtcccagctactcaggaggctgaggcaggagaattgcttgaacccaggaggcagaagttgcagtgagccgagatcacgccactgcactccagcctggatgacagagcgagactccgtctcaaaaaaaaaaaaaagaaatatggttaacaatcacacatatcttgcagggtcaaatgaagttatgtttgtaaagtggttggcacagcatctggcattcagcaggtatttaagaaatggcagcagctatgatgctatgattatcatcactaatgtaactatcagactgccactaatagtgagaaaaataaagatggcatggtccctgctcgtggaactcagtctagtgaaagaaacagactttgaagcatcacagatacaaaacatactacataaccattgtgatgaatgctacgaaagagaggtcctgtagaaagaactgacttcatctacgaggtcacaaaagatgacaaaatgatgttgagctgatcgtgaaggaagatagaggttagccagtgcagcaaggagccactgagacaagagggtgatgtgtcatatctttaagtgatttgtggatgtgagcttcgtcaaataacttttgggcagatacatggtaaaaataaaatctagtcattactttatgatttcagatcatttcccctgtatcagttatggtgctttttgttcacacaaaaccggaaatccaattaatggtgttttaagtcagaaggacttttattttttacctgacaagtccaaaggtggttggtcctatggatggctcagtgactcagtgatattatcaagaacccagactctttctgtctttctattctggcaaagtatgttgcatttacattttcatccttgtcacctcttggttacaagatggttgctgcagctaccagcatcatatccttacactacaagactcaaaggcagaaaggacagagagcagagaaaagcatttctctttatacacttttgtcttttttttttttttttttttgagacagagtctcactctgttgcccaggctggagtgcagtggcacaatctcagctcactgcaacctctgcctcctgggttcaagcgattctcatgcctcaggctcccaagtagctgggattgcagacgcatgccaccatgcccagctaattttgtttttttgtttgtttgtttttagtagaggtggggtttcaccatgttagccaggctggtcttgaactcctggcctcaagtgatctgcccaccttggccttccaaagtgctgggattacaggcatgagccactgtgcctggccacctttgtcttttcaggaagaaaaatctttcttgagggcccccagtaagcttcttatgtttcattggtcagaactagggcatattcccaccccttgaccaatgactgacaaagaagaacatggttgccacgctggcttagaccagccatgactcatgcttgggggtcatggggtaatggttattggcaagacaaccaacagtgtctgccacatccccagaaaaagaacaatgctgtgcagttaaactgatccagcccagccaatgaggtcggtggtgaccttttcccgcaacaccagtctcataaagcctctccacaagctcattttgtgtccttttccagttctctatcttccctggagcctgctatgtgtggggtcttatggctttagcattttctaccaggaaaggaattgcttattggctcctggttatgacacagtttccatctgctggcagaaacacagcatggatagagtgaccttaccataggacagaattgcagtagcctggggcagcatcagagatacgcctcctccagtcccacgatactatgccagcgtggtctcaacagagcaaggcgaagcatttagatccttcttcatgaaactgccaacccctgcgtccctaaatagctggatattttgcaagatcaccttttgtttattttgccttgtgccgtccaatgtcactgtcagatgtcactgtagacagaagctctctacatgctttgagcccaagtgatcaggttaacctgagagagatactggattttcttagcttttccatctttcttggaaggaggtaggctggggagcgtggctctcaccccagctctcagctctttggccactgactcagttcagctcagctcaactgagccttggcttgctctttggccatcaaagagggaaaatgctggagaatccacaggtatacttcaggtgccaggccctcttttaaacaagctcctggagagcaggagctattttctctgtgtcctgtagctcacctggtttcctgaagatttagtgaagtttgcctgcctttccacctctactgcaaagtcttcttcaagacataaccctggccttgtcacctccaccaacattctcacctctagtcacctgtttagagccttcactgatccatcctggggcttgcaaagcccgcacgtccagtcatgctcaggtgggccagctccctctgcctcccagcctcatctctctcctcacactccagccatactcagctcctcacagctccccaggcatgcccctcgccctcatccccaggcatttgtgttcactgtcccctcatccctgggcgtttgtgttcactgtcccctcatccccgggcatttgtgttcaccgtcccctcatccccgggcatttgtgttcactgttccctcatccccaagcacttgtgttttttgtctcctcaccctcaggtgtttgcgtttgctgtcctcgagtcctcatgttcttcttcctgttgagctcccttacctatggaactcctcctcctccctggggcctcctgttggccttatctcttcttggaagaccctctcaccccaggactcagtgaggcccctgctctgtgctctgcattgtcttttagttgctgtccttgtctgactcctcaccagagcctgaacccattgaggcagggcctccatctcagtcgtcattaaatctctgaatctagctcaaggcctggcacttggctggcagacaaacgaatgaatgatccgtcccggcttgcctcagcaggcagcacccaccagccctctccatgggggctcatgggagccccgaggggctgccatcagccctgggagaggtccagagtctgaaggaaggtctgcccttcttcccctcagggatcaactactgtgcactgaacaaaccgggctgtgagcatgagtgcgtcaacatggaggagagctactactgccgctgccaccgtggctacactctggaccccaatggcaaaacctgcagccgtgagtgtaccctaggggtggggtgctgatggaaggtggggtccactcatgggggcgggcgggttcactagcaaccagttatttctggagcccaccgggtttcctgatggtctgtcaggtgtatccttccttatcctcagtttcatcacccatagaatgtgactattaatgctatcggcctagccaacttgggttgcaaggattaaaagaattaataggaataggctgggcgcggtggctcacgcctgtaatcccagcacagggaggccaaggcgggcagatcacctgaggtcaggagttcaagaccagcctggccaacatggtgaaaccctatctctactaaaaatacaaaaaattagctgggtgtggtggtgggtgcctataatcccagctactcgggaggctgaagcaggagaattactcgaacctaggaggcagaggtgcagtgagctgagattgcgccattgcactccaacctgggcgacaaagcaaaacttcatctcaaaaaaaaaaaaaaaagaataggagtaaaatacttagaacagcactgctaggcataagcactcaataaatgttaactaatattagtatttgctgttaagtgtatttactaggtcagacaggtctaatttcaaatccaacctctcccacctactagatgtgtgtgaacttgggcaagttatttaacttctccatgctttgatttcccatttatgacaaaaagcaaaactaatagtcgtattattcccacagggtttttatagggagaaataggagccattttgatatgttagcctggtgcctggcacagggtaaacttccaatcaaggggaactgttcctatcatggagcctgtgagaggggccagtgcctggcgccagactgggacaagaggccggaggggacagaccttggaaagcaatgggctgcagaggctgatctgagagcagaatcaagaaacatgggattttctgagaaggcttgtcttaattttcttgtgtcagagccacaacaaagctccactgggtgatgtaaatgtatgggaacttgcaagctctgccagctgggcggctccatggttttttatgaggcaccatctccacgggtcctggccagcaggataggagcgcctgagtgtggtgatggaccctatgcccttggcatgcgggagagggggcccatctccatgacatggcctatgcagaaggggccctttatgtgcctttccactcagcaagccccacatctgctccctttggagaaagagatagattgtgagtgaggacagtgcagctgttgagccctgggctccacgctgccagcagggaagtttcccagatgaaataagaggtccagggcagtcctcaggaaagcgtggctcctccagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcggggagcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaagacagcaagcaattctgaggcgctcactctgtgcaggcaatgccctgagcacttcccatgcataaactccctgcatcctcacagccgccctactgggcacccacattcttgtcgctatttaaacaagggcaaactgtgacacaaagggattaagtcactgtcctggggtcctgtgattaacaaatggcaacactaggatgtgaacacaggcatgtagctcccaagatccagcaagtgttcgcaggagatgcatccaccagtggaatgttctggaaggcactggtcccagactctgcgggagtcaagaggcccacttggcagacctgcaccaggcctccagtgtctgtccagtctctggaggtgcattttctccataagggaaacctgggaagcagcctgcagggctgttagtgggagctgttcaccacagctgtgtgttcattagccttcggcacttgctgcccggaggaccagctgtgcagcattcggatgccaggataggccacacatgcagtcccaggctttggtttgttttttaatctggatgtcctgataatgggggtaaaaaaaatagaaattgatttcatggagaatgacaactctttttcattttcaattagaaatgaaactatatgactaattcttactcagcactacttgataataatagtgtgttcattaagtggttgctgtatgctagctactgttctgagcgctttacataatcaacccctcttattctcaccctattcctataagaaagcaaccatcaacatccacattcacaaatcaggaaacgatggcaaagaggccgtgggactgcccagcatccatagctaggaagtggcagaggtgtgatttgaacccaggtagtttgatgccagaacctgcattctaagcactactctattagctgtgtggctttgatcttgaccttcctgagcctcactttcctctctgtgaaatgggaattgcacctgctctcagaggtgccctgagactgtggattctgtgcgccatggccctggcagagtgctgctgtcgtcaacaccagggacagcattccccagccattggagttgtatgctttacccttcaaagaaagaaatgggaaagaaggctgggcatggtgtcaggcacctgtaaccccagctagctactctggaggctggggcaggagaatcgcttgaatccaggaggtggaggttgcagtgagccgagatctcgccactgcactccagcctgggtgaaaagggaaagaaaaccaacaagccaggctgattttctagagggatcagtgatgtggggtagaatgacaccttccctgtggcttgttatgcctccggttttgtttttgaatcttggttgctggtggggtattgccccctcggctcctctatgctttcgcgtgtgtgaaaatgcaggagtggaccactgtgcacagcaggaccatggctgtgagcagctgtgtctgaacacggaggattccttcgtctgccagtgctcagaaggcttcctcatcaacgaggacctcaagacctgctcccgtgagtccctccgcgctcctctcataggggaaggtttgcaccaggagtgaaacctatgtgactgcagagggcacaggttgtacttgggcacccctcccctgccccttgctctgctccaggagatagtgaggatgtccactgggactgcatgccttcgagggagggcggggtgagcatgacggtcacttgatccaatcactgtcgcccagaggtctcactgataaagggctgcctggcttttggttttgcaggggtggattactgcctgctgagtgaccatggttgtgaatactcctgtgtcaacatggacagatcctttgcctgtcagtgtcctgagggacacgtgctccgcagcgatgggaagacgtgtgcaagtaagtgtctgaaggacaagcaggacctgcacaggtgttccgtgggtgccggtgtgggtgcgctgccgacgtgtatatgtgcctgtgtgtcctgtctccaggctttgctgggcctgcatgaatgtgtgtgacagcatctcttagccattaagccttggtggctgcttcaccaactcccctcaatcttccttcccccgtgccctgaagtggctttttgctgtttccacctccctgtcattctgaagctggacagagcccttgtcctcagctctctctgctctacccccagccagctagtatggcacatgaataataataatgtggacccctcactgactgctagctgcatgctgggcactgtgctaagcacacatgctgttgcattcaggggacagatgaggaaaaactgtagctcagattaagtaaagagcctaaggtcaccagctagtgagtggtgggttcaaactctgctggctgtgattccaaagtcagtcctgggagaagaggatgctcctgagaaacgctttgccctgctttctgaccccggtgatctcacagcacatggtgaggctggcagtgatgtgtcctgggtacatatttccttgcagctggtcccaaatcttgtctcaattaaaaaaaaaaaaattgctcccagacctccttctctcctttactgaagaatgctggtgtgtttgttgccctgaaatcctgtttcgaagtggaccaagataaagaatcgaaatatggtcattttgagagaaggaatcagaaatgaaagaaaaggaccaccatttatcttccccagcctgctggtctttctggttatagggccaagttccctgaccactggtataattgtaggcacaacctaatttatccactttttatatcatctattcatctaggcagatgagctggctgcacagctgggcgtgcctctctatgctgcctgtgagaaaatatttccagtttgggacagatccttggatcttagcaaatgggttatccatgttatagctttcggtggctccctgcccagctgcctcccagactgctgctgcagccagctcagggagggatcgggcacagggggtgcagaaagagggtgggtgtgttgaactgcatcgacattgacagcatgccaaagccagatgtaaggggtttgttggtttgtttaattctccatcattttagattattctgagaataagaggagtcattcttctgtccacctcgttcctgtaataatcaagaactgactacaagatggttgtaggaccctacgaaattctcatgagcccttctaaacaaatgcagctccatctcctttgaatcaggtgccccttcctctcccctgcccaggtccacatctggattttgacctgaccacttttaagtgttgcccattttctcatttaaagtgggtttctaaccaatggcacagtggaaccatctacatgagtaaatgtccaacaatgcaatgaatagtgaattttgttatttatatgtggttgtatctagatgagaacttgtgagatagtcagataagtgagaattgtcctcaggaaccgtataggagagatgcatttcacccaccagctgatacatatgcattgagctattcccctaattgaagactttctgcctgtcccagaatgattcattctgactgtcctgtcctgtaataatgggctaggttttcagcgtggccacagctaactgggggttgggatgtgtgttccccagctctactctcaatgacaaagggccagacgacatgactgcacctatttggtaaagccttttggggggcagtcaggcctggctcagcagataagagtgtccttggctctttatagaggcagcctccacttagagctttgatagcaagtggtcttaagaatgtgtcactcaccttctggaaagttctctgaagtgtggaggggttccaggggccctgggatgagatgggcactgctgtgcccctacctcttcaggcaccttgggttctctggcctctggagcgatgtcccctcccttcctccagccccctgaccgcaagctctgctttcccagattttccccagaggcctttttgcctcgggcagttagatgcacagactcagggtgtggggggtcggggaggggatggggcgatctcttttaccagctgcagctgcgcagactccttccctctctagacgtttccctgagattgaccttgtgcaagggcatcccagcaccaagaaagactctataggcctgatgtgcatggaccacactgcccactggcctgcaagctcctggaggttggaggtcagaggccaacatgaaatgactgggagcgtgaatggacagaggccacctgtctttttgccccacggcccctggcacagggtccgctccccgcttgataaccttcagtggctctccactgtctcccagaataaatttccattgcactccttgatttggcagagtgcagaaccccctcttccacttctttagcctcaccccaggccctccctgaagccgcctcctgttctttagccaaagtggcaagtcccccattctctgaacaggcctggtgccttccagcccatcccaatgtcacccccatgggtaacctcctctcccacctgataggctctcctctcctcctcccaccccaggctctgctggggcctctctgcagagctctcctgcccagcctcaccctggggctctctgtgcacatgtctgagaaacagtgtggcagagcagaaagagtactgaactggaagcccaaagactgggtttaaatcgtgtcgcttctaccctaggcaagggaattggccctcttggggtctgactgctcatctctaaactgagaatggtcgttgctgcctttcaaggccactgtgtggttcagggagactgctgttgcagtgctatgtgaacttgtggactgccgtgacccctaaggaattcctcttcctctctcccctcccagcatcagaaccccctgcactgaggagactcagaaggtattgctgcctggaaacccatctgccagggccaggcctgctctccttggaggggccccagagacacacaactctggaagtgggctggactcaggagtccaagggctgtcctatgagggaccctcccttctgcaagcggaggacaccaacggggatcagagccgtcagcctagggcactgggggatctctgctggtgatactcccagtccaactaccacaggcagatctgcgagggcctgttaggctgcctgaggccctgagcttggccttccagggctgaggcaggcctaggcgaggctaggggagtgtcttagtctactcgggctcccatcacaaaataccatagactgaatgttgtttcttaaccacagaaatttctttctcacagttctggaggctggaagtccaggatccaggtgctggcatggctgggttctggtgagggccctcttcttggtttgcagacagccagcacccagctgtgtcctcatattgcatgggttgtagggggtgagagagcaaaagagtgcaggcaagttctctggtgtctcttcttataagaacactaatcctatcaggtcaggatcctgccctcacaaccccatctaaacctaattacctcccaaagactccacctctgaataccctcacatcagggttagggattcagatgtaaattttgggggaaacagtctgtagcagggagtagggggaggggaccaccctcactctcatgtattcacattacaggcttgatgcaacagaaggaaactagagattttcccttattttgtgggaaacggacacatggaggaaagtgatgcctccaagctggccctggtcggggagtcagtggcagagccaggaccagagccgagtcccctgattttaggatcttttgcccagtgtgagatgccctggaaaagcacatctcagttcagctgcttcttggtttgtctgagaaaaagcctatattaagttagcaaaggattggctgctgctagttttattacgagaaaagccaggaagcagtgtaattctatctgtcggcttctggttactgtcttggcagatggccactgtggctttctctctctggggttggggttggttttaacaacgtcttatgtggagccccagacgcaggattgctgtctgtcatcacggcagaggtgcaagtccacagaacacgttgccccactgttgctgcgccacagacttacgtgactcacctgtgtcagcgtgcagggctgctagacagggaccctaaagacccgtgctacatcctaaaacttctaatcatcctgagcacacgctgcagaatccattcacgatgagggtttaattaaacacataggcctgggtccttatgtgtaaaaggaggagaatccttctttgagaggaaaaatgttttctttctccctcttgagatttcttacatcctcccacctatttcacttaagtgatggctcctaatggagtctgtctttactctcctctctgggtttgaatctaggtacttccttaagcgcttggttcctttaccctcgttctctacaaatatttactgtgtacctgcattgtgcggggtgctggggatctctggggttgatgcagattcggtttgtgccctgacagtgtttaaagcttctcggggaagaaggatagcagagacagcgtccattccttatggtgagagtggtgatgtgagaaggatggagccgtgggagcaccccctagtctagagaaagagaagtttaatccaacacccagaggagggggctgtgggagcctcccctagtctagagaaagatgtttaatccgacacccagagagtgagtacagtgagccagccagagatggaggggaaatgcttcactaggggccagagagcgaactgcaggaagttctgtgctctgagtacggggtactgaatgcgagagggaggcggtgggtgagaaacgagcctggggacgccggcgggacacatcacccacctacagccttcagagacttcctggctggcctctcttgagaaaatgatttttgtctagtttgtcttctgagaatctgccaggctgcctcagcacactcccttaagctaggatgatctgtggatgtgcagctggaccagggacacggaggtctatttgaatatagtcccatctctgcccccaggacagctaagaccagtcacctctgaaggttcagggacattgggaaagtcacttcccctctgaccatcagttttctcatctttaatgaaggggttggactagttcatatccaatgagttgaacttccagcacccaaacaaggatattgcctggctcagataagtgctccgtaaacacttgctgaatgaatggacttactgtggtgcccaccatagtctcccaggctgaagacacccagtggtactgagtcaggggtggtggctctgtttgcctgttaggggaccactgaagcattttcctataggggagtatctttgccctgggtagaaactgactccaagttggtttccagacttggtggatagaaagctagcgcctatggtcaggaggttaactatcatccacctttggcattctctaatttcccatccacggttctttgaatttataagtggcccagaacatccctgaagggcagaaactggacattttgctgaacaaatgtgagtcgtgcattttgcaaggtgggtgtgtgggagagagtgggaagcctagctggccacaaacatccacacatcccatggggttcttatttaaaacatctgcacaaaacccctgtgaggtggatctaattaccctcaattttcagaatagcaaactgaggaaatgtttccttttgttcaacaggtctttcctagggatctgttaggtgccaggcattatggccactgccaacatctcacctctgatgattcgttgaaatcatctatggggctaggaaaaagtctaaaggcccaggcagcatcccagaaaccctgaatcagaaacagaaacagagactgtcttacattgttggtgagagtagagattgaaataatctctttggaggatgacttggaaatatttatctgcctttaagtattcataccctttacctaggcaattctgcttctggatgtgtaactttcaggtatgccttcacattgtacataaaactacatgcacaagaatatccattgcagataaggtgtggtggctcatgcctgtaatcccagcactttgggaggctgaagcgggaggatcacttgaggccagaaatttaagaccagcctgggcaacatagtgggaccccatctcaacaaaaaatatgaaaattagctaagcatggtggcatgcacctgtagtcccagctactcaggaggctaaggtgggaggatcacatgagcccaagagccaaggctgcagtgaactgcgatgacaccactgcactccagcctgggcgacagagcaagcctgtgtctcaaaaaaaagaaaaaaaagagccttagctgaagctaggaggacaggactgggcacaagggaagctccaggaaggaagggcttaggggtctgtctggattatggcttgacaaggttgacgtgaaagagctatagctattttattaccatggaaaatggagtagtagtagtattataaattcacggtagggggaaaaaaaaacacctcacctccatggccatccagttgtctatatcatggatcactcaactctactttccactcttacaccatgtgaggaactatcccaaaccatcaggaaatgttctgcattaatagtgagtctagaatttgctgagaaaagcaagtcatgctcagggcaaacaggagggtccaactcggctttgagcctcctctgcagctgtaattgcagttatcaaacttttcccattcttcaaagattttggcagtgcttctccccaaagaaattcccttcacatttgaaagcttgctgtagaatatagcaatgtagtatagtcagaaaatacggggatttatttataagattacaatttttgtctggttctttctcttgttaacaattggtcttgacaagccatcagccttcccaacccttagtttccctagctggtgagtgagaataacaacagctgccttaactaacccaaaggtggttctgaggagtcctctccagagagatactgcaaagatgctttaccaaaaaaagtgtgtggtttgtgcctgattataaaggtcattatgtgctttggggcctttatttaataattccgattcatgtccattttagaaattctactcaatctgaaaggattgagttaactttcagaaatatgtagggttcttataaaaagtcaccactcacctatcctcagtattaagcttttaaagtaacagcctggttttcacaggttcacaaaccttctagtcccccagaagccacccagccctgtaagatggcaatgccatccttcagttgctcagtccagcaacctgggagtcttccttgactcttctgtcctatccatatgggctctttgtattaatccatgaacaaattttatagattctaccttaaaatacagccagtctgaccacttctcaccagcctggtctgggccaccaagatctttgcacagggctgctcccaggtgtccaagctccattctgtgcagagcgatcctttaaaaacaaacccatatcatgccactccactgctcaaaacactgcagtgactgcccttctctttcagatctgacccccactgtgaaccccacatggtctgccccagccaaccttgctggcctcatcccctgccaggctcccggatgctccagtcacagtggtctccttgcctttcctgaaacacaccaaccaagcagctcccgttgctgcagtttgcaaatgctgttctttcttgctgataatgctctttcccagacaccaccactcacttcctgtctttctgcagggctctgctcagtgtcaccatatctgacacaccatataatataacaagccctccctactctccagcccagtagccactctccatccttctatcctgctcttcctccatagcactttttcccacatgacatatcacatatttgtctgttttccacgcatccctcttctcctgacacctgctgccaaatgtaagcttcacaaaagcagaaactttgtttcgttcattgctatatccccagagtctaaaacagtgcctggctcattgcagggactcacaaaatatttgtgaactgactgaatacatgaatgaattggttacctaagtgtaatatatacatacatacataagtagatatgtaaataagttgatattatagttacataatagccagttaggttaatcttattttctaatatttacaagtaatttatctctcattctgtaacttgtattctcatgttttttgttcatttttcttgtggagatgatttatattgtttgatttttatgtgccatgtgtatattaagaatttttgctcactttgggagtccgaggtgggtggattgcttgagcccaggaattcgagaccagcctgggcaacatggtgaaatcccgtctccacaaaaaattagcctggtgtggtggtgcacgcttgtagtcccagctatctgggaggctgagatgggaggatcacttgagcccgggaggcagaggctgcagtgagttgagatcacgccaccacactccagcctggatgacagagtgagaccctttctcaaaaaagaatttttgctcatagacatgctttatattctgaaatgtgtactgtaggataaggcactgttttaattcaaagtgtctgaaatgtcttttatgattgaataagccactaatatatgagtcattttcttcttctgtttctctaattcccatttgattctcagaattggactcttgtgctctgggggaccacggttgtgaacattcgtgtgtaagcagtgaagattcgtttgtgtgccagtgctttgaaggttatatactccgtgaagatggaaaaacctgcagaagtaagtttgtactggagctggctcctactactatgccagaccactgtgtgaaatcgctatccttatctctgtatatatcagttcctctcagaagtcaatgccacacagcaaaatgtaatgtagtgtcctggataggaccctgaaagagaaaatggacattagggaaaaaataagtaaatgtcaataaaatatagactttagttaataatcatgtatcagtatgggtttatcaataataacaaatggaccatactcatgtgagttgttaataatagggaaaactaggtgtggggtatattgcaattctttgcgctatcttctcaatttttgcgtaaatctaaaactgtcctaaataataaagtctattaaaaaaatggacaaacaaaaaaagtcaatgccagagctactactgaagttcttcacttatatgctctgtggcaagaaacagtggtttggcagtatactctagtggaaagatggacagtcagaaatccaagattcagtcaacctctgtctctgccatttattagctgggaaagttgcctaacttctctaagcctctctgcttatttatctttaataatgttgttgttgttatttctggtagcacaaatccctcccaaagggcaccttgtgatgaagccagttttgcctttcagaaggcaaagcctcttagatggggctgcagccagccagcccaggacaagcagccttagagtgaattgctggtgtaaatctcaagacacatctctgaataatcaaaggggagtgtgtgaccctggtttccatccatatcagttatctttttctcaacgtctcaaagcactttataaagagcaactcatgttgacacttttggaagaaaagatgggtaactggaataattactctctcattttttggacagcacagctaagactccaagaagttaagtgattctcctaagtcatacactatgttaggcacaaagccaaagttagatttcagtgctgctaatctaaattgaggtttaacctcctaaggaatcatatcaagtgtttccattctgatatcagaaactatgtctacagaaagttgatgatggactgcattttaacactaaagtagtgctggtgaacgatgatggtgaagacagtgaaacagtttgaagggttagcccgaattagagccgctaaactttgttctcaattgtaacttcctgccccatggaccactgagctcaggtggcagatagaatccagtagctgactccagtggatgggtcctccaaggtgaagtccatgtgaaatgtatgttgttgaaattgttgtaacttgctctcctgtcttcagggaaagatgtctgccaagctatagaccatggctgtgaacacatttgtgtgaacagtgatgactcatacacgtgcgagtgcttggagggattccggctcgctgaggatgggaaacgctgccgaagtaagtagcctcgaggtggagaagaacttttccctctgtggactcagacagttagagaagttcatttaatccttaaagtcctcctttattaccactgtcacaagtgtcagttcctgccttgggtgctctgaaagtgtttagctagagatcagttcagtagccccttgctttttcgggaatttctcagtcaaggcctgagttttgggttctttgcttctcttcattttctgccagccatcagccctttccacagtagctgtgtgggtgcccggaaactcgcacagtgctagtcactggactgaattagaacctctgccagcaatcactacaaggactgaaggttaattacagagctttctcctcttggcagaccgtaaaagtaagggcaaagggtgaaagggtgtattcgtccattttcacactgccgataaagacatacccgagactgggcaatttacaaaagaaagaggtttgatggactcacagttccacttggctggagaggcctcaaaatcatggcagaaggtgacgggcacatctcacatggtggcagacaagagaagagaacttgtgcagggaaaccccctttataaaaccatcagatcttgtggagacttattcacaatcagaatagcacaggaaagccccgtccccatgattcaattacctcccaccaggtgcctcccacaacacgtgggaattgtgggaactacaattcaagatgacatttgggtgggacacagccaaaccatatcagagggatttcctgtgggttttttctattatttttatcatttgcttctataggtcacccagaacaggctctgagagtttcgttagaaggtgtattccccagagttctccagagaaacagaccttctctatgtatatcttcatcttctattatatataaatataatagaagacatatatataatatatatatgtcttctatggtctgttctatcttctatttatatatatcatagaagatatatatatatacacacacatatatatgtgtgtgatgtatatatgtatactatggtctgtttctatcttctattaatatatcatctccacaggaaaaatggacatacacacacacacacacaaacacacatatattgtgagggaggaaaagattggttgattttaagggattggctcacacaattgtcaggggctggcaagttctaaatctgtagggcagcctggagacccaggcaagagctgatgctgcagcccaagtctgaaggcagtctggatgcagaattcccttttcctctgaggacctcagtctttttctctttaggccttcaagtgattggatgaggcccatctacattatagagggtgatctgatctgcttcactcaaagtctactgattaaatgttaattgcatctaaaaattagctcacagcatcatttagactggtgtttgaccaaacaactgggcactatagcctagccaaagtgacacatcaaattaaccttcacagtacccaaaggaacagagggatgtcatacgagctcagtgaggtgggcattaggagagtacagagcagggatttttccccaccatgagattctgagctggtaattccctattttggggggaggggtggttgacaaagtctacttgcttttgtgacactttgccccagtgggcaaaataaccctttttcaattaagtcaaaataagttcagttgctttgaggttgatttttgggaatttcctcacagactcctttgagataactggggatattccacaagccaacaaggctgggttggagggatctcaatacctcgcttcttcctccaggaagagggactcctacctttagcaagaagttctgtgtgaatgactgacacctaggatgcctgtggtaccctggcctaactctgcagggattcccctcacaactgcaggtccagcttcacactgcagtggccctcttgtggagattttgtctataattctgcccattgtgcctgtctgcactgcttgttcatgcttttctttttgtttgtttttgttttgagacagggtctcactctgtcacccaggctggagtgcagtggcactatcttagctcactgtaatctccacctcctgggctcaagcgatcttcccacctcagcctcctgagtagctgggactacaagcgtgcaccaccacacccggttaatttttgtattttttgtagagacatggtttcaccatgttgcccaggctggtcttgaacacctgagctcaagaaatctgcctgcctcggcctcccaaagtgttgggattacaggtgtgaaccaccatgcccagccctcatgcttttctttctgcaaacatctgcacactcacacacacactgtttattcattcaacacatttattgctcagtaaattgaacacaaggtacaacttctacctctggaatttgatcctaaatcagatttcaccattcctgcttcctagagggatgtgttctcactgattccaattttgtgtgaagcctctccttttaaggggtaatgacaggaaagagccataggctctcatgctatggaggagcactcgggagacagctgtgtcatcaacctgccagatgaccgtgggcagcagtgaagctctctgaggatctaattcttcattgataccttgagaataattatccctgtcttccttgtctcacagggtgttgtgagggttaaagggctgtaagtacttcgaagagtttaaattacctcacacatgagaaatgttcattagacaatctgaactggagtgtttgggatgtctgtggcaaaagaaattagaagctaaagcacatctaataataggatagtaagtcaaggacacctaatcacccatcgtaccattcagactcatgggagctagagctttctgagaggagctttttccccatcctgagtatgagactgcaaaagacattatgaaggaggtttgaagagaggtgtattttctttaaaagagattacttccacaatctctactcacatgactattcaattcacctcatttctacactgatgggattgttcaactccctacattttcctcagggaaggatgtctgcaaatcaacccaccatggctgcgaacacatttgtgttaataatgggaattcctacatctgcaaatgctcagagggatttgttctagctgaggacggaagacggtgcaagagtaagtgatctgaacttggctctctgctttaattttgttttggagcaactgctttttggagtattttcaggcaacaaatccctcacctctgcttctcccataaatataaatgcatatgcacaaatacagaatggggaagagagggcttaactgcagcacctgtgaaaacactttcggttttaattgacagtaaattcattatcagccaagaggctagggtgatcgtaggctgaacagcaatgtctgcatgagggaggtggagagagctgtgctctgctctgtgctggagaattacattcagttctgggcatggtactttaggaaaaaagagatggatcaacagtttaaacataaaaaaaaaaaaaacacaaaagagcaaaaggagtcttgagagaattattttttaatctgagagtagagaagatctttctaaacatgacatgaaatttaaaagccataaaagaaaaacaaaggaaaatatctagtaagagagtaaagctgtgatacctttttttaacctattagttaacctattagttaccagagatcaaaaagtttgattccttatgttggcaaaggtatattgtagtagggaattataaatggatcagtgagtgtctgaattggtataacctttcagagggcaatttggcaatgttatcaatccagttctagaagtttatcttacagatacgtgcatgtttacaaagccatgtatacaaggatattttatacagcactatttgtagcagcaaaaaactggaaacaagctaaatgatcacccatgagcctggctgaataaattaaggcacatctatgtaataaaacatgatgcagctgttaaaacaacaagcagctctggatgtatccccaagatattttaagagaaaaaagcatggtgctgaatgttttttatagtatgttaccatcgatatattttgtaaaacactctaacatacagtctctctttctctatatatgtgtgtgtgtgtgtaccattatatacatatctaatgtgtatacccttatgcacacacacacacacacacacatacacacaccctttttctaatatttaagttttgttccaaatgcatgtattattttttagaaaaaaataagataaacacgatttagaaagaattaagcagcatgatcttgtgaggaagttcagtattatgttaagcagaaaaaaattaggaaactggggatctttgtagaaaaaaattttgaggtaccaaataccaatgtgactgtcatctcactcatgatttgtatgatacccccaccccaccccaccctaccctggaaagaaaggacacttggagaagctacagcttagcacgaggacaaagaagctttctaccagggaagctgcatgcctaattagttcagagcataagcttcagctcagacagatctggatttgaaccctgattcatactacccgtgtgaccttggtcaaattatttaatctcggccgggcgctatggctaacgcctgtaatcccagcactttgggaggccaagacgggcagatcacctgagatcaggagttcgagaccagcctggccaacatgacaaaactctgtctctactaaaaatataaaaattagccaggcgtggtggcacgcatctataatcccagctactcaagaggctgaggcaggagaattgcttgaacctgggaggcggaggttgcagtgagctgagattgctccactgctctctagcctgggcaacagaggaagactccgtctcaaaataaataaataaataaaataaataaaatacaaaaattagccgggtgtggtggcatgcacctataatcccagctacttgagaggctgaggccaggagatggaagttgcagtgggccgagatcgtgccactgcactccagccagggtgacagagcaaggctctgtctcaaaaaaacaaataaacaaacaaaaattatataaactctttgagtcccagtttccccatctataaaataaggataataactcacaaagccatcacaaggaatacattagatcgtgtatccaaaggtgctgaacagccgggtgttgtggctcacacctgtaatcccagcaccttgggaagctgtggtgggaggattgcttgagctcaggagttcaagaccagcctgggcaacatggtgaaaccctgtctctacaaaaattagaaaaattagctggttgtggtggtacgtggctgtggtcccagctactagggaggctgaggtgggaggatcacctgagtgcaggaggttgaggctacagtgagttgtgattgtgccacttcactctagcctgggtgacacagcaagaccttgtctcaaaaaaaatttttttaataaaaaataaataaaggtgttgagcccagtgctcacacacactaagtgctcaaaaaatgatcactattacgattcacaatagtaaagacatggaatcaacccaaaatgcccatcaatgatagactggataaagaaaatgtgatacatatacaccatggaatactatgcggccataaaaagaaatgaggtcatgtcctttgcagggacatggatggaactggaagccattatcctcagcaaactaacacagaaacagaaaaccaaacactgcatgttctcagttataagtgggagctgaacaatgagaacacatggacacagggaggggaacaacacacaccggggcctgttgggggtagtcgggagtgagaacatcaagataaaaagctaatgcatgtggggcttaatacctaagtgatgggctgataggtgcggcaaaccaccatggcacacatttgcctatgtaacaaacctgcacgtcctgcagatgtatcctagagcttaaaataaaattaaatttaaaaaacaacagacaggccaggtgtggtggctcatgcctttaatcccggcaccttgagaggccgaagcgggcggatcacctgaggtcaggagttcaagaccagcctggccaacatggagaaaccctgtctctactaaaaatacaaaaagtgtccaggtatggtagcgtgtgcctgtggctctagctacttgggaggctgagacaggagaatcacttgaacccaggaggtggaggcagcagtgagccaagatcgcaccactgcactccagcctgggcgagagagcgagatgccatctcaaacaacaacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaactttctgaaaattacgttctgaaagcaagtcacagctccattccagtcttatcaacttaactaccaaaaagaaaatgcccaagaaaagtgggaattaacctctggcaaaaaaatagtctaataagtggggctgtccttcctgtgtctgaaagcaaatacctgggccctgctctccctgatgcttttccactctactttgttttgtgtttcctggagaagccttctggatgccattctatgtgtgggggttgcaagtgctagttttgttctgtaagaaaaatgtgtacagaaaggaggagaaaacagactcactgctggaaaattatttcagtatttttgaaatctgctgaagagccacatgcatgctgcctgagtctttttttggttcactcaggaacagactatgaatgtaaatgaagctttgagttggccttttcctctttcactaataaaagatcgataggttgagtgatgaggaaaagcacttaatggagaaacagaagaacccaatcccccaacatgtgcgcactcacgcacacacacacacacacaccacacacactatgacgttaagcattttatactggccaggcatagaaatggttttgcatgtgtgtgtctctacatgcttatattgttgtgcctcacttttaaagattagacagctgcttgatatataaaacagaatgtttatcacagattgtggattgtttgaaatgagatcatctggcccagcacggtggctcacgcctgtaatcccaacattttggaggccgaggtgggtggatcacaaggtcaggagttcgaaatcagcttggccaagatggtgaaaccccgtctctactaaaaatacaaaaattagccaggcatggtggcatgtgcctgtaatcccagctacttgggaggctgaggcaggagaatcgcttgaacctgggaggcagaagttgcagtaagccaagatcgcgccattgtactccagcctgggcgacacagcaagactctgtctcaaaaaagaagaagaaatgagataatccattttggatctgtccatttttcttttgcagtcctaaataacaaaaagcctctccacacccaaattgcttaacataaagcttttatttctgcttactatcgaccatctattaatagttgcctgagaccaggtacagtggctcatgcctgtaatcccagcactttggaaggccaaggcaggtgaatcgcctgaggtcaggagttcaagaccagcctagccaacatggcaaaaccccgtctctactaaaaatacaaaaaactagccaggcatggtagcgtgtgcctgtaatcccggctacttgggaggttgaggcaggagaatcacttgaacccaggaagtggaggttgcagtgagccaagatcacaccattgcacttcagcctgggtaacagagcaagactcaatctcaaaaaaaaaaaaaaaaaaaaaatgcctgaaaagcttccatgtaaagaatttatggtgataactttttttttaattttgttttttttttttttacggagagatgcagggtcttgctctgtcacccagactgaagtgcagcggcacaatcatagcttactgcaacctgtaattcttgggctccggtaatctttctgcctcagcctcccaagtagctagggctacaggcatgcactaccatgcccagctaatttttctttttttaagaaagacagtcactctgttacccagggtgttcttgaactcctgtgctcaagccatcctcctgcctcagcctcccaatgcactggggattataggcgtgagccactgcactaaggctaattattttgtaagctttaataggtcagtagggtacttacaggtgtgctacccaatgaacatcacctcattcacttagtctgtcaccacacatttactgaacactttttttgtgccaagtattggggggtggggcacaaaaatgaatgaaacacagtccctgctgaggaggaactcacagactggaggaggaaacacatcattaaataattattgtacaatgtggaacactatatagagtacattagattgtatgcagcttggtgttagggattgtgtcttggtcactattgcaatcctgctatgcccatggccttgtacaaagcaggtcctcaataaatttttggttgaataaattagtagtgtttggggtatatagaaagcaatacaagctgagttactaggaaggctccccagcagaggtgatggctgagctgaagaaatctctttctccattgactgtcagaatgccagcactagggtgatgtcaccctcctaaagttctaggagtcttttgggtattgttagacccttcagtgtactctacacccagctcctcccagacctgtcagtgttccagggtacaatgtagacttggtttcctagacaattgtatatctgccgttttgcttgtgaaaaatactatttttatcaatatgacaagccaaccataaaagtatacgtgaaaattattgttgcttgtggccctcccaacaactcatctatcctgtgtattatctaaagaacaaaactggttccccaaagtggttatgcctccaattgaagcatcattttattctactcttgtgcataaatgattttttattcaactatgtcaactttccttctgttcatatagaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtaatatggggtggaggtgcggtttacaccactcaaggttcaggtttcttaaactcactcagtggtctcagctggccataagggtaagcttctttgagtgtacagaaaggcctcctggcaactgccattatacatctttactaccctgccacctagaagccttaacaggaccccacaggagttaaataaagtgctcaggaaggagtctggctactagaagggtaggctaagctgaccacaggcgggtatcctctcactgtgatttactagccagtgtgtgatctccagtgtaagaatcgcctagatatacacaatagttccgaaacactggtcggcttgctctagaatcaactgaagactttgttaaattgtttctgatgggaacttttactgtgtatatttattcttgtattttttaaccaatacttcaagcgagcattctgaaaatgcaatagcccctagggtggataatactcttgtgtttccaggaggcaaagttagcttttccgaaaatcaaatgatggaacagattatgactctaagctcttgttgctcagtaaagcccagcctcttctctgaggttttcctgacctgagggttacttcagttgtacagatgtgaagcgtgctcgaggagtatgacccttggctaaaggaaacccaaaaggtaggataattggtagagacagtttatggtgaagtttctagattccttgagggagataagaaaacttgaggttgtgaactagtttgcttgaaaactgctttttttttttgagatggaggcttgctctgtcaccgaggctggagtgcagtggcgcgatgtcagctcactgcaagctccgcctcccaggttcacgctattctcctgcctcggcctcctgagtattgggtactacaggcgcccgccaccacgcccagctaatttttttgtatttttagtggagatggggtttcaccgtgttagccaggatggtctcgatctcctgacctcatgatccacccacctcagcctcccaaagtgctaggattataggcgtgagccactgtgcccagccgaaaactgccttcttaaagtacttgttgaggacacactgctttagcaagtcctgtaagaggaaataaggtatgcacagatcaaggcctcatctaagactttatggacccagtgcctagatcaggcctggcacacagtagatgtgtgacaactacttgctgagtgaatgaagaaagaagtgagagtactggcagtcccattggtgaactccattcctcctcacagaaaggctggttcacatcgacattcactcgctgtctttgtgaaggaggtcattttattgatactgcgtaccttcctctttttctagcccaagagtggtagccacaaagtgtcctgccctgaatcatctggatagattgtaaaactggctgttcacactagcctagattgctagagctcatgtcaaactcataggccccctagtctgcattcttaaaaagaattaattaggggaagcatcttagtctccagagacagtggttagccctttcatctcactgagactaatctaccttaccctttgctccactcaaatgtctctacacatcacacaaagacaggtggtagcagaaactgatgtttacttgattcttgaatcaacaagatttatatgaggtgacatcctcttatgaatttaactagtcttatgtatagcaaacagaatcttaaaatagtagttatcctttttaggaagtcgtgcataaaatcactgggctcccggacaaatatgctgaacttggttagtgaccttacacagactcagaacaaggcatcacaactcttgccccttgtcttgaagagccatttttaagtacatttttaagaatctagtctaataaattagctagaataagttatcagtgctgaaaaatgtttggactccagcagaacatattcttattgtgttttactttcaaatgaagagtatataggggaagggagtctaaggattgagtaagaaaagcttttaaagcaaacgcatatccctgttgaaatttaaggctgatcttgggtttgttctttttcctgactttaggggtttccaatggtctgtagattatccttttcagcttagcacttcctcacaaagttgtgtcatcttagcagaagtgggcaaaaagcagcttcacttggcctcaggtcacttacgtttcctaccctgtagctttgagtagaaactaggttattaggtcataaattgacttgattcttagaattcttccagaagagattcccatttagcaagccataaaatagggctcatttctatgaatccagaaggctaattcagggggaagttgcagatttgttaaatggcccagcccagggctgagcaacaggttagtagtttagttccccagcgtctcccagatgcctcacttctctcttggatccctcccttttgttcataggaccaaaataaaaatggtagaaaaataaaaaggaaggttggcatggactcttcaaatcataccacttaacatctaactggctttgggtgcagtacacacaacttccagcccctgggaacacaactctaactaacttgctcttaatttttcctgcaccctaggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaaggtactatagcttacgccgaagaccttagcaaacaaggcagcatgaactcctttttttttgttttttgagatggagtctcactctgtcatccaggctggagtgcagtggcacaatctcagctcactacaacctccgcctcctgggttcaagtgattctcatgcttcagcctcccgagaagctgggattacaggcacccaccaccacacccagctaatttttgtatttttagtagagatgaggtttcaccatgttggccaggctggtctcgaactcctgacctcaagtgatccagccaccacagcctcccaaagtgctgggattacaggcgtgagccaccgtgtccggccagcatgaacctttagtgataaattctcaaccaaaaaaaagtgtctccttcatgggcagggccagcaatgcctagaaacagtacaaaaagaagggctgggcaccatggttcccacctgtaacccaaccattttgggaggctgcggtgggaggattgctcgagcccaggagttcaagaccagtttaggcaacaaagtgaaaccctgtctctgaaaaaaaatttaacaattagctaggcatgatggcacacacctgtagtctcagctacttgggagactgagcggggaggatcgtttgagccctggaggtcacggcttcagtgagccatgattgcgccactgcactccaacctgggtgacaaagcaagaccctgtctcaaaaaaagaaaaaaaaaaggtgggggaaacaggggaggtgggaaagaaaaaagtaatagctaccattgtttgcgcccttgctctgtgccaagcagtataataagtgttttgacacaccagcatgcttcatcctcacaaacaccctagagaaatgatcatttaactaaaaatcaatcattatataaatcaggagagctgaagtgcaatttcagaatatacctataattggagtggaaaggggcgtacctagttcttccaagcccactgttaaaattaatgcctttctgcatggactacttgtttacagaatatcagactgccctttagacttcagattttgttatgcatgcttttctccagtttactaactgtgccagatatgcttacagatagcagttctgcctatttttccttgtactcatgtccccggctcaccagttagatcccagtctaagtgctgtgtcttacccctctagggaaagaactcttgagatgaggggtaacagggagggaaggcctttcagatttctgagtagagaatgttttgcctcttgattgtttcatgcaagttaaaatgcctcaagtggagctgctgccactgcaactaaaatccctcaacaacttcaccttttttttctgccctactttctagacatgacatttttgggagcattcttaagatgtacttagggggtccaagcttctcttacgagagagaattgccctagagtggtcataagtatcatggtaaccaactgcttttttgaatctttggtgttaccaaacaaaactaaaaaaccttaggttatggcaggtaggtaaggaggtggtctgggaccagcttcctgaagaacacacacatgcctgtggacaaccatcacttcttttggtcatctttttctgctcagctctagaagactccgatggaagacaggactctccagcaggggaactgccaaaaacggtccaacagccaacaggtacagtttttaaggcagtgtttttagaaattttggtggagggaaccatggtttccctccagataaaagctgtaaagaagtgaatgtaagtatgttcaaattatgataatgaaggccttttttccctcaaaaagatagttaacatttactcttacattaagccatatttggtaactagcatcgtttcaggtgacagtgtttttttgtttttgtttttgttgttgttgtttttttgagacagtttcattctgttgcccaggctggagtgcagtggtacgatttcagctcactgcaacctccacctcctgggctcaagtgattctcctgccccagcctcccgagtagctggaattacaggcacccaccaccatgcccagctaatttttgtatttttagtagagacggggttttaccatgttggccaggctggtcttgaactcctgacctcaagcgatccacccaccttggcctcccaaagtgctgggattacagacatgagccactgtgcccggctgtttttgttttgttttttgttgttgttgttttttgtttttttaataaagatgtttactccactgaagataacagtctttttgcttcagtatgtcccaaagtaaagctctgtaccaagtgctaggaataccaagtaccttactctgctgatggctgttttataaccaaaagcgttaagcaggtttgattgcagttttctttctctttacagaatctgagccagtcaccataaatatccaagacctactttcctgttctaattttgcagtgcaacacagatatctgtttgaagaagacaatcttttacggtctacacaaaagctttcccattcaacaaaaccttcaggtaattccaagtaaaatattactataagataacttgatctcagcctttcggcttgccaacaaccttagctttaaggaggaaaggaaagaaggaagtaggaaatagtatagaggaaaagagaagaaagaatttaagtaaaatgagaactaaaacataaactaaaagaaactcaagtagtgttcctcagtaatccacagtaagggccacttccagtgttggaagcatatacagtgctttcctggtatttactggatctggctgcatggaaaaagtggaacatgtctttcattatggtttcctccatatgctgattcattcctattattatgcgtctgggaagtctggtggattctagaggtgaacactttccatctgctttctcaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctatgtaggttttatcaactgaagtaaatcccacgaagtcacaaagaacagtgatctccaggaaaggctttttgctttaaaaagcagcctcacaggtgtttgagaggcaagggcaagccaagcttattagcagcagtcaagcacttagttgccatcggctgttctcgggggcttagcaataaggcctgtcagtcagcatacaaagtaaggaaaaaagagacactggcctaactccgtctctgctaggaaggtgtgtaggacatgatgaggtctgaagtgcatcaaaggtacggtaagtatagacaaagaatgttgtagaatgaagaggtttcaaactcagtactccaaacttttcctttagccccaaggaacaccacagccacatatagattcagtgtgtttagtttctggaggacaggagtggttttttcttttttttcccttggcagcagagatcttctctatcggcactctaaaaaatgaaacactccaccaagggaacagcaggatccaatgattcatttaaacaatattaaataaaaggaatgcttggggataataaagaaaagaggattcggtgcttttacatattgaacaccctgccaagtgctctaaacttaaaattacagtaagcgtactaaagctggctgatatctcaagtgcatcaactagtctatagggaaatggcttaattctgaactatctctgtgccaatgggcttatgtaataaggaacaacagcatagggcaattccatttctgaaagctggaaatacgctcccttaagtaaaatgaaataatctttctgagtggttaattgacgaatatgggctctcattctgccctcaagagggcagatagagggtactgaggagcttacagggaagaccaatacctattctaatgcccttttcttctcgcttgcctgtcccaccccaaagttctactcacaagagactaaagaagacatatttttacataggtcagaattcctcaaaaccgtggccttatgtagcatcatggtgaaaactccgtatcgccctttgcttctgacttcatatcttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaaaaataataaataaaataaggccgggcacggtggctcacgtctgtaatcccagcactttgggaggccgaggcaggcagatcacctgaggtggggagttcgagaccagcctggccaacatggagaaaccccacctctactaaaaatacaaaattagctgggcgtggtggcgcatgcctgtaatcccagctactcgggaggctgaggcaggagaatcgcttgaacccaggaggcggaggttgcagtgagccaagatcgcgccattgcactccaacctgggcaacaagagcgaaactctgtctcaaaaaaagagaaaaaaaacaaaaataaataaaattaaaattaaaaagacaaattcacactgagccatctggctttgctgatgttaaaaaaaaaaaaacccaaaatatttgtcttgacagaatatgttaaatgagttctacaaatttacaagtcagggttttaacatacttgacagaaatgggaaaaaaaaccaaaaccttttagatttcagaagccaaaattttacgtggataaatcaagttatatttaaatgtaaataaaaatagacaattcttcatcttccttaatttgagatttactagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagag

SEQ ID NO: 36143 - DNA, 6079 bp, Homo sapiens
ccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatgatcccccgtctctttggtcactgtatccctgacactcccagacatttgacctcatttctgactctcccagactccttcatgtacgacacccctcaagaggtggccgaagctttcctgtcttccctgacagagaccatagaaggagtcgatgctgaggatgggcacggcccaggtttgaagacagagaagggaggcagggcagggaactgggggaaaatggagaagggacagaactgttaatgctggagcctgagccactctcctggcacccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaacaacagggccccaggaaaatctccaggtcctattctgtcctccttcccttttacttgaagcagtttcttgactggtaattcctccatgaacctcagcccttgagcctcttactgagagcctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaaggtcagaggttagggaatggtgggaggttcactttggggtcaggaggttcagggtggagggggtcatgagactaccttgagggcgacagggaggaccactttgtagtcaaaagttgaacagcaggatcgttgggcaatggaggttagtgggaacctgttgggggctggaagggccactttgtggtcaaagggaagtccgtgtaatgatgattaacttaaaaagttgaaagatgtgggatttcagttgcagattggtctctggggttaaaagatggcttggaagaccaggtgaggtgatggtctcttccctctccacagaccacaagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggttgtgctacaagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacacaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 36144 - DNA, 170896 bp, Homo sapiens
atccttcgcgtactgacggaaacactggcggcacatattgaggccgtatttcaggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagcaagtcgagggccgtgtaggagttggaggagagaaatgaaattttggaagagtcagcagaaggtgggaaatttttatttcatttacagcagtacagacttcatgcagccaaaagtatgaatgccctttcttctgtgacttacactgtaaagggagcatttctcttatgtgcaaactaaccatagtggacatgtttgtctacatccagaccagttcctagattcaaaacttgtctttgtttttgtttttgttttttttttctttttttgagatggagtctcaccctgtcacccaggctggagtgcagtggttctgtcttggctcactgaaacctccgcctcccgggttcaagtgattctcctgcctcaacctctggaatagctgggactacaggcatgaaccaccatggctggctagtttttgcatttttaatagagatggggtttcaccatgttgggcaggctggtctccaactcctgaactcaggtgatcctcccactttggcctcccaaagtgctgggattacaagcgtgagtgagccatggcgcccggccatgtatttgttttataaccatgagaaactaaaatcaaaagtctatttgtagattctcccagtgggttataaaatctggaatatttctgaagaaattatttctgctacacacacacagacacatacacagagagacacacacacagcgcaggtgacagctctttggtaactcaactatgaagtatagtttttagaatattttcactgatgaaagatcaaactacagtgattctgtgtgaactctggtgtgtatgcgtgtttctgtgtgtgttgtataaatatatatatatatttcaccttaaaatcagagaagaacctgattttgaaagagcaactgacaaattttatttccagggagattcgctgccaaaagggaaaaaccatcctgtctggtctcaccaaataccatctcccgtctattcgccactcagcaaccagagtgatctcttagaaacataattgggtcatatcactcttctgctgaaaactcccaatggagagtattcaccaaaatgttaacacaatcctttctgggtgtcttaatgctttgagaaaatgaacagtagattttcctcattaaaagattaggccctctgtcttaaggaggaggaggaagagaaggaggaataggaggaggaagagaaggaggaataggaggaggaagaagaggaggaaaaaggagaggaggagggggagagggagggagaagagagggaggagaaagaggaggaggaagaggagggaagaagccctactgcagattggacagcttcaaacaaaaatagcattacccctactcctacatttcattcattttgttatcccagggtgggccattttgaagttggtaagggtttattttaaaggattgggccttctcagagagagagtagacaatgataggcaaagatggggctctcttcttaggaggtatttcatactcccagtccctactagagtctgtgttgaaggtttctaaattttatttctaaccctgaagtctcactaggcatctattggaagtcatagtttccaatcaaatgtatagccttcagtttgaagcatttgaacatgtttaaagtcaaatttgccatttgtcctaaaatagcaggctcccttttcaaactaacttatctctgttaatgcaatattattctctaaatttacgcaggcataaaatctaaagtggagtcactcatctttgatttatcccttgtttaaaaagttgagatcaaatccacattacataaaattcagcattttaccaactttaaggtgcacaactcagtaatttttagtatattcacaatgttgtacaaccatcactactatccaattccagagtatttcccatatttcccaatttcctcttcccctcatcctggcactaccaatctacaatctgtctctatggatttgactattttggacatttctatagatgaaataatagaatgtgcagtcttttgtgtctaacttatttctttcagcataatgttttgaaggttcatccatgttgtaacatgcattgtatcagtatatcagtcatttttgtagttgaataacgttccattatataccacattttgtttatccccttatcagctgataaacatttggtttgttccattttcaggctattatgaataacactgctatgaacattggtgtacaagtttttgcgtgaacatatgtttttgaattatacattcaaaacgtacatgaacatccatttttggtatatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtatatacccaatttcttgggtatataccaagaagcagaattgctgaatcatacagtaactttattttcaactttttgaggagctaccaaactgttttccatagcagctgcaccatttcattcccaccggcaatgtatgaggattcccatttctccctatccttgccaacacttatttttccttttttttaattaaagccatcctggtggatgtgaagtggtatctcattgtagtcttaatttgcatttgtgtaatgactaatgatgttaagcatcttttcacatgcttattgatcatttgtatattttctttgcagaaatatctgttcgagtcctttgctcatttttaaattggattatttgtccttttattgttgaattttaagggttctttatgtattctggctactagactattatcagatatatgatttacaaatattttcccccgttctctggtttgtacttttactttcttgctagtgccctttggtgcactaaagtttttaattttgatgaagtccaacttctctatttgtcttttattgcttgtgctttttgtgtcatatttaagaaaccattacctaatctaaggtcacagagatttacacctgtttcctttgaaaagctttgttattttagctcttatagttagttatttgatcgatttttacttaatttttgtatacagtgtaagctgggagtccaacttcattctttgatatgtagatattcagttgtcccagcaccatttgttgaaaagactgtcctttctccccggaacagtcttggaaacctgttgaaaatcaattgtccacaggtggatggatttatttctgaactttcggtttaattcagttagtctatatgtctagccttatgcgagtaccataccctttagaatactgtagctttgtagttaagttttaaaatccagaattgtgagtccttcaattttttctttttcaaaactattttggttattcaaggtctcttgcatttccacatggattttaggatctgcttgtccatttctgcaaaaaccaaggaggcagtttgaatttttataagttttacattaaaactgcagagcaatttagaaagtactgccatcattttttcctctcttcttgtttcaatttgtttggtgttttgttttaccattttaactattttaagtattttaactgtacagctcagtggcattaagtacatttacattgttgtgcaaccattaccaccatccatctctaaaactgttttcctcttcccaaactgaaactccatacccattaaacagtaactccccattccttcctctcccagcctttgggaagcatcgttcttctcctttctgtctctgtgaattggactactccaggtacttcatataagtgaaatcacataatacttgtccttttgtgactgccttatttcacttagcataatgtccttaagtttcatccatattgtagcatgtgtcagaattttcatccttttcaaggctgaatattattctattgcatgtatataccacattttgtttatcaattcatccattgatagacacttggttgcttccaccttccagccaattgtgaataaggctggtatgaacatgggtgcacaaatatctatttaagtccctacttttaatgatcttagatatatacccagaaatagaattgctggatcatatggtaattctatttgtatttttttgaggaattgtcatattggttttcacagtggctgcaccagtttacattcctactagcagttcccaaggaatttaatttctccatatcgtcaccaacattgttattttctgttttgttttgttttggtttttaataatagccatcctaaggagtgtaaagtggaacaatgcccaaggattgtgttctttttgatgctgttgtgcatcaaattattttcctactttcattgttggattgttcattgctaatatatagaaatacaactaatttttgtatattggtcttgtatccttcaactttgaatagaagtagtgagaatagtaattttcttttttttcatgatactagggagaaattttcaacctttcaccattaagtataatgttagcagtgggtttttcaaagatgacctttatgagattgaagaatttcctttctttttctggtctggtgtgtttttaaatcatgaaagggtactggattttgtcaaatgctttttctgtatctattgagatgatgatttttttccctttatcctattaatattatattgattaatttttatatatcaaatcaatctttcatttctggaataaactccacttggtagtgatgtacaaggagacttcaaatgtttgtgaaaatggagttaaaaaatataaaatataaactaatttctcaacattaagctccatcaattcaagacacttttgtaagtgatgatactagccacttagttcatccctagagaactgagggtcctggaaatctgacgtcaatgccatttttttacattattaactgaagaaaaattggtgccttttacagattttttaaagattaagatataggaagaagtcagaaggagccaaatcaggactgtaagatggatgcctaatgatttcccttcagaactttcacaaaattgaccttgtttgatgagaggaataagcaggagcattgtcatggtggagaaagactctctggtgaagctttcctggtatttttctgctaaagctttgtctaactctcttaaaacactctcataataagcagatgctatcattctttggccctccagaaagtaaacaagtaaatgctttgaccatcccaaaaaactgttgctgtgacctttgctcttgaccagttcacttttgctttgactggaccactttttttgtttgtttgtttgtttgtttgtcttttgagacagagccacactctgttgcccaggctggtgtgcagtggcacaatctcggctcactgcaacctccacctcctgggttcaagagattctcctgcctcagcctcctgagcagctggaactacaggcatgtgccaccacacctggctaatttttgtgttttcagtagagatggggtttccccatgttgcccagactggtctcaaactcctggcctcaagcgacccacccacctcggcctcccaaagtgctgggattacaagcgtgagccactgcacctggcatggaccactttttacctcttggtatccattgctttgattgtgccttgtctttaggatcatactggtaaaactatatgtcatctcctgttataatcctttaaagaaatgcttcaggatcttgactctgcttgtttaaaatttcctttgaaagctctgctcttttgtgcagctgatctgggcacaatggttttggcacccatcaagtggaaagtttgcacaactttaatttttcggtcagaactgggtaagctgaaccaactgagatgtttatggcattgactattgtttctgctgttaatcgttgatcctcttcaattaggtcacaaacaagattaattttttcctcataaatggatgtggatggtctgccaccgtaggcttcatattcaatatcatctcatcctttcttaaaatgagttatccattgctgatttctttggggcgttgtccccataaactttttgtaaagcaccagtgatttcaccattctccaactcaagcttcactacaaatgtgatgtttgttcttgcttcaattttaacaaaattcatgtcgctctgatatgggctgttttcaaactgatgccttatctttcttagtgcctcaatctagatcttgttcagacatgttataagttagtacaagttcattttagtgcaaaaaattgaaatccatgcattctcttctcatatgtgttttccatgaacttttgaagatccctcagataatcattttcatatgctactgaagtcaatttgttagtattttgttgaagatttgtacatccatattcacaatggatattggtctgttattttcttttccctgttgtctttgtctggtgttagtattagggtaatattggtcttatagaaggtgttaggaagtatcccctgccctttatttttttaaaaaatctttgtgaaagcttaaggataattatttgaaaatttggcagaatttatcagtgaagccatccagtcatgggcttttttttttttttttcttgtctttttcctttttttcccccttttaaaacatggtcgggctgggcacggtggctcacgcttgtaatcccagcacttcgggaggctgaggcaggtggatcacctgaggtcaggagttcaagaccagcctgaccaatatggtgaaacctcatctccactaaaaaatacaaaaattaacctggtgtggtggcatgcgcctgtagtcccagctactagggaggctgagacaggagaatcgcttgaactgaggaggcggaggttgtggtgagccgatatcatgccactgcactccagcctgggcaacagagtgagactctgtttcaaaaaaaaaaaaaaaaagacaagatctctctctctgtcacccaggctggaatgcattggacaaatcatagctcactgaagcctcaaacttctggactcaggagatccttccactgcagccccccatgtatctagagctacaggtgcacaccaccatgctcagctaatcttttttaaatttttttgtagagacagggtgttgctatgttgcacagactggccttaaactcctagcctcaagtaatcctcctgtcccagcctaccaaagtgctggaattacaggcatgagcaccacagccagccttgttttgggtttttttgttggaagttttttgattactgattcaatttgtttactttttatacatctatccagactttctagtctttcttgagtgagttttagtactttgtgtgtttttagaaatttgtccattttctctagattataaaatttgttgtcatgcaattgctcatagtattgccttataattctttttatttctttaagattgatagtaaggtgcctgctctcattcctgattttcgtaatttcagttttctccctatttttctggtcagcatggataaaggattgcctattttgttgaccttttaaaagaaccaacttctggcttcattgattttctctaatatttttctaatctctttttcatttactttcactctaatctttattattttcttcctttttcttgctttgggttcagtttgcccttctttttctagtttctaaaaatggaagatcatgttgttgatttgagatctttcttcttttttaatgaaggtgttcaactaactgtaaatttccctctaagcattcttccaacattccctgtatcccatacatttttctatgttatgttttcatttctattcaccccaatattttctaatgtctcttgcaatttcttctttgacccactgttgtttaagagtttctttgtttaatttccatatatttaggaaccttcctgatttacatctgttattgacttccaacattttaaaagatggggtctcactatgttgcccagcaggccttgaactcctaggctcaagcagtcttcacacctcagcttcctgagtagctgggattacaggcacatgccaccacacccagcccaatttcatcttaatgtggtcagagaacatattttatgtaatttcaacattttaaaatttattcagacttgctttgtggcctgtcttatagtttaacctggagaatgtcccatattgttagatgtgtacatgtttatcattgttatatcttcatagtggagtgactcttttatcattataaaatgttcttctttgtctctcatgacaatttttgtcttgaagtctgacacatttgtctggttttaggatagccacttcaactctctttttgctactgtttgcaggaaatacttatcttttctcattcttttactttcaacctgtttgtgtctttaaatctaaagggagacttttacaaacagcatatagttggatcatgtttttttttgaaattcattcttctaacctctgccttttgagagctaattcattcacatttaatgtaattactgaaaagaaagggcttacgtgtgccattttgctatgtattatgtatatgtcttatatcttttttgcacctcagttcctccgttactagtttcttctgtgttaaatagacacttttctagggggccactttaattcctttaccatttcttttactacatacttttgagctattttcttggcaatttccctgggaattataattaacatcttaatttataacaatgtaattaggattaataccaacttttaatgttatacacaattttgttcctatatagttcagtttcttgctttatgctgttactgtcacaaattacttcttaatacattgtttttccatcaatataaatttataattattgctttatgtagctgtcttttaaatcagatttttaaaaagggagttacaaacaaaaatacattaataacatcttttatatttatctatgtagttatcattaccagtggcagtggttttttggttttgttttgtggtttttggttttgttttgttttgttttgtttttttgagatggagtctttacagagggattctgcaactttattggggcatgccttcagcactcagccgagcggtttacagttcggccttggccttcacttactgtttgctcaggtaaactagaggggagaaatcaggactttctctggtctttcttgagcatgtgaacagttctcggcatgcacctggccttctaaattcccagaaatgtaagagcttttcaaagtccttattcgccaaagcatctcatttaggcttttctcccaagatatttggttaatctattgtttgccccaactgttatccattgtctcagtagcaaaggctaaaacatttacttgtgttttcaacaaatgactccagatagtgactttagggctgggcaagctctgaaacaagataaaacatgacttttgagcccatctcttagggagtcaccagacaatcaaccaaggacaaatatttccaaatgacgacattcattctccttcttctggtactggtgctagaatgcaggctgttatcttcaagtggctatctgccactgagctggggagctagagatggaacgaaggcaagttataatgtcacaagtctgtccctcctatgaagactcagctatttttcctgaatacgtgttccctgagttgctgcaagcatttggttaatttccagggttctgaaaaagtagattctgatcatttttggcaaatttgtagttgcttttatgttggagttcattttcagagtaccttactctaccatcttcacagagaccataattcaccatttttttatccactatatccagaaaatcaccaaagacagccagttattcctttaaaagtcacctttatctatttttcttaatcactaccaccaccaggcaggccttgagaggcaatttattatactatttaaaaccatcagttctggaatcatatgttggtgtttgaataccagctctaccacttcctacatgcatgacctggagcaagccaattaaaactttttatgcctcagttttaacatctgtaaaatgggataataaaagtattgctatgaggattaaatgagttaacacttgtcaagtgattagtactaggcctgcatatagtgaacactcaaaaattgttaggcactaaatgcatccagcaaacatttattaaagctaaatttattaagattatatactcatctctaggactattacaatgagcaagactgacaacaggtaagagctccacttttgtggaacttacgtgaaatgtcccaaacacttcatattcagattgcgatttctcagatgacttctgctgggaaacaatttctcattaatttctcatgtttcttcccatcttgtaagcagaggcacagatggccttatttttggactgtcttcctctagagcagagaacagatttgtttattgtacagtataataaaaatgtctttctccaaggcaaaggccaggcaggtatgcacacattccattatagaagatttgagtttcctaggcttgggattcctcagctctggcaaaaactcatgacatatacagcattgattctgcatcacctctgtggaatttgaggagcatggggaatggatatgaaactgacattcatgctgccactatgctatgattaatagagtcgtttgtctctgactcaggagtctcatgtcttccaccatcatccacgcaacaggataactttttagcttacatgcagagtaaaatctccagtgtttcagcttttgacaacttctagccggtatgctgttacaaaggtatcttccttaaacctaatttctactggttacatctaaatttctttatctggctttcagactccttcctacctactcagctgaatatctatttcttcttgaagaagactttctgcttcatagaccagtattttcacacgtatactgtgatgttcctttctacctctgacattaggctcaaattccactccacccccttttgttggaattcctttcctttccccttttttcctatttagtcaactcaaatccatctcttaacacctgtatcaagtccaaaactgtcaagaaacttcctcattgatcactctttctgcaaacatctgtagaacttaagaacctatacaaagagcttgaatatatattgtgttattttctagtggttccatatgggcatgcattgcttccccattctgactgtaagcaagaagaggagtgcaggcacaaagcagaaatggaatgtgactgattggaatggttacgtgcatatgcactaaagccagaattcccagatttagatccccaccacttattagctatgtggccttgggcttattacttaacttccctatgcctcagtttctccatctttaaaatagaaataattataatgataatacctatctcatagacttcttgtgaaaattgaattaacacacataaaaacatagatcaagttagaaacatcccggagtttagaactgtaagaacctgtggaggtatatagtattacagaggaatttgaaaaacctttcttaaaaacctctcaaacctaccagataaaaaattaaaaacatcttttgtttgacaaaaaatataggaaatattccaaagtcaaaggtggcatggcacaaatctaaagaggagggtgaatgctaaagctggtagctgttctagaacatttgctggtccacagtaatccagagcatttgtttcagtggccacttggctacaggacaataagtctcaggtctacacaaattcaaaagtaagattagaaacccaaacatttatccaggattgcaaaggatcatatgctcagtgaataattaaaagagacacacatatacccctcaaaggaatatggtgaaaaaataatggcacttggtacaaggtccaaaagtcttctcttgagaatttgtaaccacatgtgagacttcaaataaggttacagcctgaattcacatttccttcatgtttcttcaaagtgattcaggttggtagaccccaagcccctggcaaaagcaaacacaaattctctctactcaggaatctaagaatctaaaaaagttccaaagaatgttagctcacaatttacaaaagtcacaaaatacacaaggaaacaaaattccctgagtaagggacagcagaaacaccatgtaaggaaaaagtgacctaccgagactttaaatgtagttattaatggctacagaatattttttaagtatatataacacatttaaaagtaagagaactaattgaaaacaggagaaaagaaaaagaggctatcaaaaatgatcaggcaggcggggcacagtgactcacacctgtaattccaacactctgggaggcagaggcaagaggatcagttgaggccaggagttcgagactagcctggccaacgtgacaagaccctgtctctactaaaaacacaaaaactagctgagtgtggtggtgcattcctgtagtctcagctattcaggagactgaggcacaagaattgcttgaacccaggaggctgaggttgcagtgagccaagattgtgccactgcactccagcctgggtgacagactgagactctgtaaaaaaaaaaaaaaaaaaaaaaaaaaaaattaccagacatatttgaaaaataaccaaatagttccagaaaaaaaatttttaatgtaataattaaatttgaaactctgtggacaggttaaatagtagactcacccagaagaattagtaaattgaagaatagctgaagaaattttacagaattcagcttagagaaatcatgaaatggaaactacaaaatattaagaaacatggagaatgaagtgagaggtatgtatgtatctattcaccttcccaaaagagggattaaaaaggtaatattcaaagagatactgtcttttcaacaaatggtgttgggaaaactggataataacaaaagaataaagttggatgcttaccttataccatatacaaaaaataactcaaaatgggttaaaggcctaaacataagaattaaaactataaacctcttagaagaaaacataaggggacaagcttcacagcattggatttggcaacgatttcttggatatgacaccaaaagcaaaggcaacaaaagaaaaaaatcgataaattgaactacatcaaaatttaaaacatttgtgcatcaaaggacactattgatggattgaaaaggaaactcacagaatgggagaaaatatttgtaaatcatgtatgtgataaggaattaatatataaaacgcacaagaaactcctgcaactcaacaatgacaacaacaaaatacccttgatttttaaaaagggcaaaggacttcagtaaacgtttctccaaagagatatacaaatggtcagtaagtaaataaaaagatattcaacatcactaattattagggaaatgcaaataaaacccacaatgagatatcactttacacttataagtatggctattaccaaaaaaacactcacacagataacaagtattggtgaggctatagagaaattgaaattattgtgcactgctgatgtcaatgtaaaattgtacaagtgctatataaaatagtatggcagtttctcaaaaaattaaaaataaaattatcatatgactccccagaagaatagaaagtggggacttgaacagatatttgtacacccatgtttatagcagcattactcacagttgccatagggtggaggcaacccaaatgtgtatagatggatgaatggacacacaaaatgtagcatttacatacaataaaatattatccagccttaaaaggaaaggaaattccaacacaagctacgacatggatgaaacttgaggacattatgctaagtgaaataagtcagtcacaacaagatgaatattgtatgattccatttatatgaggtacttagaattgggatagaaagtataatgggttgccaggggcttgagggagggaggagtggatagttagtgtttaatgggtataaagctttactctgggaagctttttaaaaagttctggggatgaatggtagtaatgattgcacaacaatgtgaatgtccttaatgtcactgaactgtacacttagaaatagttaaaatggtacattttacattatatatatgtatgtacatatatattaccaaggttttttcaaaacttggggaaaaataatggttgagaattgttcagaactgataaaagatgcaaatattcaacttaaggaatcacaaagaatccctcataaaacaaatacatatctagacactttgtaaaatgtctttgtaaaaccacagatctacaaagagaaatgttaagactagttagaaagatattacctacagaggaatgatatttagactgacaactgatttttcaacaccacagtggaaggcagatggaaaagcatcatttcttcaaaagactgaaatgaaaaataagtttacctaaaaatgtatatattttaaaaatcttacagaaggccaggcgtggtggctcacgcctgtaatcctagcactttgggagtccgagacaggcagatcacgaggtgaggagatcaagaccatcctggctaacacggtgaaaccctgtctctactaaaaatacaaaaacaattagctgagcatggtgggacccgcctgtagtcccagctactcgggaggctgaagcaggagaatcgctggaacccaggaggaggaggttgcagtgagccgagatcacaccactgcactccagcctgggcaatagagtgagactccattaaaaaaaaaaacttacaaaaataaggaggaaaataaagaaaattttggataattaaaaattggaactttactaatagacccaaatgaacttctaatgaatacattctgagaagtagaatgatatcagaaaaaaggtttgagatgctagaagggatactaaacaaatagcctgacaaatatatagacatagacagaaatctaaaaacaattgattatataaaacaataagtaaaatagctaatttatgggataagaagtaaaacaaacagaaatgtgaacagtgacagcataaaaattgggggagattaatctgagtaacagcactctaagcttccttaaattgttagaagagaaatgtatcaaatagctttagcctgtattaagaaaattatgcatgttaagatttctagagtaaccattataagaatagaacatctattaaaggggaaaaaattgaataaaggcatagaatctgaatccaaaagaaagagagaaaggaataggaataagcaaacagaaaaagcagaagaaatagaaagtgcacatttagataatagaaattaatttaaatataacagtaattacaataaacagaccaaactctttgggttaaaaaagtcaatatggaaatttttttctttttgttttgagacagggtcttactccactgcccaggctggagtgcagtggcgcaatcttggctcactgcaacctccatgtcccaggctcaagtggtcctctcacctcagttccctgagtagcgaggactacaggcacgtgccaccactcccagctaatttttctatttttttttttttgtcttaagacagggttttgccatgttgcccaagctggtcttgaactcctgggctcaagcaatccacctgcctcagcctcccaaagtgctgggactacaggcataagccaaagcacctggagggaaataatttttaaaaagcactttttaaaatccacatttgctatttataaggtgaacactcagaacaaagagacaaagaaaggttgaaacttaaagaatggcagtgtagtaactgaaagaaagcttgtgtagttataatacatgactatcagacaaaaattttgctaaaataaatgggttactacataaccatcaatgtttttatttcccaggaagatataaacttcttaactcttatgtacctaataaaatttaaactatgtaaagtaaaaaatgacaaacttacaaaaaaattgacaaatacaccaccattgtgacagattctagcatacctctttcagtaactgatagaatctctgcttaaaacatctacaggggattatttaaacaacaccataagtttgatccaactgattatatgtaaaacgtagtaacaagtgaaaagtatacttttataaaaatcaagcatatatgaggtcataaattatattctaacatattaaaaataatcagtttcccagagaccaagttctctgaacataatgcagttaaattacaatatatatccagttttaaaagataatttttaaaaaacatgtatttaaacttctttagaatttgaaaatatttaggactaagtgataaataataataatgaaaatacatatcaaaacttgtgggatacaactaaactagtatttagagggaaatgcacagtcttaattgcctatatgagcaagaaaaaatacaaatattaataagataatcaactaacacaagaaattaggactaaagcaattaaaacagattcaaagaattggaaggaaggaatttattcatgcattaaactaatgtttattgaacacccactattaggcatttacgattcagcagtgacctaaaaaaaatcctattctttatgaaacttagtgcctccaaaaccaaatatggaagtcagcataatactggtcatcaagagatttgagttgcagtccaatttttccagtacccagctgtgtgtctttaggtaaatcattttttctcactttgcctcctttttcttatctggaaaggagatcataatttctatcctatctatcatgatataatcaaatggtatccaatgacacaaactatattttgggaaagtataagcattatgcaaatataaaattattattattaatatttaaaacatccatgttccttttgctatcactgccttcctggtcttagggaaataaaatgactgcttcatttaaaactttccttccttcaattggctaaaagccataacatgagtctagctatgaggtggcttcaaatcttaatgctgggagagactgagtgttgagtgttactgtgaaatcaaagatgcagcataaattactaagtctactctcatgtatgccttgtatttctgcaactctgaacagtggaattttcacagtaggatttagcacttatcagttgtcctgtcccacacttcaagatcaaaggttcttgacacatcaaacactgagttaaaaattgccgctcagagtaggcaatttttttcattcaacactcttttactgagcattgcttatgtgttaggtaatagactgagcattggaagctcagagattacaatatagttggtgaggctgacaaaattgtctagcattctcttagcatacttatctaaacacatgagatcacaagagaagactccccacctacatacaagcccaacctcgtcttacaatctttagagctgaactaacaaagagagtgaggtcaatcgttctcagccttttggctaaaatctagaatggagagtgagggcagaggtagatggtcctggtctcatttattgtttctgtatttctaaggcctaaggcaggggctgatattcactaagttcttaacaaatatttgctgggtaaatgaatagactttgtggaacagattgaaagaagcccttggtagcaggtacacaatatccaataaatactttttaaatgttttacttattaattagagacagggtcttctgtcactgaggctggagtgcaatggcacgatcatagctcactgcagcctcaaactcctgggctcaagcactcttcctgcctcagcctcccatgtagctgggactacaagcatgcctcaccacatccagctaattttttttccatttgttggagagacagggacccactttgttgccggagctggttttgaactcctagcttcaagtaatgctccagccgcagcctccaaaagtgctgggattacaggcacacaccacagcacctggctgggtaaatagttcttgatcgtcttagagaccaaggaaaatgtatccagccaatttctctccatcctcccaaatccttgccaggcctttcctcttgcttcaggacctgtagcccaatttgctcttcctcctgtaacaaccgcaccagatctctggctggtccagaagtcaggtgaaagagtactgtcatcctctgaaagcccatcctttactaggctgagttttgctttgtgtccagcgaacaaggctgacttgaaagaggaccataccctgaagaagaaaataataggactttccatcttcaaagctcctccctacacaattttgtttgttggtttgtttgtttgtttttgagacagggtctccctctgtcacccaggctggagtgcagtggcacgattgtggctcactgcatcctcaacctcccaggcttagatgatcctcccacttcagcctcccaagtagctgggagtacaagtgcacaccaccacgcctggctaatttttgtattttttgtaaagacggggttttgccatgtttcccaggctggtctcaaactcctgggctcaagcgatccgcttgtctcagcctctcagtgctgggattacaggcgtgagccaccgtgcccagctccaatcattaattttagatggaggatctggtggccagctggcagctattattaacatgtgacacagaagcagattgtgtatgtattgggggaaggagggaggaagggaggaggaaatacagactgagatacagaggtcatagtctccacatcaaggccacatggtcaggtcaaacacagagcagaaggtcacagaattttattcaatcataggccattactcttctctcctactgctcactactatagaattttttgtaatttttccttctcatttatggaagtgtctcttaatggagtctttctctcatatgtgtgtgtatttgtgtgtatgtgtgtgtacgtataattggaagagggccctgtgttgggtccattctgtcagaagtatgtctgaatttaatcccctttctccattcccacggctatagtcctaactcagggccaagcatttttggcccggactttttcaacactcctccccatctcctccttgcccctggcctctccctactgcatttaccctccctactgacaccaggtcatccctagtttaaatttctgcttacgatagaattcaaaccctccacactctgaacccaaattaacttttcaatcttttttctcaactgggacagccaccccaccctgtgattcaataacatcatatgtgtctccaggtctttgcttgtgccatttcttttctatgagatggtcttttcttgtgggcaacgtggacaaatcttagctattcttcagatacgccatttcctctgtgaaatttcttctgaccccaccacttcttcccctatgttccacatccatatcattttgtacataacccttagaacagcacttcagtatttcaatacagttatgtgtctgtttcctcaaccataataggaggtcaagaattataccttatctttgacccctagaacctgttggtagagttcagtaagagttttaaaactgttgtctgtgtggttaaattaaacaaataaccatagaaataaaatgttaatcattattggtcatgtacacctgcatttgtgtccatcagatttcctgaacaaaaatcaaaatgtgtggtctgaaaatgtgacagatgatttggaagtggaaaatgtcctagaaaatttgtgtcatgcttgtcccatacttgtgtcccataaacatcccaccaacatttcaggactaaaattgccaatattccctccctctacctaaacccactgccatgtttcaaatgaaagtaatccattgtgaatccaagaaaataaattgcctctatattgctgtttacttctctgcctggatcaggaggccatacacctttctgttcctcttgataggctggaagactaaaaccaagattagctttgaattactctgctttctttggtttgcttttagttctcaatcaatcaagtactttagaaaagcccaatacaagtagatgcttagccttgtgctggtagctattgccaaaaagatacattgattagtctcttactatgtaccaggtactgggttaagaactttagatagattatcttttgaaattctcacaacagccttttataaattattattataatgtcaatattgtggatgagaaaactaaggcttaaagagagtaagcagcgtactcaaagtcctacacagctagtaagtaagcaaaactaactttaaacccaatactgaggctgggcacagtggcatgtgcctgtagttccagctactcaggtggctgaggcaggaggatcgatttagcccaggaggttgaggccacgatgagccatgattagcaccactgtactacagccagggcaaaacagtgagatcctgtctcaaaaataaataaataaataaataaataaacccagtactgaagtctgtgctcttaacaacaagcagcttactgtctatctggggagataagacattcacatatgaaataattggaaaacagtattccttgaaatgtcaggatgtggctccttaagttctccaaggccagattgagatttgtttttctgaaccttgagggacattcgggagaaacgagcctgagttttatataacaaaataaaagtttacaagagccctgagttatatacaataaattcagtgatcgaaggtgtagggtaggtagacaagagaattcatgggaaaatgcctccagagctaataacttgtatgtgtcaaacactttccagttcacagagcattttcacgtatattatgtcacatcatcttcacaaccctgtggaatacaaattatctctattttacacgctaggacaaagcattgattaagtagcttgccccatatcatgaataaatgttccaaagtggtcagtatgcagactcagaccccaacctctgcctcccagcagctatattttctgctatgactcactgtgactcaggactcaagcagcccagtgtccagtctggctgctcttcccaggagctttcccacctggcctccttctgctcaatgggtcctgctggagacccttccattggtccaactggtggtctctaccaactgccacagaagcttccaacagccacattccacccatccaacccttctgccattagagaaccaggaattccctgttttggggggtagagaattggacatactcataaagccttaagctcctaaaactcatgactatctttttactcctgcctcaagttttacacataaatcaatgaaaatctggtcattgtgtggctttccaagccatttggacattgtgaaacttgaaatgagagaaacattgaaatttctggaactctacttctgagtaccttattgccttttcccattccctaaccttccctgtgatagtcttaacattcctgctgtcaataaatatttatcaagcacctgttaggtgccagaaactattctaagttgggagtataggcctagcttggtggcttatgcctatattcctatttgggaggctgaggtaggaggatcacctaagccccagagattgaagatgctgtcagccatgatggcaccaccactgcactccatcctgggcaacagagtgagaccccaactcttttttttttttttttttgagacggagtctcactctgttgcccaggctagagtgcagtggcacgatctcggctcactgcaagctccacctcccgggttcacaccattctcctgcctcagcctcccaagtagctgggaccacaggcgcccaccaccacacccggctaattttttgtatttttagtagagatggggtttcaccgagtcagccaggatggtctcgatctcctgaccttgtgatccatccgcctcggcctcccaaagtgctaggattacaggcgtgagccaccacacccggcctgtgagaccccaactcttaaaaaaaaaaagttacttaggtgaatgcatcactgatcaccccagaaaaagccccccatgcttgctatcatgaaacttgcattacagtcaggacagactaactaaataattaacatgccaaatggtgatggacattgtgatgaaaaataaacttaggaaattaactggtggaatggggtctatgttggaaagaagttggtcagggaaggcagatttaataagacacctaaatgcagtaagggaagaagcgaagccaattggccctcaagagaagggttttccaggcacagagaacataatgcaaaggccctaagcttcactcatacttaggttattcacagaatgggaaggaggccagtgtggctggagcagaatgaacaaagggggggagtgtggtagaagatgaggtcagagtgagcaagtgagggacctgattttgtaatgcctcataggcccatagaagattgttgtttttcaggcattcaacctcgttcaaacaaaccaagcaattattttaggccagaattgttgggtgctgatgatacagagatgaataagacaaaggcgttactgtcaagaagctgagtctgatgaagaacagagacaagtaagcagacagctatatcacagtgtaactggtactgcaagagggttaagccctgattcctgtagtaacatatggagggcacctactgcagatgggatgtcagagaaactgaagtctaaacctgtgccattcagaatggggtgattaaagatgtgaaatgtgactagtatggctggggaaccaaatgtttaatattaattaatttaaatataaaactgaagcagtgtgaagcatttttcctttaaattcaaccttacagttttggtaggactacttctacttttgtcattgcatcccataagatttcatgattgttttgttagtgctcatgtactttttacttctactttcaaaaaatgtggctactacaaaatctacaattaaataaatatgtggctcacattatatttctactggacagcacattatatttctactggacagcactaatctaaactcaaagtggaagagacaaaccagggatgtagaagaaacctcaaggcagagggtctacatgtgccaacgtccagatcacaaagagagcatggcaccttcgaggaggaacaaataactcagaatgatgagtcctgaagtgccagcaagcaggtaggcggagatgaggaagaaaaaataaacagaagttgggtctgaaggtctcgtgtgttatttaagggaatttgaacttcattgtgagtataacagggagctaccgagggaagacacccagccagctgggattgttgcaaaggtcattctggctatcatgtggagcatacactgaagtggggcaagaatggaaggaggaaaaccagttagtgctggttgcaaaaatgaggcaagagtcgggggcagtgacagtggagaagagagaagtgggctaatgtgagacattatgagaggtcaagttggctagacttgtcattggataggtatgaagaatgagggtaacaggatggcttaaagatcagtccctaacactgtaggctctgaggagcaaatgactactgccctccaaagctgggtgtccaagcaaatgactgagctcctaaagggatgcggggtgtgagggctgacttcagtggccatatttccccctgaccgtaaacattatgaataaagaaacatcacctggaatttcacctgggcatcttgtttgtctttgattagtataatttttggaagttaatgtattccatgctgccaggtacactgctccagcattttcatttcctttgatcagatgatggttaagtgacaagattatatctctcaaaaataatctcaggaaaggagaaatgtacttggggttcttccttctcctccaatggcaaacagggaacataaattaaatagagtcacactccatctcagcaacccaggggcgtgcccaggttttgtggagcctaaaatttatatagttggtggttgggttttttttttttttttggaggggggaggaggaagggtctctttaagtaaaataatacccaattatgaatttaaaatcactaggtaggttctcatgcaaatgaggggccctgacacttaagcttcattagcgtcatggtatatcgatagttttaggaggccatattttttcatccattgaacatgtatcagctgatgggttatgggcactgagcaggacatagggatataaacatgaataagaacagacataggccccgccctcaagaagtccaccatttaaagcaggagatagataaataggtcattgtagaactacattatgaatgcagttataagagctctatccacagagtatagtgggtgcagagaggaggagaactcaactcacctgaggtgaaaggtgcttgggtatcttacaccagcaggatgtgtaagatacgtgaattacttaaacactaggtagaaaataggttttggataatattttgtgccccatgaagctggaaactttgtcagctaaaagtagaaaggccttaaatggcaaatccagttcttgctaaaagtctcatcactgccaagattaactctgtactactagctggagattctccccagaataaaatgacaatcctattgtggactgaactgtgtccccccaaaattcatctattgaagccctagccccaaaggtaactgtatttggaaataaggtctttatggaggtaactgaggttaaatgaagtcctgagggtaggaccctgagctgatagtttgggtgtccttataagaagaggaagagacaccagagacatatatgtgtctctctgtcactcttactctttctctatcttccccaccacaacccccaacctctgcagggcagtggaaaggcagaggaaaggccttgccagaacatactgacaaagtgactctctgtaagccaggaagagagtcctcaccagaaaccaaattttctgtcaccttgatcttggtcatccagcctccagaactatgaaaaaataaatttctgttgtttaagccacccagtctgtggtactttgttgtggcagcttgagcagactaataaagatctttagacaaacatggtccatttctccctatgcctggcccctgagcagaataccagaaacagtgggccattgctgtgcctccttgtccatacttccaggggaaatgcaagaatgatgtttagtgtccttttaccacattgggctttattccttccttctcacaccttagcccctctaggctactcttagggtcatagtcactgtgttagtctgttcttgcattactataaaggaatacctgaggctgggtaatttataaagaaaagaggcttaattggttcatggttctgcaggctgtacaggaagcatggctctggcatctctactcagcttctagtgaggcctcagggagcttttgttcatggtgcaaggcaaagcaggagcaggcaggtcacatggccagtgaggaacccacacgtggtggggaggagggcaggctcttttaaacacccagatctcaagtgaactgagcaagaactcactcatcaccaaggggatgctaaaccattcaggagggatccacccccatgatccaatcacttcccaccaggccccacctccaacactgggattcgcatttttcaacatgagatttggaggaaatgaacatcccaaccatatcaatcacagctagctaatgattctttgctcattcattagggaggtagcctaataatgctgaaagagttctggtaatacatttgacccctaaacaacacaggttcaaactgcacaggtccactcacatgcagattttttcaataaaagttacactgagtatgcctgcctctcctgcctcccttccacttcctccatctcttccgcccctgccactcctgagacagtaagaccaacctctcctcttccaccttcttctcctcagcctactcaacatgaagatgaggaggataaaggcctttgtgatgattcacttccacttaattaatagtaaatacattttctcttccttatgatttttaataacattttcttttcgctagcttactatagtataaaaatacaatatataatacatataatatacaaaattttattttgcatattattgactgtttatgttgactgtgttatcagtaaggcttctagttaactgtagactgttagtagttaagttttgggaaagtcaaaagttacacttggaggccgggcatggtggctcacgcctgtaatcccagcactttgggaggccgaggtgggcggatcacgaggtcaagagtttgagaccagcctgagcaacatagtgaaaccctgtctctactaaaaatacaaaaattagccatgaatggtggcgtgcacctacagtcccagctacctgggaagctgaggcgggggaatcttgagcccaggaggtggaggttgcagttagccgagatcgcaccattgcactccagacagagtgagactccgtctccaaaaaaaaaaaaaaaaaaagttacacttggatttccgaccgtgccaggggtcagcacccctaacctaaccccttcattattcaggggtcaactgtacttagaaatagcctagctcagctgctgtactgggtgcaaggtcccaggcaaatcaagttctgtctctgtactagaaaattaaggacatgagctagattattcctaggctgtcttctacttgggtgactccagggttctaaactgttatgtttctggggttcacttttaagagcctccaaagacttcatgaatgtctccaaggcccacataaaggaatcattctctaagatggggaggtacctttggccaagaggtcttcccagaagtcttcagatagtgtttggtatacatgtagctgtactacctgctcagaagtattagaatctcccactttttagcacttttggatccacaaaatgtttgggggacacaggaattcaaaggtctcactggaaggttctgattaacaagaaatattaagaagtcttttcccagtgagaacaggagtctctgtggtattccttccacttggacagggaaaatataaaagcaaagtgtaaaacgtcagggaggaaactgcttgagtgctatgtcctgactgtgtagagaggggaaccttcttaatgtcccaggggacaggcaaagttgtgccaacctaacctgcattttggcatgagatctcaaatgccctgtgagcaaacagccagcaccctgctctcactgccatgccagcgtcatgattggtgagtgtggcagatcctctgaggcttcaaaaccaagcctcagaggccacgtaagaggcaaggatccatttcacagtcctattgtctgtgtgcctgagaatcatagagtgaaaatacactaaagttgaaagggatttcaaggtcaaaccaaggttgaaggttgggcacctatcaaaatggctttgaatagtgcattttttcatgtgcgtttgaacccgcagttgattgcaaactctgtaagtaaccatctattatttttgtgtctcctccttggtacttagtatgttcattgtattttctgatgccaaatgtgggggagcaggcagaggagggattccacactgattcttcaattctccaacaccaacttggtgtccctcttagtccattttgtgctgctataaaagaatacctgagacggggtaatttataaagaggtatatttaactcatggttctgcaggctaagaagttcaagggcatggccctggcttctggtgagggtttttgtgctgtcataacatgacagagaaggtcaaaggggaagcaaacatgtatgaagagagaatagcctgagggacatctggctttataacaaatcactcccgcaggaactaacccagtctggccagagcaagaactcactcactaaagagcagcaccaagccattcatgagggagccacctccgtgactcaaacaactcccaccaagcgccacttcccaattcagccacatggggaccaaatttcaacatgagttttggtgaagacaaaccatagcaatgtccaacaattcaattcaattctgacactaactactggagctggcacagaccccacagggtaagggctcagtctcacaagactgcccccacttcaggtgcccaggctacctgcacttctgcctgactacaaattcaagggttcccatgactccccctcaggtttaatcactggctagaatgactcacagaattcagggaaccactttgcttacatttactagcttattttaaaaggtgcaacttaggaatagccaaatggaagagatgtctggggcacagtatggggcagggcacgcaaagtttccacactctgtccaggtgcaccctgtcccagcccatccctgtgttcaccagcccagaagcttcctgggtcccattgttcaagactttttataatcaatttcaagagccctgcctcccaccctttctgaagttcaggggatgggactgaaagttcagcctttctggtgaccagcctccatcctggagatatctaggcgctccaacctgagtcacctcattagcataaatccagatgtggttaaaggggttccttgtgaataacaaaaggcactcctgtcagtcgggaagttccaagggttttaggaacttcttgacttgaacaagagactaaaactaaatatattttttattgtaccacaattgcacacagattcttaattaaacatgtatcagttaattcactgactagcttagaacacaagaagcctgatgaggggctaaaaatggctaagaaatcccttatctctaaaatcagaaagattatgggaaaccctttagtttgggacaggtcattctgctagaagaacatataaccccaactccatacataaccttgaagttggtgagaggatagataaaatggcatgcatttttggctatttttgtaatttaaaaaggctaaatttctgattcgggagttttcccagatttagctaattatgaggctctctgattactccttattccctgaccctctttattgaatccttgtgagctaacagaatgacagaaagcaggggctgcagcacagtgcccttggcacctcctgcagctgagaaacctgctatttccatatgcagaagcttgccagagctgcatctgagcaagctgcgaagagacaactggcagcagaaagatgcatcagcaccagggaggtatcagagcaggtcagccagggtatgctgcggcaatcaattatgtagtaggatttggctgcctttcagaagcttctttcaccacattccaaaggctcttgcattaaaaggcacacagcactcttttctcctcaagatggcaaactcagagaggattgcctgggccaccccacagcttcctaccattcaagtttcttacatgttgtgaattgaagctgagattaaggaaagatgcttggaggtttgcaactcaggattcctcagcctgaagtatctcaagagatcatcttgttcatttacagcgtgcatgcctacactgagaatggacaatgcttgagatgttccatttatcccctgattcacttctcatctttggaggcaataggctggaccagattatttctacttcagcagtagagacaggcctgggtgaagccgaagtttcaccaccccatcaatctgctctgattccgaagttagacctatttatgcaatgcttgatctttccacatcctctatcttttcgaggcccaggctaagaaataggaggatgaccaactatcatggttttctcaggactgaagaggttactgggacacagaactttctctttttttaacttttattttaggttcgggggtacatgtgcaggtttgctatataggtaaactcgtgtcacagaggtttgttgtacaaattattttatcaccccggtactaagcctagtacccaacaattatttttttctgctcctctccctcttcccaccctctactcttaggtaggctccagtgtctatcgttcccctctttgtgtccatgtgttctcatcatttagttcccacttataagaaaaaatgtgcagcatttggttttctgttcctgtgttagtttgctaaggataatggcctccagctccatccatgttcctgcaaaggacatgatctcattctttattatggttgcatagtattccatggtgaatatgtaccacattttctttatccagtctatcattgatgggcatttagttcattccatgtatttgctattgtgaatagtgctccaatgaatgtatgtgtgcatgtgtccttatggtggaacaatttatattcctttgggtatatactgagtaatgggacaaatggtagctgtttttggctctttgaggatctgccacactgctttccacaatggttaaactaatttgcactcccaccaacagtgtataaggattcccttttctgtgtaacctcaccagcatctgttattttttaactttttttttgcctcccgggttgaagcaattctcctgcttcagcctccagagtagctgggactacagggatgcgccacaatgcctggctaatttttgtagttttagtagagacagggtttcaccatgttagccaggctggtctcgaactcctgacctcaggcaatctgcccacctcagcctcccaaagtgctgggattacagacatgagccactgcgcccggccttgactttttaataatagccactctgactggtgtgaaatggtatctaatgtggttttgatttgcatttctctaatgatcagtgatatttagattttttatatgcttgttggccacatgtatgtctttttttgaaaagtgtcttttcatgtcctttgcccattttttaatggtttttttttcttgtaaatttgtttaagtcccttatagatgctggaaataagacctttgtcagatgcatagattgcaaatattttctcccattctatactttgtctgtttactctgttgatagtatcttttgctgtgcagaagctctttagtttaattaaataccatttatcaatttttgcttttgttgcaatcgcttttgacatcttcatcatgaaatatgtgactgttcctatgtccaaaatgatattgcctaggttgtctttcagagtttttatagttttgagttttacatgtaagtctttaatctatcttcagttgatttttgtatatagtgtaaagaaggggtccagtttcaatcttctgcatatggctagccagttcacctagcactatgtattgaataaggagccctttcctcattgcttgtttttgtcagctttgtcgaagatcagatggctgtaggtgtgcggccttatttctgggttctctattctgttccattggtccatgtgtctgtttttgtaccagtgccatgctgtttttgttactctagctctgcagcatagcttgaagttgggaagcaggatgcctccagcttcatccttttgcttaggattgccttggctattcaggctctgttttagttctatatgaattttaaaatagttttctctagttctgtgaagaatgtcactggtagtttgatacgaatagcactggatctgtaaattgctttgagcagtttggccattttaatgatattgattcttctgatccatgaacatggaaggtttttccatttgcttgtgttatgtctgatttctttgagcagcgttttgtaattctcactgtagagatctttcacttctcctgggacacagcactttcaggctaaaactagtaaagtcccagacaaactaagatgagtcagtaactgtagtaaatagttggaactgacctgaaacaagtgtagtaccagataggtttttgggaagccaaattcaggggctggttttgtttggaaggcagtggctctgctatactgtttttttgaatttggcaagaaataattatgtgatctgtggctacacaaaaaaatgaattgctatagcagtagatagtgtaagcatatagactccaaaataaaaatccacaaacatatatgttttatgagagaaggaataattatttctgtactctatcacttactacaatgcaagccacatagtaaatattctaataaatatttgtgaagtaaatgaataaatgaattccagctctgtctggctctatcattactacctgtatgacattacctaagttactgaatttctttctttctttctttctttttttttttgagatagagtctcactctgttgcccaggctggagtgcagtggcatgatcacggctcactgcaacttctgcctccagagtgcaagggttcaagtgattcttgtgtctaaaaccaagtagctgggattacaggcatgcatcaccacactcagctaatttttgtatgtttagtagagacgggtttcgccatgttggccaggctggtctcaaactcctggcctcaagtgatacgcctgcctcagccttccaaagtgctggggttacaggtgtgggccaccacacccagcctgaaggtactaaacatctttaagcttctgtttcttcatctgtaaaatggggatgataataattagccacttcatagttgttatgggctaaatgaattgtgtccccctgcccaagtttatatgttgaagtcaacccccaatacctccaagtgtccttataggaattggaaatattgacacagagacaccaggcacacgtgcacacagagaaagaccatgtgaggagacagtgagaaagtggccatctgcaagccacagagagaggccttaggagacaccaaacctgctgacaccttcatcttggaattctagcctccagaactgtgggaaaataaatttctgctgtttaaaccactcagcctggggcattttgttatagcagccttatcaaactaatacaataggagaaataatgttcatagatcacctagcacatgaatgctcagtaaatatttctaatactaaaaatatctgagcagggcactgaaaaatatataatacacacaaaaacatacaaaagggaatcagtagaattatttttctacacctgaggaccttgggggacagagaaaactgaacctgccctgcatactattctctgcactgggatcatgaaagagtgtatccacaaatgacattctagtccagaacatctcaaactttaaagtgcatatggatcacctggagaacgtgttaaaatgcaaattctggttcagtgggtctacggtctgcatttcaaacaagctcccagttgattctgatgctactggttacaggaccacaccaggcaacactgaagaaataggttgctgagtcctaaggagagttataaacccttggatacacaagacacaaaaccaaatacatcgagtggccagaaaatactcagtaaattgaatcctatatttgtatatatcatgactagagatggcagtgccacttaagtatatatataataattcaggaccatggagttaaagtgctcaggcaggtaaagtcatctggagaattcctgaaggaagaaaggaagacacttgattcagcaggggaaaataaagaaaacattctctgtaggagaacccgtctgggttaaagcgaacttaaatagttcaagttgagttgtatttagttccttacttccctaccttaataagtacaggggcggcatttgctgctcctctggaagggtgaggggagggaggaacgtgtgggtgtgcttatggcactgtttgctccggctagctaatgtttggtttccttatctttggagagtgtaatgggtgttggtgccagcttggaggccacctgatctcaatcagactctaaagtcattaacgaagctactaggaggtaggcctccacgtggcctgcagccagagctttaggaagcgggagtatggagagggaaaacaaactcaaccttgggttacctaagatgaacatctttatactagagctccagaatctgcatcaccaaggctcttactatgctccaagatgtggtcccttccaggtacctgaccacacacaggtcagactttccttgtcccctgagacccaggaagttccatggggcaatcagatgtggatccaaatacttggggatgtttatgtttttagtggtttttctagagttggaggatgaattatgaaacaatagcagaaatttgctgaggtgcggtggctcacgcctgtaatcccagcactttgggaggtcgaggcaggcggatcaccggaggttaggaatttgagaccagcctggtcaacatggcaaaaccctgtccgtactaaaaatacaaaattagctgggtgtggtggcatgcgcctgtaatcccagctacttgggaggctgaggcaggagaatcccttgaacccaggaggtggaggttgcaatgagccgagatcgcaccactgcactccaacctgggcaacagagcaagactccatcgcaaaaaaaaaaaaaaaaaaaaaaaaaaagaatagcagaaattccagaccctgaaaacttggatttatccgctgacatatgggtattcttttgtagaaacatgagtttcttgtatattaagtggtcaagatgatccctgatggtaatttctccataaacagatttttttagggcttcattcagactgtaagatcaaatatattattgggtttagattaggagcttggattttggaggtttgctagctgtttcacctgggcaagatccttaacctctctgaagtctcaatttcccaaatttaaaaaataatatttatataatggattaaatgagacataaagcatataaagtgattggcttttattataattctttctcttcttatcccacttaattacattcttcccatgaagtaatgtcaggctctataaaggcagttggggctgtgggcctatatccctcctctccacccatcctaaagtctactacactgcttctctgttagagaatatttaattgagcatctcctgtatgtcaactaaaagacacagtctttgcacgtaaaggagtccacagtcacttagagggagacaagatgagtcagcaaataaatataatcaagtatctcaggtgctctggcaaatgtctaaatggacaaggagtgatgaagcagagcatgtttacttttagtttggagacttaaataagaaaaggattaaaagtggatgtgtttgaactgagttttgagaaatgagaattggccaggtattctagagtgtgtgtgttgtgtgtgggcactcggtggaaggggaggattggtgggcatgggtcaccaagaaacaagcaacagcatggcttgtcagggacctggaagaggtttgaagttgccagaggatgggatgtgtggggaaggtggtagagcaatagataaggttacacagctagatcaaggtcaactcacagagggtcttgtaagccatacttagaagtttgggcaatgaaaagccagtaagaggggagtggtttggtcagacatatgggtgttataaggaaaattttttctctagttgcaaaaatagtttattttcaatggggaaaaaaaaccacaaaaaaaaattacatatgaactcactactaatacccaactcataatgtactggagtgagttttccagagagaataacagagtgtaaaaggaaaaaaaaaggttttttcctactctctctgctccctatttactcaatacagaacacttcttagaccagatgtgtgtttttccccgtacaccaagcaattctccagcagaccctctctgggtatcctagaatccaattctgattctatctacctggatatagcatcagatcccagtggttgtgggctcagtcccacaaaactgctctcacttcagaggccaattgcaagtctgggccacctttatttttcaccaaccggctataaactgagattccctcaactttctgctgggatttgattaatttgctgggatggctcatggaattcagggaaacatttaccagcttattaactgttttaccagtttagtacaaacgatattacaaaggatacagataaacagccagacgaagagaagcacagggcaaggtatggcagagcggttgcagagcttccacgccgtgtctaggtgagccaccctcctggcgtctcctagtgtttagcagtcccaaagctcatcaactcttgtttgagtgtttatagagcttgatgttcagcaacaccctccctcccctccttggaggttggagggtagggttgaaagttccaatcctctaatcacttggtctttctggtgactggtcctatcctgagactaactagggcccccacactaagtcaccttattagtataaatgctggagttattaaaggagctcattatgaataacaaagatgttcctatcacccaggaaattctaggggttttagaagctatgataggaaccaggaaaaaagaccaaagatattttacatcatatcacaaggggaaagggagccaacatgtactgagctatgtgccaggtactttatgaagtttatctcatttaatgtaacactgaggtttgctgctccatgtgggtccacagccagagggttttgaagagggcctagagaaggggaagaataaactcagtcttgcattacagaggctcctcaacttatgatggggtcacattgttgtaagatgaaaatatcaactaagtcaaaaatgtatttaacacacctaacctaccgaacatcatagcttagcctagcctaccttagacaaactcataacacgtatgttagtttaccttgagtaaaatcatctaacacaaaatctattttaaaataaagtgttgaatatctccatttatttatttatttatttatttatttatttatttatttgagatagtcctgctctgtcgcccaggctggagtgcaatggtgtgatctcggctcactgcaagcgagtctcttgcctcagcctcccgagtagctgggattacaagtgcacatcaccatgcatgtctggctaatatttttgtatttttagtagagtcagggtttcaccatgttgaccaggctggtctcgaactcctgacctcaggtgatccacctgccttggcctcccaaagtgctaggattacaggtgtgagacactgctcccggctgcctgtaacttattgaatactgaactaaaagtgaaaaacataatagttgtatgcgtactcaaagtatggtttctactgaatgtgtattgcttttataccattcacaaagtcaaaaattggtaagttagggactgtttgtattaggtaaactaaggagaacatctttacaaaagtgccaaatatttgcatcgccaggatctaatgctctcactgtgctccatggctagataagatggagcatgggaaggtgggaggagaagcaactttgggaagaggagatgaggataataagttctttttgagatggttgtaaggcacacacgtggatgtataggtttagtactcaaaagagaaatcggggctggaagtaaaaactttggaattggcatttacattagatttaaagccatgagaataagtgaatgtgccccagaaagacagaagagagaagatcaagactagagccctagttgccgggcgtggtggctcaagcctgtaatcccagcactttgggaggccaaggcgggcggatcacgaggtcaggagtttgagaccagcctggccaagatggtgaaaccctatctctactgaaagtacaaaaattagccaggtgcagtggcaggtgcctgtaatcccagctactcgggaggctgaggcaggagaatcgcttgaacccgggaggcagaggttgtaatgagccgagatcgtgccactgcactctagcctgggcggcagagcaagactgtctcaaaaacaaaaaaacaaaaaacaaaaaaaaaacaacaaaaaacagaatagacccctagagaatgccagaatttaagaggcagagcaaaggagataccactagggcctgtgaaggagggtcaaagaagaaccatgaaagaaagatcctggaattcaccaactgtcaaatgtcacacaggccaatcaagatgaacagtgcaaagaggacacagggttttgctatttctcagtgggagctttgcctgggccctttatgaagtgggatgcagggagcctcactgcagcaggtggaagaatggatggaaagtgacggtaaatgcagtctgtacttttagagagcttgactatgatgggagacggttttgtggtggattgatttgttttgcttttaaagactggagaaaatagcatatttttatgatagaaaggagccaatagtggctaaacatgaagactggagagagggaataaccaaggttgcaaagttctacagcagtttttctcaaccggggacattcagtatctggaaacatttttggctgtcacaactggggtagaggagttgttaccagcatctgctagacagagtccagggaggctgctaaatatcctttaatgtacagcacagcccctcatgacaaagaattatctggccattgccaacaatgtggaggtcaagaaaccctattctaaaggaagaaaaaacagaccaagaatgcaagtgataggattagcttccacctgatataacacaatgcatatttgttaaataaattaatgaatttaaaattccataaatagattccatcctgtttcctttcatctggaagccctataacttaagcatggcataaaaaaattgaatactatgtaggtactgcagactcaaagataagacacaagctcgtactctaagttttgaataaaatgatgctgcctagagaattcagggaagccttggaagatgggaatagagaaataaaattgacttttattaagtgtccactttatataagcacttaaaatatgcttttatacaagcactttatttagttgtgtgatttaatatacaccacactctggtgagtgagatattagctccattaactagggaggaaacagagtcacagaggtcaagttaacttgtccaaggtcactcatctagtgagaaatggaaccaagatttgaacccagttaagtctcaccctaaaatctaagttgtttccattgtactatgctgtcttcatgcaataaccaagtcaagtgacatctcagccttgaatgatgagcaggaatttgcaaaacaaagagaggggaagagaggactgggcattccagatattatggagcacatgcaaaggccctgaggtatgaaacagtcgtttggtgaggctatgtgactgaaataaatggcacagggcagggcaggggcagaggtggaccacaaggggtggagaagtaccatggcagccatgtagctaagtcttttctagaagtcagcagctcttaattttagcctttcctgatgctgttcaaataattgagcctccctatcctctgttttacactgtttttcttttgcccagtactatatttttcatattccaagcacagaggtgtctaaatattggtttggggtttagtaaatctttttctttcctatgacagcaaaaacgagctatgtaacttacaactcccttgactgagacattcattttacaagcaaagtgagttatggattaatttgggaatatttaagctccggttaagcagcagtgggcacacgattgcctagaacataaaaccaggacagtcagggagcatctctagcttgttaactgtaatgccagataaatgtcaccctctgctcaggctttttaataatttattaaaaaaattaaaagtactcagttgtacttcctaaggcatttcctgtttagagggtgtgtattctaacagctgtgttagaaagtgtgacctaagagctttcagattgcttgtcctttgaagctactgagtgccaagctaggggattactcccacctaggccagagcctggtctcccggcctgaacctggctatcttgggttcccagctcctacaaccatacagtctgtaataactgcagagcatgaagggtgcatggaggtctagaggccaattcactttcatggaaagtataatttaattggaaagtgggaaagaataatgtttacaaagtatcttgcagagatttctgtatttccggatcacagagcagaggctgacaggcacagatcaccactgaacctctaaacattcctgttctccccaacccccaatgtctttccctgtcctggaaaagtgcaaaaaagcagtatacatcccaggctgctggacatatgcccaattattctctagggcaagaagtctacccctgatagtgatatatataaatgctcatgctttaaaaaaaaaaaaaaaaaaaatacagcaagtttaaccaggcgcaatagttcacatcagtaatcccagtggctgggaaagctgaggtaggaggatcacttttagcccaggagttcaaggctgcagtgagctatgattgcgccactccactccagcctgggcgacacagcaagaccccattcaaaaaaaaaaaaatacagtcagtttaagcacgatgtatcattttcaggtcacgagttcactaatctctactccagtttatttttaaaatacgcagtcatagtttcacaatttctatgtaagtctcatttcacacaaaagattaatgcataaaattgtttaaaatagcattatttacaatgaaaatctgaattgcaaaaaaaagctgaactaaaaaatagacaaaaaattaaatgcaatttacaatcacaagagaatgggtaaagaaagttatggtacattaacagtagatattttgcagctattaaacgttatacttaacaagagtaatagtaacactaggaacgattatataataatgttgaataagcaaaacaagatacacaactgtctatacaattgttatttcttttttttttttttttttttttgagacagagtctcactctgttgcccaggctggagtgcagtggcgcgatctcggctcactgcaacgtccgcctcccaggttcaagtgattcttctacctcagcctccctagtaagctgggattacaggcacccaccaccatgcccagctagtttttgtatttttagtagagatgaggtttcaccatgttggccaggctggtcttgaactcctgacctcaggtgatccacccgcctcggcctctcaaagtgttgggattacaggtgcgacccactgcacctggccacaattgatatttcaactgtgaatgtcatgcatagagaaatgattggagatgtacaacaagatgtaccacagattaattttaccaccagaaaaggccaaatctccctgtctgtttgcttgggctgctataacaaaatacgttacactgggtaatttataaacaacagaaacttactgctaatagttctggagactgggtagtccaagatcaaggtgccagcagactcagcatctagtgagagccggttcttcatagatggtgccttctgtgagtccttacaagacagaaggagcaagaaagcaccctcaagcctcttttataagggcactaatcctattcattcaggtggagccctcatgagttaatcacttcccaaaggtaccgcctcttaatactattacactgagtattaggctctaacatatgcatgtggggggacactgcattcatactgtagataaaaggagccgaagaaacaaacagcctctcgcatagtgttgtttacatccttctaatgtctctagagaaattcatatataaatagggaatactttatatgcctgatgtggccggtgaccagaatgccattatttaggaagagtagaaaaagtagcagctctgataactaaggaaaaaaataaacccacaaatatgaggcttattcagttaaaataccaaacctaggaggatgagcttcaactgcttgccataaaaatctcactacaagagtctgcagctttccactgcaaaactagaaaattaaatatctttcatcttcattttcacaccctttactgtattttcttactaatattaggagccgcagatggcaaatcaatagaatgtttctatgatagcatggaccaaaaagaatggtgtagaaagagataagtctgtctctagctattccatcgtggcttcatcaattggacagggtgaatgtcacctctgttgccgatttaatcctcctctttcaagtctggacacctgcattcctcaactatcctagctccaggggaggactaacagggagggaatttgtttttttaggtattgaaagaaaatcacatcaaataataaattactctctatatctcttttaaaactgtctcgtgtgtctttaaaatgtcatgggagaaataaaaaggtacactgagagagtatgctcaatgaaatatttaaaccataaaggcagcaaggccggtgattaaggagattaaatagatctggatgatggatacaaatcagaagcatgttgtcaaagattagtagatattaaagctctttattgtccttccaacagaaaaaaaaaagcagtaatacggtttttttgatgtcagtctgagccatcaagccattatgtaatttttatcttttcttactccttttgccatgaggcaagacaatttatttcccctgtagtaaataaatttcctctgcctcaaacatgctctgaatgtaatcctgggctagccacccacctcttaggattcactttcctcatttgctaaaggagggaattggttctcatagttctgacattctgtgtttctctgaaagatgtttagagagttctaggatgtgagttatcatatatcatctacactaagacacatttaattataagataagccattattttatgtactactaacaaaaaaaagatcctgccaactaaactatgacagaataccctaactatagccctgtgacctcaggattaatcacaccagcctctcatgctttgaaataaaggacaattcctgccaccctccattgcattgcttggttgattttagacagttcatttgtatgtatctcactaataaaacaacacaattttgcttgtaggtatctttctttctcaggtcccataaaactcttgattcttgttcttttcagaataatatatggaactgcaatcatttctctgatgatgaatatttgcttcactagtatcaaattcatgccccactatgttcatgccttctacaaatacgggaatcatagtgtaatttttttaaaatttaaacaacaagtaagctcaacatgttattaccaatagtgtccttaactgaatggaagtcgtgacaacatgaacagctatgactaattttgaacctgggcagaccaggacaactacatcatggctacagtctaactgacatccctactgacttcagagatgtcaaaaaacaaccaggaacctgggcaacattgtgaaaccccatctccacaaaaaacacaaaaactggccatgcatggtggcatgcacctgtaatcccagctactcaggaggctgaggtgggaggattgcttgagcccaggaggtcaaggctgcagtgagctgagattgtgctactgcactccaccctgggcaacagagtgagaccacatctcaacaacaacaaaaaagtggaggatggtggcaaggagaaaaatatgtggtttagaactgatgaactgagatgtcttcttcacctccagtgagagaggagtggcatatagcaagcgttccctaaatatttgcaggttgttgaaggactgaatgaaagtatagatgaaaggatgaatgaaaaaacaaacaagtagctaattgggaatgttgagaaggcactttactgccttctttgagattgcttcttatggcaaactgcactgcagtcttgaatcaccacggctggctaaaatcatggcgacccaaccttcacctaagactctggaatctgattcacattcacctcccagcctctgctgacctctcatgcctctatcagactgcgaaactgaatgctaaggtccacgtagaggactcaatgtaacacaagagcttacatttccttgactcctcaacaccagtggccttgccttcttatcctcccctgcagctgctcccagccctactcctccttgtccttgtttttccaccattctatgacatcccatccctgcatatcgacttcctgccttctgcatccaggtggctacaagcaattatatagattcatttgctccaactttaggtgaccctcaagctgctgctaacctgttccttctgtcattcttctcaacagctctctcacgcattctctttttttccttaaaccctcaacaccttcatcacctgcaacttcagtaaatcatctttctactttatgagaaaattaaagctatcaggtcggaactccctgagctccatcaacaacacctaaaaactctcagtctaattctatcccttctttctctcctctcaggacattttctctagttcaaaactaatccctccatctgacctctgcctacgcctcaggaaactgttactctattcgttatcctctctatctcctttactccaagcttcccctctacttgatctttcctggcaaaatataaatattatcatctctaatctaaaaacaacttccactcgcccactcttctcttctagctcttagtcatttctctctttttcaaagccaagttttttaagtctacctattattgttgcctccactttcacctcccattcacttacaaatctagtgcaatctggcaaacatgttcaccatgccaacaaaattgttccctaaagtcactaattacctgcacagggctatccttacctcacttgacccctctacagtatttaatgctgtgaaatattccctcctcaacatctgttccttttggttattgtgatactgttctctcttcctttttcatgtccttctctgttttattctttggtcagacagaaaaaaagtttttgctttccccagtctacttatgagttctctttggtggtcacaaatacactatttcagcttctgcatatgacccacagcctcaaatctctacgcccaactgaaacttctctctgcgttgatgataacaggtctcaaactcatcatcttcccccataagcctgcttctcttcctgcctcaggtgtcaagccatgcacacaggtgtcaagctggaaatgtgtcccttcctttagatgtgcccctcctcacccacacatctgattggttacttaggcttttagagcctgtaagccaccctctctgtaatccacttctactgtttctactttagctgaggcctttgccatttgtcatgtggatcatcatagtgggctgctgggtgtttcttctctaatctatctgccacactgctgccacataccacattactaccagaataatctttctaagatgcaaatcaatcagatcatgttttttccctgtttaaaaatacttcgattgttcttccggtagctttcaggatggaattaaaacatggaacacacaagatcccccatgatacgcccctgcccacatctttagcctcttattccatcaggtacctctaatggcttcctgttttctgatcacacttgactgtatacacatgatgtttcatgcccctgagactcctctggggatactctctaccttcttatctctggcccagcttactaactgctgaacatccctctcaagcatcttttccctaggaagctttaactacttcaattgggagcctctcttccattctagaagagcaactggtgcatacccctatcacctctattatcattaatgatttgtttatacgtctgcactagaatataccctccatgaaagcaaagactgtatgtttttggctgaaggtgttaaaaatattagcattaaatgaatgactaaatgaataaaccactgagcttttgggtctaaaaacaaggtcaagtgaataaggcattttttataatcaagacagagtaaaacttttagaaaaattaagtagtgataacagtgaaagaactgtaaaagaagtgctttattataattagatatctatatttatatatttctctaaattgtatcatccccttaaatgtgttaacacagctattattgttttggtgtcttgatgatattttaattttaagtgaagaaactaatttattagttttagcatctggatccaaactcctaataaaataattcaagtggagccaatgtacctgaaacacaatctggacaccatagtataccttaggcaattcaggttttcttaccaaataccttaactgggtatttcaatttatccaaagccaggcatagtggcacatgcttgtagtcccagctactcaggaggctgaggcaggaggattatttgagcccaggaattcaagtcaagcctaggcaacatagcaagattctgactctataagataataaaataaaatgtttccaagattttatcccaacatacctttcaccattattcagcactaaatctacattcaagttaaattaaactcctaaacactccctgaaaatgctccacattttcccaatgtgttatttcctctatatgggccttaactccttacactgagaatctctttgctccatttctacctgtttaaatactaagtccaactccatgcacatacagttttctgattcctttcagagagattttgtgccttttatcacatccagttttatgtatttatttatttttattaatttatttttgcaacagggtctcactttgtcacccaggctggagtacagtggtgctatcatggctcactgcagccttgaactcctagttcactgaactagaagttcacttgaactagatcacctagatcacttgaactcaagtgatccttccacctcagcctcctgagtagctgggactacaggcacacgtcaccatgcccagttaatttttgcttttgtttttgttttttgtagagatgaggttttgccatgttgcgcaggctggtcatgaactcctgggctcaagggatccttctacctcagcctcccaaagatttgggattacaggcgtgagccactgcacccggcctactatactttctaattatttgttttttcttacattgggacacagctgatttttgcattttaatcttgtttctgtggattttgctgaactctcttaatagtttgtagattgtcttcaattttctatgtagataatcacattgattgtgaatactgtagtttgtttcttcctttcaaatccttaggcatttaatttttttatcttattactgcctgctaggacccccagtactaaatttaatagaggtagtgatggtggacattcttgtcttattcttgacttaaagaatgcttctaacaaatatttaaccattaagcatgcatactaagcatattatttgctgtaaattttggatgaatatcctttatcaagttagggaatttccctctgtaatgattagctaagaatgtttactgtgaattaaattttataaaatgttttctctgcatccattaaaataatttgaattttttctcctttaatgtataaatgtagtaaattataataatacattttctaatggtcttttttttttttaagagatggggtctcattttgttgcccaggttggtcttgaactcctgaaagtgatccacccgcctcggcctcccaaagtgctgggattacaggtgtgagccactgcgcccggcctctccaatgttctaatattatattctgggataagcccaaagggatcacaaatattagctttaatgcattgctagatttaattttctattattttgtttagaatttttacttctgcatttatgagagattggtctataattctccttgtctggtttggtatcaaaattctgccagcactataaaataagttacagtcagttcttccttttctattatctggaatagatcatataagattatgattatcttgttcttaggtgtttggcagaattgcttataaatccctttagccctggtatgttttgtttttgtaggtagattttaaactaccaattcaacgttttaaaaatagctatagttttctaattagattttctgtttcttcttgagtcagttttgtaagttttctttttctagggaactggccatttcacataagttttcaaatttagttgcatgaagtttataatcatctcctattgtttaaaaaatgttacctatgtagcgattttctttttttaattcctgtcagttttattagtcttttcaaagaaccagctttttgttctcctgatcctttctatcataactttgttttaaattttattaatttctgctctgttaatacttccttccatttactttcttgtgtgtatgctattgttccattattcaatgtcttgagatggacatgtgactcattaatttccagtgtttcttctttactaaataaacattttaaagcttttgtaaatttctctgcgtaagttttggaatatatttcattatttagctctctatattatctaactttagttataatttgttcttttatttaggacttaatcacaattgatttattcctaaagttatttagaagtgttttaaaatatctgagcgcatgatgttattaaagctttttttaaaaaccgatcagataacatgatctatatgatactgacttgtctgggctgagatggtgtcatgatgtcaccagagacctggatccttctatctttctgttctgtcatcctaattcatggcttccatcacagaccttttttgtatttcccattgttttcagtaaaatggtttgcacatagcagctatagggtacatcctacatcatgctacataagaaagatttaacagcccaaacaataatcatgagatttatcatgaatcagtctcatcagcttttctctttcagaattcagaattcgaagttcagagccccattttggatttgcacatcagaggtctggactctatcccacgccccagctctggacctcgagggctggctccaacattaggcatttgggggatatttattagattaaagaatacataattagaaaagaatgaatactccctgcatgctaatcctgctagccccaaactagaaacggatggcaaatgtcacaaatagtaattcaatactctttctaaagagattggaacacagtctacaacaaggcaggcttataatgcgagcagaagcatcacgtgctgcacattcttggggagaacaatttaaggaaaattaatttctaaacaataacattctgaaagcctctcaaacatatatgttcaccaatctcctggctgacctgtcacaaagggtcactgttgttcacagcacaagcagtctgtctactcaggacagcagccacttaaccccagatattgtccacagagcaaatctaggtatatgagccaaaggcacatgtatattggggagcaggaaacctgaagtttagggtaaatgatttctatcatgttctgtaggccacgcttgacagtcctgtaactgcacccttccaccttgctttggccaagttaacacagtttgggtgtggttgctcataaatattcccaaagagcaatgacgattcttttggattcctgaacacaccatctctgttgtgggagaactctggggtatgtttccagctctctcaatgaagttttaatcaaagcactgtttccttcccgttgttgcttttggaatggccttgttctctgagtcctagctttgacaacagcaactgtgctgaacttttccacagcagcttttggatttctgccccaccccctcccatctgcacgcccccatttcctctcttctctgttttggctctgcgtggctcttctgagtaaagtggctgaagagtaatgaacccaaaatacctaagtaacaaatgagtcaccacacttccacagaagagctctgaggatcagtgggtgtgttggggggtaaatagcagaggaggtggctgcccagagagagggagagagagaaaaaatagaaacaaaacgagcaagttggcagaggtggctgagagcagctgagtgggtggagggggcggggagccgggttgtgttggcttgcaaaggtgagatcagtgctgtggcttgtcacaccctggctgactcaagctaagcccaggcccctcgggaactgttcacactgggctgtctagtaaaaatcagctagacaagtcgcctaactgccgttctcttgtgtttacaagttctgagttgtagggcttggaattctttgctcaagttgctgcaaagctgctaattaggaacctgcaatgatattgctctagggccattccctttctggttatatggtatctgggtgataagagtcagggcagaatttaaatttcttctttgtacttttttgtttgttgggaatgtttagaatgcatccttttttcaaaaccttatcttgaagtgtagtggtggagctggatcgccacctcaaagctaaggctccaggcagcattgatcctgaccatgcccagcaccctaagaggatgaggctctgctgagagatcctgggatgctgccccatagggccagctttgcttagaagccactgggaatttgtcctggcagcttaagttatgactcctactttttttttttttttttttttttttttacctttctaagtaaaaaaggagtggaataggcagagcccttggaacaagacaaatggtctgatttcatgaggttctgcctggccagcccacagtggacttttaatctgtcacaaaaaaaaccagaaagaaaatccatgtgtgcaaagaacaaggcctaagattcattcaggactgttaatgtgaaatgacctccgggagaatcttttgaaaaaagaattataaaatgtcctctgagacaggtggtctcagatcacaaggataacaggatttgatcacaagctgtctggttttctcttaggtcaaaaccaggaagttcagggactagcttacaaacagaggaaaacaaaataagttgatttggatttttaagcctccagcaacgtttcacttcacttgaccctgcagtgggggctggtgtcagcctttgattttatcttctgcagttctcccacccctatcccgcataagtataaaaccagatgccacgacttggaaagagcaaaatttgatcttgagaggaagtgggaaaatgtaaaactaacacagctttggcagctagaaagaaacaactatagcccctgcaaagaaagattcacaccctaggcaacatagtgagacagcatatctacaaaaaataaaaaataaaagaattagcaggttgtggtggtgtgagcctgtagtcccagctacttgggaggctaaggcaagggaattgcttgagcccaggaggccaaggctgcagtgagccgtgatcatgccactgtgctccagcctgggcaagagagatagacaaaaaacggaaggaaggaaggaaggacagatggaaggaaggaaggggaaggggaaagggaagaaggaaggaagaaagaaagaaggaaaggagggagggaaggaaggaaggaaggaagggagggaggaaggaagcaaggagagcgagaaaagaaaaagaaaaaaacaaagaccgagaccaaagacttgataaaggtgaactttctgaacccataaagttccttaagtgctgcctctgctcatttagtcttctgctcacctgagcccactgatgaataaatgaaaatctttggaaatgattcatgaaaatcatcacaaggaagcatattcttggcctctgaagtcttcatttcaaaatgaagtttatagtttaagactataaacaatacacgattcttataaaaataaaagtagaaacaaaaaatattagccatagttccaaccctcaaatgttaacacttcagtgtgtttccttccagttctcttataggcatatagacttattcttgtaacacagttgcactcattctgtatatatggaattgtgtatgctgctttttgctaaatatatattactgttatcatatagaaaattatgcaaccatcattattaatagttgcctaataaccaatacagttaatcagcccatcttcccccactatgttttggacattaaatttgtattcagctttttaaactgtaagtcttgatttaattaatgtacgaaatttagagctttttgaatcagccccactacttagccatgtagcaaatcttaccaatatctggaccagcaacctgaaggctgcaggaggaacctataggacaatcagagggaggtactagtacagattcctcgggctgtaggagtttctggtacaggggtcttgaaggacaaagaaattgcctgacgtaaggtcaccagccctctagctgtgtattccctgtccaatgtcacccacaagcctcatttccagctcaacatcttcaagcatcctagagaatagagatgacattttcaatgagtgaaaaaaaacagtaaaacaaaggacagggataacacatggcaaagctgaggatcttttttgttttaacataaagggtcatattgtctcttattctcatttcttattggagcattctgacatctttattttgggcttccctggttaggttacctgctggagaggtgtgtttagagctgcagttagggcagcaaaagcagagagagttggcaccagtgaggatgggcagagttggctatggatataatccatcatttgccaaatagctcaaagttgtatgaatatcattaaatatttcatgtaaatgctgttttttttcaagggcaagtcctgtttcatagaaaatatagttcccgagcatagtaaaggagcatgtgctccatactaagcacttctaaatgattatttcatttaagaatctcaacaattcagagttaagtgctctcttctccagtttgcacataggacaattaaacagcagaaaagtaaaataagttgccaagaggacttgctaataaatgtttgagccaacattagaacatagagctgacttcaaagtttgtgatctttgctctacattatgctgcctcccttgttaaacctaacagataaacataagtgcaattttaaaaaagagttaatgcttattgattaaaggcagggctttctctgggatccaggagtcaccattatgggtaggcaggatcatttacaacattcttttgaggatccctttaaaaaaaaaatgaccactgggtccagccaggtcaacaatggatgaggaactcttccatggagttctgaaaggccctacagaggctctgacaacaaggaggccacaggacagcttccacctcccagtttttcctaggccaatccttgggacatagtatggttgatggaaatggaaactattgcttcttggtgcattttttaaaggaatggttaaattataacgtaagagtctgttttcccactagacttgagttttataatatcagggaccatgtctgtcttcttcattgccatagtcccattccttgtacagtgcttggtccatagcagatgatcttagtccatttgagctgctataacagaatgccatagagtgggtagcttatgaacatcagaaatttatttctcatagttctgcaggctgggaagtcccaaatctgcagtgctgagagatgtggtggctggcgagggcccacttcctggttcatagatggcagtcttctcactgtgtcctcacatggtagaaggggtgaggaaactcaccagagtcctttttataacagcatagcactaattctcctcttaagggctctacccttataacctaatcaccttccaaaggcctcacctctaaatatcatcacattcaggattagctttcaatgtattgatttggggttagggggtcataaacattcattctatagcatagatgcttaataaagtttgttgaatgaataaataaatgaaaatattatccgggcgaaaggtgtgggctggagttaaggatggctcatggtcaatgcctgcatataaatgtattcctcaagatgtgtggtctgaattgaggtggcctaagtcaagatatgtcaggagtatatgtagtcagtttccactttttaatatccatgataagcccttggtcacaagcatgaagccatctgaaatgaggagtgaagagtttccttttttcccctgtcattgcagcacggagtgaagaaaaactttatttttcttacttctccttgattcctcaatcaaactggatttatgttaggcttaggaagacaatccctactacacagagtgtttataggatcctgcttgtttcccaaagggagaattggggctgaaagtgtgcattaagcccagtctttaagcaattaatattgtgcccaagaaataaaaagcatgaacattacaagtggattttgtcgtaatcctacatatcccaaatgtgtatactccaggaaagtccagatccccaacagaagcccatctgctatatttctagtgtgacactcctctgtttatatttgctcatttctcttacagagtgccaggaaagaaaaagcgatatttaaaaaattcatctgctagtatttatgcaaacacatttctctccaagtgtgggttgagcaatgtgagtaaagcagacataaatgcctccgacagaccacagagcaattttcataaagaaaggggagaaatatacacctagaacaattgaagttggcggtggaggggtgggaactttcctctgaccagcaacactcaacaggggagacattctaggtctcatgccgcagacttggaggctcatttgaaccattaatgactctattgagtttctactatgtgctagccagtttggagattataaaagcttaagactcctcgttgagaacataatagtaaataattataagacagcatactactgacataggaaaaaggggaagaaacactgtgagcctcagttaggtgccactctttgctaagtgtttcacatatattatttcatttaattctcacaactatcctatgatgtaatcatcctcctttttcagacaaggctcacagtggccatacaacttgctcaagattatataacttaggctattttgaaaatccctgttctttctgctataccatacataagatgtttccatggtttataatcaaatgttatatatgtttggaatctaaatagctaacatttgttgagtgcttactatgagacaggcaaaagtcttttttatatacgttaacagatttaaactttgtaacaaccctaggaggtagatactgttattatgccattttaggatgaagaaactgagtttacatataagtaaagttgtccacatcacaaggaaataccagagcccagtttggatccagattccatatatttaagcattacactatcctgcctaccctttgaggagcacttttttttttgtcccacacgcttcaaaactgttgaggagcacttttaagcaccttctattacataccccggaccaaccatcccaagcctacattgagcaaccttcagtaaacacagtgtgaaagtagaaaaattcaaactgtgtttctcctctgctttcacaccacaacaatcatcgcagaagacttctgtgatgaacagaagtctgtgtgaccacagaagtcttctgtgaccaaatgtgtgtgggtctatcctcacacagcaagcaagcgagcagttctgcagtggataccagctgggctccctccaattctgttccaacactatctacctggcgatagcagtagaaaccacaggttgagggctcagtctcacaaagctgcccctacttcctaccagtcgcaagtctgggcctcagaacttccgaccaactgacttcaagttgggattcctacgatcctctctttgaagtccattgatttgctagagtggctcaaggaactcagagaaacacttacgtttaactggtatattataaaggatattaccaagcatacagatgatgaggtgtatagggtgaaaaaggggcacagagcttccatgccctctggacatgccactctctaggagcctccagatattcagctatccagaggctccctgaaccctattcttttgtgtttttatggaggcttcattacataggcatgattcattatttttatttattttatttgtctttttttgttgttgtttttttgagatggagtctggctctgtcacccaggctggagtgcagtggtgtaatctcggctcactgtaacctctgcctcccgggttcaagtgattctcctgcttcagcctcctgagtagctgggactacaggcgcatgccaccgcatccagctaattttttgtatttttagtagagatggagtttcaccgtgttagccaggatggtctccatctcctgacctcgtgatccacctgcctcagcctcccaaagtgctaggattacaggcgtgagccaccacgcctggccacatgattaattaaaacactggccattggtgatcaatttgagcttcggcccttctcttctccccagatgttgggggtgggctgaaagtctcaaccctctaattatgacttggtctttccagtgaccaggccccatcctgaagctaccaaggggctgtgagccactagccaattactaacacataaaaagacagcactttggagattctaagagttttaggagttgtatgtcaggaagaggggttgaagactgacatggtttggatgtttgtcccccccaagtctcatgttgaaatgtaatccccagtgttggaggtggggtctggtgggaggtgattggatcacgggggcggcagggggatccctcatgaatgactcagcaccattcccttggtgatgagtgaactctcactcagttagttctgcctcgtgagataaggtttttttttaaagtgtgcggcactgtccccttctctcttgctccctctcttgccatgtgatgcgctggcttcctcttcaccttccaagatgattgtaagcttcctgaggccctcaccagaagcagatgccggcaccatgctttgtgtatagcctgcagaaccacaagccaaaataaaacatctttttaaaaaagttactcagcctcaggtgtttatagcaacacaagaacagactaacacaaagaccaaatatgtgtttcacaatgtcacacacagtatttccattcctctctaaacccctcttctttcagctcacattgcagaggcctcgcctggcctaatgccttggccagtcaggactggtaatcacaacagcttgaaaaacaaactagatattctaccatctctagaagttcaagaaccaagtctctgatcttagagagtttcccttaagtgtaaatggatattcttctgcctgtgatagaggctagcaagcctcctcttccagccagtgctacaagaggtagggagtggccacacgccaggcagcaaggctgtttgtcttctcctagcctcccctctccagcgttctgcctgaagaatgaaatcaattagagagcatcaagagcaggagagctctttccccattccctttgaaattccttgttaggacactgctttgtagatggccccgcaccaccatgtttaagagggcagagcagtgtggggagggcaccaggggacctggtctgagaaccactggtgccatttacagagaagaaaccagaagaagcaaggaatctgaaagactcctttatcccaaagtcaaaaattaagcctaaagaaactgcttaaataattgtatcagactagttttaaaatctattgagctaaaattatttttttctctcttgctacccagcaggtgagggctcataagggagatcagggtgattaagagaaaaaagaaactatacattctttatgcatgtgagcggagtgagtaattttgcaaccctgtttacacatgaagggtaggcagatgtgagtttcagcagtcaaaatcagaagctgaggttgctgcatctggcttactcccctctccataacagcagaatgtgggatttccaggacctttcttgagggcctggtctctcctcagtgaggtccacatacttatatttagaccatgtaagaacgcattcattaacctcgatgacaatgttcagtgtgggtaaaccacctgcttctctttggtgaggccggtgatcaccgtgggatcttttgtatccaagaagttgaatttcagccactctctaatttcaaccacaccgattgtcctgggtgtccaggacaatgaccataccagagagtggtaacccactgctgagaaaggagatccttgtctatgatcacccctcactcctaacacaagaggaagatgccaaagaccagctgaggagaaggaaagggaggaataaagctatgtaatgactaaggaggactaagagattttactgaatagacttatctagcaggttaacgtgaatgggggtaaagggatttggtgctttctgtggctgaaggttgctattactctagaaatggaaaatgagaaaaatatctccttctccaagtagagaaacaaacactcaggaaaaaactcacccttcctgtctatgtaccatcttccctgatgacaggtagcagaaagtatagttgagaggtgcccaggtttgaaagttcaaatcccagttctgccatttctctcctgtgtaaccttggacaagtttcttagcctttttgtgcctttcatttgtaaaaaagagaaaataataataccttcctcatgggatcgctggagggttaaatgacacataaagcctaaagtacagctcctggcatgtgataagccctcaataaatatggctattattatttttataacaagggtaagaggaatatgatttcaaaggtccatctagtttaaggcatgtgtaaatttactgacaagtgattcagggtaaactttaattgaattttcaataaacaagccatagggtttcttcctccacagtctatgacccttcaccaggacctgcatcccacaccctggaaagaaatgtgttcattcagtgaattagatcctttagccaaacagcgtttgcaaacaactgcttggcatcctgaccctttctgtcactgagggtgttctaataaccatgttgggtaagaagacagtacccacctgtggtccctttcttcttgtaggttatgttcaggatcaagtcagtcttcatttgaaatcggcacttcagcaggataacaggaaagaaagaggattttggagtcaggaagctctggcttttaaattttggtctcatggtttcctaattgcaagagccaaatagttatctttaaaaatggggataataatatctacatagtaggggcttgtaatggaggattaaattaaactatttatatatagtgaccaatatagagttggcactcattaaatgtcagtttctcttcctctttccccttttcctgctgagacacagagttagactactctgtggggtgggacattcatcaggtggtgtgttggtttatttttctcccacttttctgaagcaagagatcatgaagatgatgggaggaaacaaacatctactgctctaaccttttcaacctagtgaacattgttcatccttctcttctgccacttaaaaaaataatcaaagtccagctgacacagagttatttagctactctggccatttttatcaacctagaaataagtatcctgtttatttctattaaaggtggatacaaataagacctcaggaaaatctaccccagtatctacacgttatgcccctttccaaagttgaagggatatacctaacacccaagggggcagggcaagtgaagtgtgtggtcaggcgtggccatggcactgtgatgcatcattatcaagggaggacatagtgtaagtcctgccagctctttccaatccaatcacctctccttatagtaattcacaatcacagagcccttcttcccctcttagattcccattcaagcacccaaccatcaaactcactgaggcttcaccctacttccccacctaccccattctcttcaactgccagagggctttcctgagatgaagcagaggctgagaacctggggcccttggacgagagacttagctactgacacatacaagtgctgacactggaaagtaccagtgctgaatcaaaaagccacttcccagagacgacatgaatgttcaaggtttggttcctggaacgccaccgatctggtcctgaaccttgaagccaacatcttacctctgtccttccatgcctcagttgcccagtatgtgggaagggtaatgacaacaaaggaaaattgccacctatcgcccaacctgtcatcactataatttgaatgacttggccaaccttagaatgctgtggaaattagtttactggggactctgagatgaaaggtgccaagtttggcagagctgaagccattggtaggatgttctggggtgcactgaagattcaacagaatgttcctttagcttgtaaattgaactttcatttttgtcaaagtagaaaattttaggtaacaaatatttcattttttcctttgtaaaatgttttcttctctcccttcccaagttcggggcatgaccagttgtgttggaatacgaaacccactcctcccagttaaaatgttcacaattgcagtttaaaaaatgacgaacatcttttagattatttttcataccatgcctactaagggggtactatctagcttttaaaaaaacttccttctctttttaacaaaacaaaaaaaatttgcaggattgcaactctgtgagatcctgcccaactttgaccctgaaagctgtctttgcctccagctacattttcagatgaccttcatttcagactcattttagaaatgtagacattttgctcctgggccacttactctttgcctctctgcttaaacttcaagagtataaaaggaaaagtttgcaaagatcatttacaatgtgccatcccaaacctctcatgtaagtgatgcaaagcaggctccagtgggccttggtgtctctgatgagaggagcaacgtgaatgcggaggaagtgggtaagtgagaagaggccctgaggctgcggtggtgactctaccagcaaagtcagcacctacagactgatgaaggcagcaaatgggcttgtgtagtgctccacagtgaagctgccctatctgtgagcatcaggagagctgacaagccaagtttctgcacactgtgcactgctaaatgctgtcagtgacacaggcatgctttaaagtcaggcgactgtttcttgcaggactaaagcctctgcctcactctcacctgctcaatgcttcccctcactgccatgctttgatccaaattcttcttgtgaggggactccccattacattctgcttttttctactttaacttaattcccagtggcaggatgtccacagttcagcttatacccttaaaatataaaaacaaaacaaaaaagtcatcattatcatcaaaataatttttaaaaacagttccccacccctgacaattttggcttggatttctttataatgctacagcttctacccacttcttaccttgtattttcatttatcttctttggtgcccttttccttgttcttccttttgggccaatctattgacagccaccctgcaaaatggcaaggaggtgaatttcctttcttataaattcatcctcaaaataattgcatgattaaaacagttgtgggccctctatcaagagtaatcagcaatgtgctttgaagcctggggtctgctgactctctgatggcacctgggaccatgtttatctccatttatatgattcggccaccactctgcctcactgggttccctgatgttagattgctttgaggtcttttgggagaggaagatctaccaccagagcttcaagttagtgtgacaattctccattgaactcagacaagagactgacatggtttcttgccaggcagcaattagtgactacaggactgaagtggtttccaagattcaggatttgcctagtagttgtaagaggtaacagccaacaggagaagaggagacccaaacccagactatgctgtgaagtgcagggcatgactggtattctaaggaaggtagtttccacatttttgtggcttgtgaatcactttggcaggataaaatttcccaagggccaatttacccgaccgattaccacttgccaatgcaaaaccaaataaacgtacatatgtttattgggaagaaaaccaaagctttggagaggacagggacaatgtctttggatccccagggcctaatggtctcaaaaaatattcactgaggtcatctgattcctctgagaggctaagcatacataattttccaatcattttggtcttcgtactatattcagagagtgaatctctgtgttaagtacaaccaggtgatggacaatgggtggactgaatttttcatttttatcaagcatggtatggaagaagcagcagtagcctgaccttctcaactgcttggaattcatggattaatttactgatgatttgttaaagatgtttctgtcttggtaggtgaagaaaggaggaactaaagtggtcacccaaaaagccagaaatccaaacactgttacaggccaaagtcttggcctaagaacaaagaaaattaggcaataggattgggctgtgccttgctgaagtcatgtcagcagtctcctgggccacagctttggcttgctcagatgcaatttgttcaggcagtgcagctgggggcagcagggcttcagctacaaaagtgttggctggtaagagaaaatcaaaataatccccattaagttcccattatcttaaaaatgagaaactctaatgagaggcttccagagcaagctgagcagcaggagggcacctctgatggatgctgtcctctgtaaggatgtcactgtcgtcaccaggggcaagctgagggcccaaatgcctctgcgcagtttccctggaagcagccaagattgattaggcaccccaggactcaggagccataagaaaagacagagaagcaggccagaagcaaggctggcatggaaggagacccttgacctgaagggtgatcatctttaaccctgaattctgttaactgtttctcagaaactctctctgaatctatttaacttttatagtcctggattcttttaggtgtggtgttgcctaaagacaggtaaaatgccccctaagggaattcctcacctctatggttctaaaactgggttctcgtcatatttcaggatgaggaacctttaaaaaaaaaatgccttcattctcagagcacgaagaaccttttataagaagaaggtagctggagaatgcttattctcctggcaaatagcaactgtggaaacactattttcatatagacctggcaaacagcttccagtattttctgtccaaatactacatctcctcaccagctttgcatgtatcttggcactgcacggcccagtagtaccacatcatttcatggcactgagccaagagtgtgcccagccgtgcttagcaccatacagggagtctgcagggccctccaagctcccaccaccacactcctactggagcagaaggggagattatcaggcagcaagtcacggtgttgttattattaccctgatgtgtaataaatctgtgtggtgcaataaattaaggcaaggctctgttctcactttacaggctgccgatagttttattgtaacagctcaaagatgtgagttttcctttttaggcagagtagaggaagctgtgaaatttgaagagagaacaaaagcatactcgaatgtagtttgtaaaacaggtattgtacaagaactggctcatcaggacatccagcacctaatgtttttctatttaatgatattagagaacagtgaggccttacaatggccacaagagttcatttgaattcattttcttttatttatttatttatttatttatttatttatttttattgattattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgattcagagagcacagggttgggggtaaggtcacagatcaacaggataagaatttttcttagtacagaacaaaatgaaaagtctcccatgtctacctctttctacacagacacggcaaccatccgatttctcaatctttcccccacctttccccactttctattccacaaaaccgccattgtcatcatggcccgttctcaatgagctgttgggtacacctcccagacggggcggctggccgggcagaggggctcctcacttcccagtaggggcggctgggcagaggcgcccctcacctcccggacagggtggctggccgggcggggggctgaccccgccacgtccctcccggacggggcggctggccgggcggcgggctgacccccccacctccctcccggacggggcggctggccgggcagaggggctcctcacttcccagtaggggcggctgggcagaggcgcccctcacctcccggacggggcggctggccgggcggggggctgacccccccacctccctcccggacggggcggctggccgggcggggcctgaccccccccacctccctcccggacggggcggctggccgggcagaggggctcctcacttcccagtagaggcggcagggcagaggcgcccctcacctcccggacggggcagctggccgggcgggggggctgacccccacctccctcccggacggggcggctggcctggcgggggctgacccccacctccctcccggacggggtggttgctgggcggagacgctcctcacttcccagacggggtgactgccgggcggaggggctcctcacttttcagacggggcggctgcgaggcggagggtctcctcacttctcagacggggcggccgggcagagacgctcctcacctcccagacggggtcgcggccgggtagaggcgctcctcacatcccaggcggggcggcggggcagaggctctccccacatctcagacgatgggcggccgggcagagacgctcctcacttcctagatgggatggcgaccgggaagaggcgctcgtcacttcctagatgggatggcggccgggcagagacgctcctcactttccagactgggcagccaggcagaggggctcctcacgtcccaggcgatgggcggccaggcagagacgctcctcacttcccagacggggtggcggccgggcagaggctgcaatctcggcacttagggaggccaaggcaggcggctgggaggtggaggttgtagccagccgagatcacgccactgcactccagcctgggcaccattgagcactgagtgaaccagactccgtctgcaatccccgcaccccgggaggccgaggctggcggatcactcgcggctaggagctggagaccagcccggccaacacagcgaaaccccgtctccaccaaaaaaatacgaaaagcagtgaggcgtggcgtcgcgcgcctgcaattgcaggcactccgcaggctgaggcaggagaaccaggcagggaggctgcagtgagccgagatggcagcagtacagtccagcttcggctcggcatcgggagagggagagggagagggagtgaattcattttcatatcaatgtctcactgctgagttctgctgagctgacctcttgcactagacttacagtgctttcttttggtgataaacctgagcgattttaagatcacaaattggttctggaactcattaaagtcagcaaatgagcattaaaagatacttgcacaggctgagtttgtgctaatctgtctatttaggcaattacagctcagaggatgaacagaggggcggtgagaaagaaccctccaactcccagcaagatgatccatttcagatgtctgtcaacgatgcacatgccctggcttttcttcctttacaccttgaaccctgggtgcaggaggcaagggaaggatttgagaatgcttcacctctaccctttgccaggttcaaagcccaagtgagaccttcaatcaggtccctggcacacctgacacttcattattattattttttttaatcaaaagcccacttctttggtagcaaatgctatttctattctctgttttagaacttgacccttacttttttttacttaaatgttagtcattcaagatttcttaaccctttggttacagagtcttccatctttttcttctgtcttcatctaggctcataggttatttctccctaaactagacacactgggtgctggtgctccgctctgtgtcattgtggcccctgaacaatgggaggctattgagcacagagttgatattcaatatgtaaatattgattgacttttttttgttttttgagatggagtcttgctctgttgccaaggctggagtgcagtggcatgctctcggctcactgcaacctccgcctcctgagttcaagtgattctcctgcctcagcctcctgagtagctgggattacaggcacgcaccaccatacccggctaatttttgtatttttagtagagatgggtttcaccttgttggccaggctgggtttcaccatgttggccaggctggtctcaaaatcctgacctcatgtgatcctcctaaagtgctgggatcacaggcatgagccaccacatctggcctgattgactttcaaaattgccttctagtttattctgtaaccaccagctctactaatttagtttaacatcattcacgtactgctctgaaaaactatacgccccttatgaccttacagccaaaaatgattgactcccttggtaatcctccttgcaaaaccctaagactcaccccctcactcttccttagaaaaatactatattcctttgcttgagtctcatttattagcagcaaatgctaacacaggaaacttcattctctgagtttacatattcttgtgaattctatttttctctcttatttttcccctaatacagtctacccctggccaatctataacaatcctaatcagtagaaactctggaaaaactgaggtcataatttctgaatctggtttgaatttggaatttgctccctcagctcaaaattaatattgtaaatttactgcaaatgtgttttctacttttcggactcagctagtagttttatacacaaagtttgctatctggcttaactagttactgaaagaaaaaggacatctccagctccttttctggcctttctcctattccactacttccctccacccaacacacacacacacacacacacacacacacacacacacacacacacacccaacaccagtcactgaagatggggaagatggagttcttccttgaattccccttaggttgtatcattgtttggaagttattggttcttatccaaaagcagacgtggacagagtaaggagttttagctcagccatataaagtagcataagccccaggctttaatcttcctgtaaggctgcactggtatatagtcgttcttctactgaatataacagatccatattaacaagcatttattgagtgcttactttgaaaaccagtactctattgtccctcatattatctcatttaatttaattgttgctctttaaggtagtattcccattttataaatgcgaaagcaaatattcagaaagtgacttgtactgaatggaagaaacatattttttttttattccaagcccattgccctttcttcttgtttgatttttaactttgtgataatagagctctattacaagaactggaactgtctgtacagttggttattcttaaatgatctacacagagtgcagaagtcctattacgacaaatcctattacaacaaatccactgtaacaaaacctctttctaagaaaatcccattctagagctgtcattggctcctaacttttatctagtaaacattcaaggaatattttgtaaaagtttgcccaaatttctcactggaaattttgtgcttaggatggcttcaaaattgggttcaagtatcaggcactaagggaaggaacaggaaacctgatgatattgtacaatgtttggtgtgtattcctttataccataaatagtgagtctaaaagttgtgttagctcagtttgttgtaaagtgacagtaccatggaaatagaagggaataaaaagctccacttcagatttttttaaagttacttgaatcataatgtcaatttaaaaaaagtaatttgcttaatgaataacggtttatctttcctataaaaatagctaatagtttttgagcacttatgctgtatcagttaacattgtaaatttttaaatgtattatttaaccttcacaacaaccctgtgaagtaaatgttatcctaattttacgcacaagggaactgaagctcagaacggttaaataatttgcccaaggttacacacacagctggtaagaagcaggatcagaatttgaactcacgctgtgtgactccagagcctacatgtttaaccacacttagggttgccagataaaatatagttacactggatttttgggtaaacaaatcctaaatatttcatggaacatatttttactaaaagcacattttttgtttatctaaattcaaattcaactggggatcctctatttttatttgctaaatctagcaaccctaaccacactattctgccttctgtaaattcagatatccatatatttgggttgtttaatttgcagtttacacgtgcttgagttttttttttttttttacagaataaatgatgttaattcacatctacaaaactaggcttctggatttctctttccctccatttattgaagggcgggttggtctgatgccagtcttctccctgatagtgaagctaagtgcaagcttttctcttctgataaaaaaagacttcacttactgttggcacattctggccttctgcctacactgggctctctctccagtggccagctgtgtcttgcctggtgctcatcattatccaacttccttgcctcaggaatccttgactctttccaagatttgcagaggtgcatggctaagtagcagcttccttccagacaacagtgttcacagaaggaaagagaaaagaatcagtgggctagaacttagaagaactttatatataaagtctgttgaataaaacatataaataggcaatatatacaccaccaaatgaacaactcttgtttctccatgggtatcttccactctgatttagctctctcacaatgcacaatatgcacctgcctgtataccttctttcaccactcggatcacctaagctgaaaatatagaaactgttttcaatggccatcaagaaaccaactgtattgccgctcaaatcacacaatgcattaaaaaacaaatataaaagcctttggagttggctgatctttatcatcttttaacaatgtgaataaccgaaaagtaattgtctatttacaaacctggatgtttatagaattacctctatagtcaagatcttttaaatatttcaaacagcctgaatttctataacccaagaatagaataatagtaatagatatatttattataacataaaaataacattttgtcagtatgtgccagtctctatgaagagtattgtccatgcattctctctcttagtttttaccaaagtactacaaaattttgtactctttttagtatcagatgacagacaagaacactgaggctacaagaggttaagtaatttgtccaaggctgaacagctagtggcaaaagctgcatttaaagctatgtagcctcattccagggatcatatacttaattactgcataacaatacctctacatcataagatcagtggtagatagcgcttttttggtgaaaacgtagggttttttttttttttaagttttaaatctgttgcaagctctttttctttttctttttctttttttttgagacggagtcttgctctgtcacccaggctggagtgcagtggcactatctcggcccactgcaagctccgcctcccaggttcacgccattctcctgcctcagcctcccgagtagctgggactacaggcgcccgccaccatgcccggctaatgttttgtatttttagtagagacggggtttcaccgtgttagctaggatggtctcgatctcctgacctcgtgatcctcccaccttggcctcccaaagtgctgggattacaggcgttagccaccacgcccggccagctctttcatttcaaaggcatgaagtgttctctttgttaaatagtaaagaacatctaggaagaggagaagttgggcagtaagtggccaacatgataggattaaatgaaacgctatgtgactagtacatagcttatacctcatgtaaccaaccataagacttggacaacacctggactggtccatgccctgattcacctagacgaggccactaatcacttgcttggatatcacagcaatgttaagttgccagaaaggattctaaatgcttactctcactttctttacttatctcaaggtcaactggtcattttgtggaccagcatcaacaatctatggaccacattttgagtggcactaatatagataacatcggtttagttaattcaagtatacaaataaccagtgaagtatatggctcgcttatattctctctctctacgaaacacacagacacatgctcctgaatatttattcccgaaacatttactaagaacctactatattcttgttacttttctaggctctgagaatatagtaatgaataaagcaaatcaagtacctgctttcagggaacttaaaattctaattcaaccaatgtcttaatacccaaacatctgggtaccagtttgaggccttgctaattaatagctctccgcttttgtataaattcatttaatccttctaagcaagtctttctctttacaaaatgagactaataatacgtactttaatgtcatcattggtagcattagatattgtgaaaactgtaaaatcacataccaatgccaggtcacatttttatcatgggcccttcctgagtgaagggatggtatttttcctgcctttgtatccttagcaggaagcataagggcttgctaagtggcaagcttaaaaatatattttctaaacatttattagatggaagcttctttttattgatatgtatcacaatcttcttaaagtcttcaattggtcctagaagtgtctatgcttttcctgtcagttctaagaataatggtgttctttagcattacaacctagaactgaattgtaaaagtgccctaagtttggggaggaagaaattctcagccaataataacatgaaaagaaatgtacctagtctgtttctcttcaaacgtctgaacttcatgttagaaaagttgcttccagggtataaagactttctttttgagggctagtgatgttactgttagagttagacaggggtatggatgctctacagatttcatgaaagtgcataactacattcagtggctatttgaagagtaccttattttataaggtgccccttatactgcaagggacattagcataattaaaacacagtgacttgcaaggaataatatttagtaatgagaataaaatgaatacacaaaatgcactataaagcagcatataagtgccataggtgtggaatgaataggaactatgggacttcagaggagggctccacttaggagttgcaatatgagacaggccttcaaggatttcaacagattttaggtttgatagagggaatggaaggcatttgttgcaggcagagaggtaacttaatacgttgactcctttgtaaaaagttagtaggagttacagcaagtagtttgatatacatgtaagggtatagtgaaaggtaaggctagaaaagtgggatggagatacacaattgggcaagtgccagattgagcagtttgtactaaatttgatggggaactactgatagtttttaaaatagggtggagtcatgatctggacaatgcttcaggaagatggttttggcaagaacacaagacggactgaagggaaggcaaccaagcaggagaccaaacaggagatcacagcaaaagtctcgacctaggttaaccaatacctgacctagggtcgtggcaatagagctagagaggtgggggcagctggaagggccattgtgtagaaagtatagtatttatacctgtgcagtccaatatagcagctcctaattaaggctctttaaatgcaactttaattaaaattaaataggatttaaaattcaggccaggcgtggtggctcacgcctgtaatcccagcactttgggaggctgaggcaggcagatcatgaggtcaggagattgagaccatcctggccaacatggtgaaaccccgcctctactaaaaataaaaaaattagctggccgtggtggcctgtgcctgtagtcccagctactcgggaggctgaagcaggagaatcgcttgaacctgggaggtggaggttgcagtgagccaagaccgtgccactgcactccagcctggtgacagagtgagactctgtctcaaaaaaaaaaaaaaaaaaaaaatttacttcctcagttgcattagctgcatttaaagtgctcaatagccatatgtaactcctgttttggactatgcagataaagaacatttccatcacagtgcaatgtttattgaacagtgcagctcactatgctttagggactaattaggcatagaatgaggaagatggattaaaggaggcttcggtttggcagctgagtgactgagaaaggtagtgccatgaacagaaaagaggaagtcaggaagaggaggagctggatttaggaagaaaggtgtttagtttctgtcaaatactaggccagataaagtgtctacccaaatcatcagatatccctggtgaaaggaaagggcagggaaagcaaagtgcccattgggttctcccaaagcttgtaaaggagccctgggaggatttaattggtttatctcctcctgcactcagtttctcctgtttgtgcagctccctgaagattatgagtgggcaatccagttcctcaacctctccaaaccaatggttcacatataccgtgatgaggacagaagcccaagggctttgctgtttccttagctccttggagccagcttgaacctttttctcacagatgctttgtgcttcctgtcccctaaccgccttactcacccttccccatgctcaacttttggaaagtccccttggcctcacttgtttgattacttcctctcaaactacttctcacagggaccacagcaaaccattgactctaccactttttacttgccctgtcttccctcccagcttaaattccaaggtctatcactataatcactcccttacataatactcctacccctctcataggctttccccagcaaaactcagacctggtcaaatacaattctcctccaacccccaagcaatggagtgtggctggaggagaatcacacggccttgctgagtggtctcactttaatgtatgatcatcaactcaagagggccctcagcactgtccatgctaagcttctctagtcacttttccactcttcaaggagattatttctcaccttcttctatctcctttaatagccaacagcttttcattgcatagagaacagatcttacctcatcaatcccagtgaggcagccagtacatatggcactcagtggaaactgggaaaaggtccatacgtgtgtgtgtgggtatgcatgtgtgtgtatgcgcatgtgtgtgtgtttgcgcatgtgtgtgtgttatatgcaggatgctaacatgcaccacctctcctggtggagcaatcagaaaagtaccccttcctccaggctgatgtgaccccaccagggcacgtggctttgtgggcaaaacaagggctacatttcagctcctacctgccgcctctgctctacaggggcctgagcgtgccacaaccaaatgtactgtctaatctatctgcttctgcacccagacactctaccttctctccagaaacagtgtgtgaatgcattcccttactcctatcctaggccaaccctttcacttctgtgctagatccaattgcttctcacctatttgaggacactctttctccagttgtctcctcttgccttctgtgtcatcaattttacctctcttacagagtctcgctctgttgcccaggctggagtgcagtggcgcgatctcggctcactgcaagttccgccttccaggttcatgccattctcctgcctcagcctcctgagtagctgggactacaggcgcctgccaccacgcctggctaattttttttgtatttttagtagagatggggtttcaccgtgttagccaggatggtctcgatctcctgacctcgtgatccacccgccttggcctcccaaagtgctgggattacaggtgtgagccaccacgcctggcccaattttacctctctaaagaatcattccagctgggcgcagtggctcacacctgtaatcccaacactttgggaggccgaggcgggtggatcacctgaggttgggaattcgagaccagcctggccaacgtggagaaaccccgtctctaataaaaacacaaaattagccaggtgtggtggcacatgactgtaatcccagctgctttggaggctgagacaggagaatcgctcgaaccagggagttggaggttgcagtgagcggagatcacaccactgcactccagcctagcaacagagcaagactccgcctcaaaaaaaaaaaaatcattccagcatactaaaatgagaaaaagcatttctcatcttaaaatatcctcccttgatctcaagtacctctctggctactgcccttttctccttcaaagcaaagcctctcaagagctgtttagaacactttctcttcctcacctcccatcctattaacataccctaatcagactttctcccctatgactccactgaaactgttttcatcaaggtcatcagcaacttcatcaggccacatccagtgttcaaattctcagtccttatcttactaatttcagcagtatctgataagactcttcactctctccttcctgaaacaattatcttgttttccaacgcttcaccttctcttggtgtttctcctgccctgactggtagcgcctccttttctacttaaccttcaagtgttggagtgcctcttggtcctttccttcagctatctcccctccccatgtgatcctaactagacttaagacttaaaaagtatctatttgctaatgaatcccaaatgtatctctctagactcatatatcgattgtttattcaatatctccatttggatgtataacagacaccttaaacataacatgtgtaagaaaagactcttgatttccccatccccaaatctgctcctccatttcattaagtggcaccgccattaactcagtcatcaggcccgaacctaagaatcaactcttgatttctttttgttctttcacacactatgccccaaatccaaatccattccaatcaaaatgtatctaaataaaataaaataaaataaaatagccttcttctcatcctgtccgtggctgccaggctagttagtccaagctaccttactggtatcccaaggacatctgtgcttctccattgtgtattttacacacatcagcaagactaacttttaacaacatgaatcagatgcggtcattcctcggctcacccttctctcatggtttcccgttcctgttataatggcccacaggcttcactggatctggccaagcctagctggtactgctctcgggctggctgacgctgctcagccatgccggcctttcactgtttctgcaacatggcaggcgtatccccacctctgggtttatggctgattttctctcagcttggaaaggctattcctcctccaggcccgcgtgtttgcaagacttattccttcatcccgtgtgtatgcgctcaaaggtcttctttgagaggcagtatctcaccaggtgtaaagtcaccctatcctctgctttatttttctccacaccacttatcactacctgcaatttttgtcacttgtttgttgtctgtctcccctctctcactccaccagcatgcaagctgcaagagggtctttgcctgtctatgactttaaacctctgcgcttagttagaacagcgcctggaacctaacaggtgctcaattagggcttgtcgaatgattgagttccctccaaattctcttcttgaatctttggacccttcctcatcttttttccggtcttacccacctcccatcccgccctacgcaaagctaaaactccccgccccttcccggtagctccaggctttcccggctccagtgtgcgcggctcctttaagcggactccggaacgccgtggggaaggcggggccgaagcccagccatcgccaacttggaggggcggggcagaaccagggggcggggcctgcgtggtgcgtgcgtgcgcgttctggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccgggggggtgagtaaggggcggggagctccagacggccccagagggagcggggggcgcgggtcggccgagccgagggtgaggcggctcatgtcgccggtcagtcgcctggctcccccttcctcctccgcgttccatcggtgtcggggcggcggcccgggggcctggccggcgggaggggccggagatctgggaggcccggccgccgccagggccagagccaaccacgcccgcggaccgacccggtcgactgtaggcctgcgggagaccgtcgggaggggccccggccggctgtgggagagaaagaggacattgtgtcccccacccttcagctccccgaggtgtcatagcacaagcccatttccctcgccgtctccccagacacggtgccctcgtacctcactgcctgagagaagtagaaggttggacatcgctgccttcctcctcttgcatgtcccctgtctagggtcagagcttccttcaaacccagctctcccttttgggcccgcgggggcgggggggagggacacacggggaacggggttggagggttgggtgaattctctgtcctctgctgtaggagtgcgggtagactggagcattgctgtctccgggctcacttctgtcagggttcagggtctccctttccttcctttattcccccagttaatagggctgacatctacatcccactccaccttccagcccctttcccgccttctttaccctcatgtcttccgtagcttaccatgtgttcgccttttcagtgttacttttcatgggtctctgcttcttccctgaattttgttagggaagaggtcacggtgtgattcttgttatccttcaaactagcggcttggtaagagtatctcttgcccccttaatcaggaagttaaggacggtgtcttcagccgagttgtgtaatttactgctacggggagaagatgagaggaagacatttgtgcctacaaaatgggatctcctcttagggctgagaaccagagtttagggaacctttgacctcttggaaaaagaactgccattgaggagtaatgcattctgttttgggagggaaaatcattttgttacttctttgaagggaggaggtataagaaatgaaatagaataatagagcagaaggtcaatgagccacagccctacaggtagccagccactcttcttaggtggcggatgatgtttttgttttgattacagtaagaataaagtatcagctcttagatttaacttggggctcctaccttcaaaagcatgaagggccgtctcagaagagatgctgctggaaacaggatttggaaactttctttgggtttcctgtcagaatgtgtgggggtggacatgcctatgtgtagtttttctttccttgtgatgtaatttatttctgtgatactttgacataataagcattaaattaggccccagactttctgtctttattatgctttcctataacattgttgttttgaaatcatatagttcgatattcttttgtagcgtgatatttcagtgaatcctgtctagttttcttggtgttttaaattatggcctacttcagatacgattagctgttaggtattgaggatcatacgtgttaagtatttgttgaatgaattgaatgattacaaagatgagtctagttattaaatcttctgtccttttgagaggtaccctatattaggatactgcagtccatttccagtttgtaagatagtaattcttaaccttttctaggccactgacacctttgagaatatgatgaaatatataaactctctccccagaataaagttaataggcatttattcacaaaattttgcattagttttagggaccctctgaggccaaccatgaacttatgtcttagaagtgaactggatggaatccctcagtgttacacagttccatattaaaacagctcaaaagcctttgttcactttttgtatggcttcaagaaggacagtatctacacttaatataccccagaagacaggtatattcatatacgttgttcctgtagtccttctgaaaatgaatcccaaggaaatattccaaaagaaagaaaatgttgtatatgcacatgttcatttaattattttaatagatgggaagaaaaggaaactacttgcccaacagcagaaagatacacaattttgcaatcactgaaaaaggttagaagtgaagattattaatctcctaattgatcttccagcttccactcttgcccctccaccccaagttgatttccacacagcagctacaatgatgctcacaaacttcagaacaagtctctcttctattcaaaaccctccagtgttttcccatctcattcacagtagaatccaaagttcttaccatggcctacaagccttacagctgcccagctatttccctaatctcaagcccctttacttttcctcttgcttactgtactccagccacactggcctcctacatcccaaaaaggtcaaatacactgaggtgtctgcacttaatgtcctctctgcctgtaacctttttccccaaggcagtatatatccctcacttcttcaggtctctgcaccagtctcaggtcttcccttactacccttccctgccactgtttctatcctctcaccctaccttatactcttaagactaggttatactgattttgacagccacagttgttgacaaacattccatggtaatgtcgcttgtatacttgcattggacattattgtttaacatttaaaaaataatgtcagtcataaaaagataactttcagattgttaagttgaatttttcaatagctcacatttaaattttggatgttagcttacctctcttcaacatttaactacaggatgctaattgttggatacagagatgaattagacagggtctctgccctcagggagtttcacagtctgtcattgtttgtattgtaatagttaagttactccagatcttgccagtgtttagttttacccatgaactttagtgtatggttgatgatattttatataaaatagggattagacatccagattttcatgttggtaattgttttttttccttacaaagggatatgtttaaaaattaaattttttttgagacggagtcttgctctgtcatccagcctggtgtgcagtggtgcaatcttggctcactgcaacctctgcctcctgggttcaagcgattctcctgtctcagcctccccagtagctgggataacaggtacccaccaccacgcccagataattttttttttttttaatcgttagtagagacgaggtttccccatgttggccaggctgatctcaaactcctgacctcaagtgatccagccaccttggcctccaaaagtgttgggattacaggtgtgagctactgtggctggcaacaaaggaatttttaatggtatctgtaatttgtttaatttctgttttgtatgatgcttttagaatattatagctgtgaccgccccatgttttgttctttgagacagagtcttgctctgtcacccaggctggagtacagtgatgtgatcttggctcactgcaacctctgcctccgaggttcaagggattctcctgccttagcctcctgagtaactgggattacaggcacgtgccaccacacccggctaatttttgtatttttttttagtagagagagagtttcaccatgttggtcaggctggtcttgaactcctgacctcatgatccgcccgcctcagcctcccagaatgctggactcctgcggctgagactattgtttttgttaaataggtcaacattgaaattttatttggtttataggggatgacgacaccagccagttttgatagaaaactataccactgtgagggctttgcccagaatttctggttctggaacctagatggcttgatttggcataggtggggagctttgacatctacacaagggagtgggttgaatcacttgagttacttgaaagcaccttgctctgtttctgacatgtgatagggacaccgtaaatgttcattgaacctcagatcacttctaatctcgtgattctaaaattctcttattttagttggtcaatgaaaataactaatgtaaagcatttatattttaatattggaatacatttgaaattgtgaatgtaagtttactcgtttataatgtcccttttcaaattaattggttataacaattaattgattacatctaatcatttgtaagaagagttacggcctatttccaagaattttttgcttattctgatgtcatataattgctgcattacttaatgccagattcatatcttatgaaaaagattagcattaaacaaaaatatttaagctttagtatgttactgagacagatgaagtgtccattttttcttttattgtgtgcatgaagtatggggattacaagcagtagtttttatgtgctttttagtttttcatatacaaagataatgttaatattagctcatttacattttgaaacttttgtaatagtggtatagatttgcactgcataattcacattctctcagtctcctgcacacagttgtgagatgactggttaagagggcactttgtttcaaagttaaatgatccagatgagtattgaacctataagcttagctttgttcattatcatgaggttctgatcaacaaagcagttcaacagagaaccatgccatgctgtcatttctgcttgaaaataagccttttagaggtagaaggtacaaacatgcatatacacatgcaccaataaaaaaaggaaattgtgtatggttattaaggtagagttgaaacaggaaataacgtgcgtttataagtggtttaaaaataattcttttaataaaattttcagaaatacttgatatacgcatggaaaattaaatgttttatgaaataaactccaatcagtagacaagttaatggcttttttaaaagcactaatgacttatttacttaggctatataaatttaggttagataaatctgaaaaaaaaattctttataaatcactcaaattttcccagtgtttcttacctctaacctatttagtttacactggtagagtggttcaaagtgttaaagttaaccaaatttaaaattaaatgtgtaatcatatgttttagtgtccgaatgtatttaaattaggccatatttcataagaatagcagtatattaaactaaaaaagctaataaaagatactattgggttaattaaaacttgaagtgccttaccttgaacacctaggtgtatacgcctataacatgttactccttcacggttttttgcagtgcagtgctgtacccacttattctggaggtaaaagataattttgttcatgataggactgtggttagctgtctttcgttttttaactgttttcttttttttttgttttgtttttgtctttagaaaagacaaaactataaaaagaggcacaaagaactgaatacaactatttggacatatcccaaatgcagtttatatgactctaagttagtagtggaaatctcttattgctgactatacatttcagatatgtcagatgtgtaatccagagagtaaattcactcactgtattttcagtgatattttaaaattcatttatcagtaggatcattctgttctagacaagttggctatattataaaacattaagcaagcaggcactaagttaaatattgtagcagttgaaatttaatgctaatcttacagttttacacagttaacaatctaggccaaatctattgatacctttggaactaccctttaaattccatcctatgcttgtgaaaaggttgcatataatttcttttcctttttctctcttctcttcctcttcttttttctttttctttttctatttcccttttcttcctttttctttcacagagtcttgctatatcacccacgctgttctccacctcctgggctcaagctatcctcccacttcagcctcctgagtagctgggactacaggcgtgtgccaccacagttaattcataatttcattaatagatttcagattcagtcattgaacagatgtttaagtaaccccaaattaggctctttgatggatactgagatgtgaaggtgtagtttctgcttaaaggaatttatagtctagcagtttattttgtttgccacagcctgtcatgtgttttataaatcagtgttgtattttcatgatagagtgaaaatagaatgatactcattttttaagtaaaataaattgtgaacatttcacattctcttagttggtgaacagctattttggtggtcttgttttctaacagcttatgagtattagaccaaatcagtttcccagttgtttaaaatagagttaaataagaattgtttgctttactgcctgttttacttcagtccaagacttattttttgtaaatagcttttctgcatatgtatacatacacacacacacacacacacacacacacacatatgcatgtatatacacacgttgtagggaagttgtttcctggttcagctagcaatttcaattctctgtttaacgtcagaagttgttttgtagaatgggatgttaatatttttttctacactgattaaaatcatcctttgccactaaagtcaagtatctgctaggacagaaatgtgcaaatagcatgcgtaaatgtgcatttttagtgactgttgttagcttgacagttttattttcaagatcctcttctctcccgacctaattaattatgatgtgtttataaggcaacaataatatatttagttagtttgcaaaatgagaacaatttttctggtttttccatttttgcatgttttgagtttggattaattggacttgtattattctcagtagacatatataataaaatagtccatttaactgtgattctttctcttggaacattggctgacttttagatagtgagccttgtgcagtttcataaatacaggtactactgagttttggatgacattctttacacaacctaaaagtaaaggtgagcataatagaagctggaaacaagctgctgggcataatagaagctggtaacaagtctgacgttttctttgcactaggaaatgtatttcttattccaagtaatatgcccttgttaggttcaggatctttttcagtggttataactgcttaaacatttttttttctgtttaaagtaattcatgttatactgtggcaaattttgaaaaaaatgttaagtgtaaagaataaattgaaaacatccatgatcctatcatccagaaaaaattactactgatactttaatatacatttttccagtttattccttgcatgtacggattttttatttattttttttacgaaacttagaattataactttatatatactgttttgatcatacttttttttcctgaatgggatgttggtctcctagtttgagactttaaagttgattctttataatattactgttttaaataacactgggacagacattttttgtacatgtatctttgattgcatctctgttttttttttcttcctgtaggatagattcccagaagtgggataactggatcagagggtgattaccctgtgtataagagtatgtgtctcactgcaccttcaatggcattgagtaggtcagtttttacaatctttgccaatgtgatagatatctgttacattcttgggtggtaatagcagaaatcctcatattattaataatctgtaaaaccatcatagtgtatgaaagaaatttgcaattgtcctgaaatgagtttctttaaaaatattttaggtaaaagtaatctgtgaccaaaaaaaaaattactgattaaagttggaatttcagcatttttttttttggagagctagaattttaatgttcttttattaaaatgacaaacatgagaaagcttgttttatagtatgtaataaatataaatattatgtaaaactaaattatttcagatagatgaggggggtagtcacatggttctgactttgaaaaaacaaaaaaaaaatctgtgaatgtttagagcagtagctctggagttgggcagcctgggtttgtgtccttgctttgccacttactaagtacatgattggaggcaacctgctaaatatgtgtatgatttgatttttctgaaccttggcttccttatttttataaaaggagaataatatctaccccataggattgttgagaggattagaataatgtgtaagaccacttggcacataggtatttaataaaaactagctattttcgttaaatttgttttttctgccagtctcctcaagggcaagaaatatctcatttttgtgtttctgtttacatgaataaatactgaaatgcaaatgggctgtggtgagcagtggcagcaggaggggaatggtggacattctttgtggtaggaatggcatgtgccaagatagaaagaaagttcaggagaagttggaggacaggtgattaatttgacagaagcctaggcttttgtatagttagaaaatatggagataagggagaattatggagattggggctagacttttaagccattgaatgctacgttgataagtgtagactttttcaggagtacaagctttggtatgtggaaaatgacttgataaaagcattcatcgaaaagcagatgaattcgcttgtagagtaaagaatgaattgaggaaggaagaggttgaagacagggaatctggattaatagtaacacaggtaaggtaagatctgagggtttaaaggaaaacaaaagggagggttttggaggaagtgcttaggcttcatgtttgtgaagatctgtacaaccaatttggagatcaaattcaaaagaaacagcctaggcttacatgcagttaggcagcctttgagagaagatgggactcagtacactttggttgttactattgtttttttaaaaattgaaggataaaacattccaagattcctatcatttcgtcagtaaaaagcatatatttatgcttttaaaaatatatatgtacaatctcctgcagtaattttatttagttagcattttgagttcttggttaacaggatatcctcgcttttagactttgtatttctggagctattaccttaaaactcttcactgtaaggtgaaattcttctgcatgtggtttttgtagcatttgtgattgctgcaggactttaaaaaaaccagtcgtgtgagcagaggtgatgagaagtgaaatacagacttcttgtttgttaagcagcttctaagtaaaatataggagcaaaaaaatgggaaattgtgtgtatgatgtttagaaaaacattacttttagtgttcctgttttctctctcagccctgaattttcctaattaaaaaaagagagtttgcagatgccatttttagtcattctagaacctgactagagctctactcatactttccacttgactgaataatataaagcaagttagccagagattgatattaatagtatttctttttgactgataagtaaactcacatgaactgtgaattgtctgctcggtatcttccaatggagaaaagaagcaaccaccaatttaaaaaaatacaggcttgtgatacttataaggtgtttgcattttttaaaacagtgagttatcatacctttcttaatgtttcttttagtttccaaatactgcctaaattcagaaataaagtacttattatttttattcaaatctcttccctttaaaactatccttgaaaatatttttaaattaataagcaaatgtaactcacagtgctcgtagtgttggggattgtgtgcgtgtgacttttttttacaaatactgtgtttttcctgtgtgaatctgcaaaagcccagatctggtcaactgaatgaaatttcatttgctaaagggatctcagatattcaaaacgatgatttaatgtctacaaactataagagtctcttttaaataggtttgaggatacttctgcctgtttgtccagcagaatctgaactacagtcattctctccccatcattcctactccttaaactatagctgagagaatagcatagtccttagtttgggccattctggcattgccactatgatggcctgttgtcttacatttttagaaacttgcttgcatcttgacagaaaaaataaattattaaattaagtagctagcagtttatgggatactgttataagatagttcatttaatttttacatgaggtgaaatacgaaatgtctgaaatgtgaatagacttttatatgcttctatcccaaaggattaaaataaaacaaaatgaagtgtactggttgaatagaatattatgtacatttttctttatcagaagattttttcatactccttttgaatcagcaattttgaatgctaaatataaattcttgactaagaaatcattccctacagtaataataaacagtttggttagtcgtccaacatgtatttattgagtgattattgagtgcttgatactattctaggaaccacagatttagcagtgaataagacgtgctttcatggcaatttttataccactgaagggttgatgatagtagagagacacagtagaaaaacaagtaaataagataatttcagaggtcccaaatgccatgaagaaactatagcaagatgaaatgatagagaatgatgaaagggttttaaattgagtgttgtggaaaagctcgctgagatggtgatatttaatgtggcacctgaattacaaaatgccagacatataacagtatataagaagaatgaaccaggcagagaaagggcccgttggtgcaaaggccctaaagtgggaagcagatcatcatgtttgaggaagaacaaaaagacccttgtcatcacaaggctaggaaaagcctggtagatgaggttgatagggaacagctcactggatatcattatttctctttatgggtaaatatatgcaacttgtgaatttgaagatggtgttactaataatactcatttaaatctgtagggtaaccagtagtttttctagacatacagaatcactaattcctggtccataaattatgtttttcccagggatctgcagagataggaaggaattatgattagtattacaaaaagtcaaatgaaaattgtgcatttaccctaaatagacttatacagataaaatattatgtatcttttctttgaccagtgattatattgactcaaatcattatcatacattgtagcgatttgcagattgttaaggaaataaaatattgtacttatcccttcaagatcctagcactgggttttgttagtttttaagtctttggcaatttgagaattttgattagcttttacttatgtgattaataagatgtcattgcagttggtagacaaagatctttaaacacgtgaaatccatggaatagaataaagtttttttatagaaaggttgggagccattgattaatgtcctatctgtaatggacctacagggagaagggaactcatatgtttttgagtgtagaccccttacatcctatttaatttgcacagtaaatctacaaagtagatattgttattgtccagtttttttacaggtgatgaaactcaaagtaattatgtaatttgtgaaaatttacacagctctaattatagagaatcacgtgggtagtaaacttccagaagaagggacttttgcaatacaaagcagaaaataggtgatcaatacatatttgtatcttgcttaaatgtaaacatgaatgaatgagtaaatgacaggagactgcctctgtccctatactgttttcagtgagtcacaccatttttctcctaaatgagtctagaaaatttcttcagaaataaagtgacttaacctgtctttttttccataaatcatacggtgaaaatcctgaggagagaaataaagaccaaacacttacaaagtataattttctcttgggctttgttaactgagtaatttgtagagtttttggctttaaaaaaaaaaagtctgctttgcaccatagtgttcattatcaataacatcttttggttctgtttatatcttaattttttttgtaaccatttaagaatttagtattctgaaatgaggtgatggaattacagtagtccaaatgtttatgtagccagtgttagttgtctgcctaatatctatcacagtctgtggggagtggggcagggttggtggcatgtgtttgtttctgtcttctattagaatatcaaagtgtgtgatttgttgctcagaaatatgaactcataattctgggtcatttaatggttagtaggataaatgagggcttttttttttttttaaactaatgcctacacccaggcagaataggagtatgaaatctctaaaccctgtgtttataaagtttctaatccttcaaattaattaatatcttaataaattctaagtttagtattcttttaaatgaatatcataggaatggatacctagaggatgaaagtaaatataagtaattgagaaattgaaagaaatcagagtaaggttgagaaaggaacgtaattatgatacagaatttaccataggggaataacacatggaagttgacgtgctagactgtggaaaaggaatttattttctcaaaaaagagaaatgaaattgatggaatgagggctaggaggaggtaaattatggttgaaggagtagaatactttggattagatattggagcctacggccaggtgtggtggctcatgcctgtaatcccagcactttgggaggtcgaggcgggcggatcacctgaggtcgggagtttgagatcaccctgaccaacatggagaaaccccgtcttcactaaaaaaaaaaatacaaaaaaactagctgggcgcggtggcgcatgcctgtaatcccagctactcaggaggctgaggcaggagaatcccttgaacctgggaggcagaggttgtggtgagccaggatggtgccattgcactgcagcctgggcaacaagagcaaaacttggtctcaaaaaaaaaaaaaaaaaaaaaaagatactgcagcctgcagggaccttcagagagaatatgattaatctgtcaccatttgtggcagtataattactacttcatgaggtatggtgtcttgttggtttgagttggaaggacaataaacctagatcgaatgaagagggttgttgtgaagaggtaacatattttaaaatttgtttctagttgtctgagacttggtatgacaggtctataaaagataactttatgtgatattttggttcttggtatcctcaaagtgttggtttttaatttttcctggtggatttctgtatgtcagctttagactgccctattgttgcatcctgctgttctccattctaatcatacagttgatttggtaatgacatacataacccctggcatgaagtttttatgcttcagaaaattgtttggcatataaagtgcaagtatcaatttgctctatagatgtgtatctataaaaactagtgtgattatttaaggatatcagattaacttaagaaaaaccataggcaagtgatttgggagggagaatcttataatcagacacacctttatttgcatgtttagattttcatatattaggttatttcggtagtgtttctttttcgttcaactggtaagaagcctgggactttagtatctcgaaattggtcaaatagtatatactcttaaaaagtttctgtgtcttttaaataccgagtttcacacctaggacaaacctcagttgtaaaacatccctttgaattttaaattactgtttaataacttctgactagtatttcactcaagtgttacaacttttacattggaatatgatagcattataattcaagaaccaaccaaaatctgcagtagaaaccatgggttggagggttttagatgatatactcatcctaatattcccattaggcttcagacgtggactgctgtcacaacagaacatacttgagatgtgtcaccactcagtgccatctgcctacatgggtacataagctatatagtaggccttaaatattggacataaagaatcattgctttgtggttttcttagctgactctgcttaacttctagtgttctgggctgagcctgtagtcaattttgatcttttgcatttataacaacactcccataaccacatgttcagtgtcctctgtgtgttggtataccaaagatggacatgtgaagttttttaatagtgcaaagaaattggctgtttaatcagtaaaatttaaaggtgattttaaaaacattcaaatatttgagagagtgccctttatatgaaggaccaactatctcttccctccctggttaattttcacaatataataaatattttttagttatataggccaaagtgttctatagaaaatcaatcataaaattgcatttgtctgtgctatttttaaaaagttctctattgttacattggtaaatgcagattaccagtgtttacatagtatgattttagtacttatttttaaaatatatatctattcatatgtagaatataggctaaaaggaaacaccaaaagacctagattattatctctgatgtatgggttatagatattttattatatgttatatattatatgtattattatatgtcatatattttatttcccttgttaagccttttatgaactttacatttatatatatatatgtatgtatgtatgtatttatttatttatttattttattcatttattttttcgagatggagtctcactctgttgccaggctggagtgcagtggtgtgatctcggctcactgcaacctccacctcctgggttcaagcgattcttctgcctcagcctcctgagtagctgggattacaggcacgcaccgccacgcccagctaatttttgtatttttagtagagacggggtttcaccatgttggccaggatggtctcgatctgctgacttcatgatctacccgcctcggcctcccaaagtgctagggttacaggcatgagccaccacgcctggcctgttcatatattttataatcaaactaaaagttctaaaatcaattcattatagagtatgaaattaaatttaataaagcttttaaagataaagattcttaggtgataaaatgagttaaaggctttacaaataataaataggatttctgaaatggaattttatgttatggtaaacatttttcctttaaaactaaaacagatgcaaaattaagttgccattttctgggcatggggatgggagaaataggaaagattttgtactgttgtaccttgccttggaaaccttttgattcttctaactcagatttgcttcagttacgtcatatgctgttttatggataagtgtttaattataggatttaaacttatttatataaatggtatgcaaaatcttgctttgaatatttggtcatttgtatttgtggtcagcaggcaaaacactttgcaaaagtttgcatgtagtgcctaccagtttttctcagttttctcatctgtcagtggagaaagaacaatatctatatcttgtttgaggattaaataagcatgcctgaggtacaagaagcacttaaaattattgctgctgttattaccccaaagttgggattgatgtttctttgttttctttgtgttttgttttgtttctgaaacagtgtctcactctgtcgcccagggtggagttcagtggctgcaatctctgctcactgcaacctctgcctgcagggttcaagcaattctcatgcctcagcctcccaggtagctggggttataggcttgtgccaccacacccagttaatctttttatttttagtagagatggagttttaccatgttgaccaggctggtcttgaactcctgacctctgacctcaggtgatccccccacctcagcctcccaaagtgttggaattacaggtgtgagccactgtgcctggccagcattgatgtttccatgaaactgaggtaaaagatccctagggactggaacaatatcttatgccatgtatcccctattttggtcaaccctgtgtattccccattaattaagtgggacggttagttcctcacttaggtagtttcattgtttatgtatacaataaatctttggcattcacgacttaatagtttagacctaaagtatttagcatgaaaaatttataatctggtataggcaaaattttgaattcaaggctgatgtgctgaacaagtctgttaactagagaattgaatatagctgacagtatcccagtttttattacccaacagtgacgtgacttttgttctctacttaattttcatcctagaattaaaaactgtttctttgtgaatttagtgcccggggaaagccagtagttaatactggtttttgcagatttagataaactcttgattttagacaacaaacactatggcaataaagtaagtttattttagtagcaattcaattcatgagtgttgcttatttcttttctgttcttcacaatgtcttgcgcccagtggagataatgaacaataaggtgtgtttggtagtttgtgaagaaaggtaaattttttttttttttttggagacggagtttcgttcttgttgcccaggctggagtgcaatgatgtgatctcggctcactgcaacctccacctcccaggttcaagggattttcctgcctcagccttctgagtagctgggattacaggcatgcgccaccactcccagctaattttgtatttttagtagagacagggtttctccatgttggtcaggctgagtctccccacctcaggtgatccacccgccttggcctcgcaaagtgctgggattacaggcatgagccactgctcccaaccaagaaatgtaaatctttgaattcattaaaggaaaggggtgagttgactgggaatttctagatttctaggctcttatattatttctattacttcagtacataattttttaaatctctcaggccaaattaaaatatatttcctgtctagatttcatatttccatggagtggtgtgatgatgtaagtgtgcttcatttaataaaagctactccggtatacctcataaccttgcagaaatactgattttatgggtctgtgatagggctagggtgctgtattttactcctgtgatcctcagatgattctgatgagatgctttttcaatttatttatctccatattttcattttagtgttatttttaaaaaatggtttgtattatatttttaaagccataggaataaagaagtacattttatagttaataatgaaaattaatgatatatcttagctttccatggttatgttttgttttactttttcaattagttaaatgtacatagattacttaagtcaaactcaagtaataccaagttcactgtagaaaaaaataaagtaccaattagacattatttctcagcctttttagatatttttctaattgtccccctcatgaaattttaatgccacagatataactgtatatttgtttatgtattgtatgtatatctgtgttttatgcactaaaagaataagaattatttttttgcccctcaagagccaattttcaccccattggtggtgatactgctcctgttgagaatgcatgcaataagccaaaagaaaaatcacctttaattttaccttacaacttgttaacattttggtgtacatctttctcagtgatgttcaatgcatatatgccttttctttgatgaaaatgaaatcagatacataatacttcatgctcctgtttttcttaatattttgtgaattttcatgataaatgagtatcttttaacagtaccccatctctaatggataaatactatagatgtatagtagtatgtgaatttgccatcatttgtttaaatgatttgtctatagttttcaattttttattataaaagttctactatgaatatcattatagttgaatttttccatgcatccttaattatttctgtaggataaattccaaaaagtagaattacttcattctgtacattttaatattttttggtgtatatgacttagaaagtgaaagtccatttccccaaggacagccaccatcaaaatcaatctttgtctagccttttcctgtatatatcctaacataaataactatatatattatttatataaaacctacatataaataattttatatagctgtttctgtctcttaaaaaagaaaaatatattgttccttaactacagcaagttgcttttttgcctaacgcattttgcctgagagattttagtcatcccatatcactatgtataattctacctcattcttgtaagctgtatgatacatagtaatttgtccattcttctacggaaggatcttttctttcccattttgttttgtttttgcgtatgtctttgttttttatttctgcagcataaattcccatttgtaatagaattctgggtcatttatgaattgaaagtactttatatgtgctggtctttttctgtgtttatttttctttctttctttcttttctgtttttgtttttgagacagaatcttaatcctacccccgggctagggtgctgtggcagggtcacggcttatccactcaggtgattcccccaccttagcctcctgagtagctgggactacaggcgcatgccaacatgcctggctaactttttgtattttttgtagagacagtgctttgctgtgttgcccagaatggtcttgaactcttgggctcaagccattcacccacctttgccccccaaagttctgggattataggtgtgagccaccgtaccctgtgttttctatttttttcattcctttatttgcctactctggtattggaccagatgttaattacttttgtatcaggaaatataacatgttctaataagtaggcagataagtcacagttgaattttggctaggtgttggtttttatcttttttttttttaagacaagtatatgtattttaagtagtctagaataatacagatttttgaggacttttaggtccaggcagtaattcagaactctaaaggcacatcaaagttgcatagtgaacaaacaagctattgagctgtgagctttctgggaatacttggaaccataacatttctgtcaaatatgccttttaatctttggtttattgattgaagtattttggactctttctgctatcaaggttttattctttttaaaggagatacactatcttttttacatttctggtaatgtgtttagtttaggtacatcatactgtgttgtttctgcttatttctgtagttctctacttataccttcagagttatacatagattttcctgaggtttattaatctaatatagctcaaaatatcagaatagatgttatagtaggtaacacttttctgaattagaatccgattttttaagagtctggtgttttggctggatttatgtaggtttctttatgagaaaacagtaaacattgcagaagaattacactttgctttttaaagtagaaatgtgtttagtttctaaaaatgctaatttttttctgagactattctttctttaaatgtagccactcacagcattgttaaaatttttaaatgttgattctgatactatatactattagtaactaatacattatgaacttttttttttttccttaggacatactgtcaggtgagattctcaaatggttttagtgttctggaagagttagtttacctttgtaatgaaaaatctctcatgagagtactgcactcaccgctaggatgaaaactaatcaaataaatataaaaaatggtagtcagtacccaggcatttcagacaggactgttgtctgacactagcctcccttggagttgaattgtcaccacagccaggttaagcttattacagaggtttaccttgctttggattgtgggtctgcgtctatcaaagtgaaaagccaactttttcccctcatggtagtggtatgctttttgcatggtgtgtttatgaaaattaacatcacaatggtgattttgtgtcgaggtttaccatttaactagattagagattgtattctttggtgcaaaatttaacctaaatgctttgtgaatgtacacaaaactgagtcctttatctcagaatcacagctgcaaacaaatgacaacccatgcttgagcattaactcattatcacttagacctttggccaagcctgtgattgcttagataaagccttaccctccacctttgcctacttctttgttttttgaagactgaagccatataaaaacttcaaattcatttaactgaatagtccatgtaaggaggatgtttaacttatttttaggacaatatttgattttaactaaatattatgtgagactattataagtgattataaaactatgtgatattttgtgttttataaaacttcaaatgttttcattttattatttctcattatttaaaacattttttcctcactaaatattgtgataaattagtatcagtaagactttaattaataatagccatctgatagcagggattctttaatagatttgttagagtatacatcttcacagtacataaaagttgagagatttttatgttttgtgtagtgacttaaaagtaagctgtttttcaggaaagtattaaataattgttactagctcttttttataattattttcctattcaaagtaataataaagtaatccttgaacatccttttagttaacacacgattttttaataattcactatttttgaccaggcatggtggctcccgcctgtaatcccagcactttggaaggccaaggtaggaggatagcttgagcccatgagtttgagaccagcctgagcaacatagtgagaccctgtctctacaaaaattaaaacaaaaaattagcagggtgtggtggtgcatacctataatcccagatactcagaaggctgaggtgggaggatcgcttgagcatgggaggttgaggctgcagtgagccatgattgtgccactacactccagcctaggtgacagtgagaccctgtctcaaaaaaaacaaaaaacaccactatttttgttaagtaatgtattttaaaaggaatacaagtaatgccctgaaaagtacagatcaagaaaagaatgcaaatgagacaaaaataatggttatcagtttgctgtgtatccttacagaagtttcctgtaaaaacatgcatatgtacatatatgcatatatagaaataattagttttctttttacaattccttttgtttttaagtcttcaggtgtagcaatgagacaagaagactagttctatattagcatgttagcaaataaaaattccattcttcagagataagttttgtcaagtttctctcatctttctgcttgctcctcccttcactcttattctgttcttaccactcttctccttgagaggagagaacgtatagtgtggtggattgcaacgctggcttggctatacattagatttaactgggagctttgagaaatatccacattctggctccaccttccagattcttaattaattggtcataatgatgcaggggatgtgggaggagaacgttctttatcttagcctgcatatggaagcttgcctcagcttcagagttcaaatatggtttgcgggaaagcaatggttgaatccaaggggccatcttcctcagtttctctatcttctagaaggaaggggtgtgtgcgtgtgtgtgtgtgtgcgcgcgcatgcacataggtctttgtaatcctttaaattctctaagaaatgtaccaccacagatttctaatttattctagtattggttcatccatagtgtttgtatactttaattctaaagaaaaataatatttgcatagtacagattagatagacaagaagatgactggtaaggcaatatagtattgtagttaaccacactgatgctagagccacagtgccagagttttaatcctggctccataatttatgtatgttgagcttggacaagttagttttagcctttttgcctcgtctataaaatggggacagtaggctgggcacagtggctcaaacctataatcccagcactttgggaggccaaggtgggcggatcacctgaggttggtagtttgagaccagcctaaccaacatgaagaaaccctgtctctactaaaaatacaacagttagccgggtgtggtggtgcatgcctgtaatcccagctacttgggaggttgaggcaggagaatcacgtgaacccgggaggcggaggttgcagtgagccgagatcaagccattgcactccagcctgggcaataagagggaaactccatctcaaaaaattaaattaaattaaattaaaataaagggacaataatccccaccccacagaaatgtgaggattaaaaatactagtagatgtaaagtgctcaaacagtattttatgcatggtaaatgtacaataaataacagttaattagtttattcctttcttgtagtctattttctaacatttcttacccctttcttgcttattcctcctgaagttaatgcgtcttctgataaactagagtaggtgttaactttttttttttttttgagacggtgtctcactgtctcccaggctagagttcagtggcactatcttagctcactgcaagctccgcttcctaggttcacgccattctcctgcgtcagcctcctgagtagctgggactacaggcgcctgccaccacgcgcggctagttttttgtatttttagcagagacagggtttcaccatgttagccaggatggtttcgatctcctgacctcgtgatccacccgccttggcctcccaaggagctgggattacaggcgtgagccgccgtgcccagcctttttttttttttttttgaggcaaagtctcgctgtgtcgcccaggctggagtgtagtgtgatcttggctcactcctgggttcaggtgattctcctgcctcagcctcccgggtagctgggactacaggtgtgcgccaccacacccggctaattttttgttattattagtagagatggggtttcaccgtgttggtcaggctggtctcaaactcctgatcttgtgatctgcccacctcagcctcccaaagtgctgggattacaggcgtgagccactgcgcccggccagctaattttttttgtaaggggccagatagtaagtactttaggattttggggccatatggtccctgttgcagatattcaactctgctgttatagggtgaaagccatttacataagcaaatgagagtgattgtgtctcctttatttatgaacactgaaggtgtccttaaatatagaaacagtccttagttcacaagccacgcaaaaacagacagtggcccagatttggcctgtggttcatagtgtgctggcccctgaagtaaggtaaacaaacctgcacattctgataactattttagacgtcttttctttcttggacattccttcatttttaaatttctctgtacattgggatactctagaaagttaattttttggcatcaagtttagaactttaaaattctactcacagctttgagcttaagctgtttattagcactatttgaaacagtgaaactttgtgaactctctcctcctcaaacaatgacatatataactgtatttagggttctttggttgcaagcaacagaaccatcatggttcattggagattttattctttggtacagaatttaacttaaatgccttgtggatgtacatgaaactgagtcctttatttcagagtcatagcagcaagcaaatgacaatccgtgcttatcatcagcactggtgtgtagtaggtcttctctcagagaactgggcagatacctacagaacctataagaccatacacacattcacataccatacacacacatgcatacattatgtaaataaagatacttatttcaaggaattggcttatgtgattgtgggggctggaaagtccaaaatctatatggcaggccaacacattgcagattctgtagctgaagctgataatgcagtctttcagtagaatttcttcttcagcgaaacctgagttttgctcttaaggcttttcaactgattggatgaggcctactcacattattgacgataatctccttaaagtcagctgattgtggatgttaaccacatttagataataccttcatggcaacacttccatctgtttgaataactgggtactatagtctagccaagttgacatgtccaactaaccgttacatggttcaatatatatttgtccaataaaaggaagaacaaatggctaaaatggttaatttaagcagaaaaatgtttatttggaggatgttgaataacagaatttaagtaaaaagtgagcacttaggcctcaagaagtcccaagaagaaccagagcagtttgcaggggtagggacctaggtaatagtaaggaacaatgccttcagtgtaccacagtcataaaaaatcagctctagccattttgcttcctcacatcactctaagattcagcttcccgggaaactcagcctgattggtgtaggctgagtttaggtcacatgtctcccttgcccagtgaaaggtgggtacaccttgattgacattctcaccacaactgcattcaggaagacaaggattgtttcccaataaagtgtcacaaggctgttaccaaaagaaggaggaatactagacatgcacaaataaaagatatccacttcgccaactcttgatatctcacatagatggtcagctggtaaaactaacatggatcagagccagattatgtagaatgttacaaggcctgataatgagcttgggccttattctctagaataatgaaactttttttggggaagggggagggtcatagatctctttgaaattttgaaattttggggccacatattgggccctcttctctcctagaagattatgcttatgctttaaaaaagatttgtttttgttttgttttgtataacatttcaagagtttgttttacctcttgaagtatatccatagttggtgggaaaaggagctagtctcaacctgaaaaacaatcagaatattatatctctctcagcttctgatatttgcactgctgattctccttaatctctttgatttctcttggaggaatttggttaagagatgatgagggtcttattaacacagtgtggaaatagggataaaaataatttgcaatttaaagaattatttaggaaacaatatgcagaactagctcgactgttgattatatatggggagtacagtcaagtatgacttataggtttttagcttgtaggaattgcaggggaaatatatagggcaggtagaaaggttgaccttaaatgtgagaagggacagcctcatcctttgagtgggactttaggaaaaaagatcatagtaactggacttaagtttatcaagaaggaaggtaatgagagaggaagtggagtagagattggtaaaaggattgatgtgcagtactgagggtccaggtgagatttcagaccaggaatttgaagtagtgacatcagttatataataatattttctccaccaatgaagagaaagtttaagattcactaacagttgatgtgtactggctgatttgcgggtgaaacaacaggaatacatggaatagaggaatctgagcaaagactaactcaaagatggtggtgtataacttatagaactcccattctgtgttgggcgcataaatgatctttgtagataccatttcatttactcaaataaccctgcgagccaggcactgttatccctgtgatgaaactgaggctcagagaggttaagacacttgccaaggattacagagctagtaagtggcagaactgggctttaaacccaggaagctagattccaaagtcttgtgttcttaactactaagctacactgttgatcacccttggagtcgtgggttaggagaaaaggaagggaaacaataaggtgggagaagatgaaggacttagggctcaaagctgatgcttcagtgaggtggaaaacctgtgctgtggggttttcctcagattacacacacgtgcacacgtgtttatatcaggtgctgaaaaaaagataattaatttagatatttaccaggaattctttcagaagcatttttaatgagtcatatttgcactgcacaattctttttgcttcatttttatatagttgaaggcagtaaggaattcttgtacaagtaaacatcttttccttttgtacccctcatcactgcgaatttgatagaacccttagtaaatgaccaggttgttttttacacttttttttctctcccacaacgtaacatgggtttggcaagctttaaaaaatgttagtatgtttgtatccactagtatacctctgaccatttaataggagatccctgccaattagagctagtgatgttttgttctaatttggagagacagggtgtgtctgtctttaaattctctgtcagttttcctttttgtaaaaaaaaaaaaaacaaaacaaaacctcaattcccaaattataaataaatttgagcaattgcagactaagggaataagaatgaatgaatgaatgcatccattggagtagaacatcttctctttttctttctttttttttggacggagtctcactctgtcccctaggctggagtacagtggtgcaatctcggctcactgcaagctccacctcccgggttcacgccattctcctgcctcagcctcccgagtagctgggactacaggtgcccgccaccacacccggctaatttttgtatttttagtagagacggggtttcactgtgttagccaggattgtctcgatctcctgaccttgtgatccgcccgcctcggcttcccaaagtgccgggattacaggcgtgagccaccgcgcacagacgagtggaacaccttcttaacacagaactagttgatttattttttcctaatgcttggctttttccaagtttttgttacccaagataacattagtcaaactagcactttgagaaaaggagttaaagtttttttattgttaaatttgggtaactggtcatattttcctttgtctcttactgtctcatacccttagatcaggggtctccaacccctgggccacagactagttagtaaaggtccatggcctgttaggaaccaggctgcacagcaggaggtaagcagcgttgagtgttactgcctgagccccgcctcttatcagatcactagtggcattagattctcataggagtgcaaaccctattatgaattgcatatgtacataatctagcttgcacgcttcttatgagaatctaatgcctgatgatctgttgctgtctcccatcacccccagatgggactgtctagttgcaggaaaataagctcagggttcccactgattctacagtatggtgagctgtataattgtttcatatcattattattattacagtgtaataataatagaaagaaagtgcacaataaatgtaatgcgtttgaatcatcctgaatccatctcccacgcccactccagtctgtgaaaaaattgtcttccatgaaactggttctgccaaaaaggttggggatcgctgccttaaattatgtagataaacgtaacagatatttgtggttatatcagggactattataacattttttctgtattaatctagatatttagctaaagctcaacatgctttacagattgatatggctaatgtttcaattgtttgcttcttgctactgtaaggtttcttagaattagggctctagatctttttttttttttccttcttttaaattaagagatgaggtccaagctggtctcaaactcctaaccccttcccaccttagcctctcaaagtgctaggattactgacatgagccagtgtgcctggccagggatccagatctaatacatgttaagatcatagcttttagaatgtttagtcataggtatttaactgtagtttcttcctttgaaccctgaacttcaaggcgtttagtaacacttttaaggtctgtgttcaggtggtttttggtttgactgtaaatacttttttctgtttaacatttcttagttcaaatctaggtcacaacctgtctgtactcttgtagagaattttattttttaaattttatttatttatttatttttcacagtcttgctctgttgcccaggctggagtgcagtggcacaatcttggctcactggagcctctgcctcccaggttcaaacagtgtgtgtgtgtgtgtgtgtgtgtgtgtgtatttttttttttttgacttccagtgacctttgaactttttattggcttcctgctccccaaagggtaccctgcttctgctggcttaattctcagaactttggtgtcattggtctcagataccactttgccatccactatctggtggatggtcgtcttttggatggttcgcatggagttgctgctgtccagggcatcaccaagattgaagtccttgccatcttccagcaggtggtggtaggtggcgatctcagcctctagtttgaccttgatattcagcagggcctcgtactcactcctgggcctggcgttgcccctctgcccgggtctgtgccagctctgactgcagttgcagcaggatcccgtttagctgctccatctgcaggaagtagagggcctccacctccctcagtctgttctacaaactggccttcacatttctcactgagtccaggtcaatctttaaggactggactgtatgtctcagctctgtgagcgtcatcttagcctctccagcctcagcagactgcgtggtgaccactgtggtgccctcctcaatctgctgagaccagtacttgtctagctcctgtcgattctttcaagccagctcattgtattgggccgagatgtctgccatgatcttgctgtcctgagatttgggggcatctgcctccatggtcaacccagagctggcaatctgggcttgtaggccttttacttcccctttatggttcttcttcatgaagaacagctcttcgttgagagcctcgatctctggcttcagctgcagccaagtgacattgatgtcatcattgaccttgtggagtccgtggatgtcactctccacagactggcacatggccagctctgtctcatacttgactctaaagtcatcagtagcaagatgggcattgtcaatctgcagaacgatgtgggcattgtccacagtatttaagaagatctgagctctcacgtcctcgatggtcttgaagtaatggccccagtccctgagctggggtcccttcttctccaggtgctcctggattttgctctccagcttccggttctcggtttccaggctctcactctgtccaggtaggaggccaggcattgaggcgttgcatggtctcctcattctggatgcctcccattcctgccagcccctcggccatccctgcagccagaccccaagctgtcccagaagctggtggagtgggacacggagatctgggaaccagagcccccagcacctggatagacgctggccaggcgccatagctggctgccttgacagagcttagggactggtagttggtggataaggtgaagcgagtggtaaagctcatgctctctggggaggagagtgagaggataggactcaggctttgccgacgaccagaatattagatattatcattgcctaatatccctttcttcttttgctgttgataatcaaaactttattactgattctgacttgatttttgaggtttggttcccatagaatttttagcagagaggttagtatttaaagggatatttaatacattatttcttttagctagaataagctaaaggtgcaaaagaatgaatgttgtcttaggttcctaagacctggaaaaccggtctgaatgcttttatgcactgggttaacctttatgccattcagaatgtgagaccagtttggtctgattttcattcctctgttaggcttaaaaaagaatcaccacactgttcattgatgtcattaggattattaggaaaaatgtttgttatgagtatgaagacccagagaactcttgtttacacttattttaatagtgaaaacttggttttgatttagaattcttctaacaatatatataagtaatatttgtggagtggtagagtgctttttttttttttttttttttttttacatttactaagtttgtctcatttgatcttcacaattctgtgaaaaaggtaggacagatagtgtcactcctacttttaaagataagaagtttgggcttcaaagaaattcagtgacttgccctgagataaatagctagttatgtctgctatcttttgcattagttttcattctcctatatcaaagagtttctatgcagaaagacttctatatgatttacttataatttctaaaatataaaattcaaattgttgaatttccggcttttctgcatttaccagaaaagtatgccatttaaaaaaatagaccattgaaaaaacatggaatgcttcatgaatttgtgtgtcattcttatgcaggggccatgttaatcttccctatatcattccaatttcagtatatgtgctgccaaagcaagcatgacttaatttttttagagcagttttaggtttacaataaaactgagcagatttctcgtatatcttctgcccccacacatgcatagtctccttcattatcaacaaatcccctaccaaattggtacatatgttacagctgatgaatgtacattgacacatacttattatgcagagtccatagtttaccttagagttcacttttggttttgtatattctatgggtttggacaaatgtaaaatgatgtgtgtccaccttatagtttctttcttttttttttgagacagagtcttgctctgtcgcccaggctggagtacagtggcgcgatcactgcaacggctcactgcaacctccgcctcccaggttcacaccattctcctgcctcagcctcccaagtagctgggactacaggcacccgccaccacgcccggctaatttttttgtatttttagtacagatggagtttcaccatgttagccaggatggtctcgatctcctgacctcgtgatccgcccgcctcggcctcccaaagtgctgggattacaggtgtgagccactgcgcccgtcttcaccttatagtttcatacagatggttttgctgccctaaaagtcttctgtgttcctgtcttgtttgtttgcttgttttggctatatataaagaggaacagatagcaagttcttccacattgtattactgtaattttaatcttatttgtagttgtgggatttagaaatacttgattcagaagtatgtctttaagttaattgattataattttgactcttaagggcattatgaaaaagtctttttctggttcttaacaaaattctttcaagttagctagtttcaaaaaagaaaaatgactttgtacttttaataatcacttaaaaaaccagtaccctttatattgcataatgcctatgggagatatatatataattttttttttttttttttttttagacagagtctcgctctgttacccaggctatagtgcagtggcacgatcttggctcgctgtcacctctgcctcccaggttcaagtaattcttgtgccttagcctcccgagtagctgggattacaggcatgtgccaccatgcccagctgattttttaatttttagtagagatagggtttcgccatgttggccaggctggtcttgaactcctgacctcaagtgatctgcctgcctcggcctcccaaagtgctgggattaccagcatgcgctgccacgcccagctaatgtttttgtgtttttagttgagacagcgtttcaccatgttggccaggatggtctcgatctcttgacctcatgatccacctaccttggcctcccaaagtgctgggattacaggcgtgagagaccgtgcccggctccaaatatatgtattttttaattgacttttttttttttgtgcaaaaagtttagttcaagtatttttatttttatttttttgagacggagtctcgctctgtcacccaggctaaagtgtagtggtgcagtcttggctcactgcaacctcagcctcccaggttcaaatgattctcctgcctcagcctcctgagtagctggaactataggcttgtgccaccatgcccagctaatgtttgtatttttagtagagaccaggtttcgccatattggccagtctcgtctcgaactcctgatctcaggtgatccacccaccttagcctcgcaaagtgctgggattataggcctgacccagttcaagtatttttagaacctctgttcttgtattcatagaccctgtgcaaatctctatgtggaaatacaaaataatccttaccttgcattcagcaaagttgacgttgacagcaaaggcaaggctaattatgaaacagttagaggagaggtcaccaaactttggtccaagacctgttttgtatggccctcaagctaagaatggtttttactttttaaagagttttttttttttaaataagaaagaataatatgtgacataggccatatgtggctcacaaagcataaaacatttaccatctagctcttcatagataaagtttgctgactatggattagaagaatatatatcatataaaatataaacagagaccttagggaaacgcaaatcaaaaccataatgagatattatttcatacacactaggaaggctgtaatttaggggaaaaaaggacaataacaagtgttggccaggatgtagagagattggaactctcatacattgctgatgagaatgtaaaatggtacagccactgtggaaaacagtttggcagttcctgagaaagttaaacatatgctaaagagatgcaatgaaaaagaataaataaataaaaataaaagaaaaatatagagttatcttacgacccagcagttttgctgctaggtatatacccaagagaattggaaacgtatgtgtacactaaaacttgtgcaagactgttcattacaataaacaaaaagtggaaagaacccaaatgtccatcaactgataaataaacaaaatgtgatatagccatacaatggaatatgatttagccataaaaaggaatgaaatactgacacaacttcaacatcgatgaaccttggaagcatgctaagcacaaaagccagacacaaaaggccacaagttgtatgattccatctatgtgaaatgtatagaaaaagcaaatctttagagacagtaagtagattagtggttgccagagactgtagggagggcaaatggggagtaactgttcatggatatgtttttttttgggaggggtgatgaaaatattcagaaattagatagtgatggtggttataacagccttgtgaatataatttttaaatccactgaattgtgtacttgaaaatggtgggccaggcgcggtggctcacgcctgtaatcccagcactttgggaggctgaggcgggcggatcacctgaggttgggagtttgagaccagcctgatcaacatggagaaacccccgtctctactaaaaatacaaaagattagctgggcgtggtggcacatgcctgtaatcccagctacgtgggaggctgaggcaggagaatccttgaaccgggaaggcggaggttgcagtgagccgagatcacgccattgcactccagcctgggctacaagagcgaaactctgtctcaaaaaaaaaaaaaaaaaaaaaaaaaaggtggattttacagtgtatgaattatatgtcaacaaaagaaaatttaaccagagattaagtagtataaaagaggtaatgagaggtcagggagagaaaagaagactgtgggcatgaattaatggatacaactctgaggttggggcttgaaatgcacctcaaaaggcacagaggatttggatagatagaggaagtggttaaggcattacttaggaaggggtataaaccaagatattattttgacataagagaagtggcaagatgtaagtggaagaaaagacaaggcgagtctcttgttttcatggggcttctaaactggcatattaactgatctggcctgctaaggataatgctttgcacaattattttcatgggataaattgcatatccttctagtctcaggcaagaattttttattccagccagagagcaagagcctaaggactctccgccatggtattcttaacgagttactgtaaggattttagttcattgcatatgctttgtggaatttgccatcttttttattttttttaacctattttaaatcatacaaagtgtctatcaggttttgttgttacttcaaacaaacccccctcttaatactttcttgttcttgccacttcacactttcatgtatactgttttatttaatccttccatcacacctgagttaggtggtatcattcccattttaaagatgaaagaggccatataatagagtgcttaggagccaggatgggagcactggaggcagaatgcctaggttcaaatcctcgttctgccatttactaattgttttgtgagttttgttgagttattgaacttctgtaggtcgtatgttttctcttgtccaaagtggtgattataataatattatagaattgttttaaataaattgactaaaagtaaaattcttagaaacatgcttgcacataataagtcctcagtaagtgttaaactgctactgttggttatagatcatgagaactgagtaagtttaagaagtccagagacttctacctgataagtggtagagccagtgattaaatataggtgatctgaatctaagtcctacttgctaatttatctagttgcctttaccatattttattatatgtttatttacttattggacataaaattattagccttctaaactttgatttaaatgtggactggctgaatgcggtggctcacgcctgtaatctcaggactttggaggttgaggtgggagggaattgcttgaggccaggagttggaggctgcactaagctgtgatcgtgccactgcactccagcggtgacagagtgagaccctgtctgaaaaaataaatgtgggccagaccatagaccaagtagttatagcaaaagagagtttctaaattactcacaacagaacttccattcttaaactagtcttttgctttaatccactggtacccaatccttagcagttataaaccaaactcatgagctatgaggggaaaatgaccatgggaaacatagatttaatgcaaaataactgaaaaaaaagaaaaaaaaacaatgcaataaaacaaaaaaaaaaacaacagaaattaacttgagcgtgataaacagctaaaagcaaacaatatctgagggaaaacgggataatcaaaaaaagtggctattcttaataaatagaacagactgcttgataggaacaaactttttttaaagataaatgaaaaagaatacgcattcacaaaagaaaaaagcacatgactgataaatatttgaaaactttaacctcactaatcggagaaacttagagtaataaaattttgataatacagttaactaaataggaacatttatgttgaaactgtgctattagggatatggtgaaatgggacccacacattcctgattggaatgccagttgataaaactaatctccatgaagaaccttaaaaatgttcatagtctttttttttttttttttttttttttttaagacggaatctcgctctgtcgcccaggctggagtgcagtggcgcaatctcactgcttgctcactgcaagctccgtctcctgggttcacagcattctcccgcctcagcctcccgagtagctgggaccacaggcgcccaccaccacgcctggctaatttttttgtttgtttttttgttttttgtatttttagtagagacggggtttcaccattcacaggatggtctcgatctcctgaccttgtgatccgcccacctcggcctcccaaagtgctgggattacaggctgagccaccgcgcccggcctcctaatctctgattaattaatgttccatgtgagaatataagacaaagaaaaaaatgacaactggataaaagtgtattatataaataaagattcattgcagcattatctgtaataatagaaaacactttgacatgcccagcaagaaggatagttaaattactgtacatttattgcaatatctgttaaaatagttatgaaaaacttcagtgaccttggagggagatgaagtaatatcggcgggggtgggggttggtagtaataaaaaacaagactcagaattgcaacaccttaacctctaatgtcaagcagtaaacctagtcttgagaacagttcattctggacaaatacttactgagttgctcttaaatgtttgattaataagtatctactataaaaataaataaggcaaaaccctttttgaaaccacattcccctttcccttgtagtagtgaccacctgatttttctattcctccttaaagcaaactcctcaaaaaaattgtccataatgccatctcccaatttcttgcctcccaatctttcctgaacccagttgtgcttttgtcctgggttattacactgaaattggtttatccagtctccagtgacctccagtggtcaagttctcagtcgcatcttaatttacatgtcagcatttgataattgatcaattcttcctctttgaaatattttcttctctttatcccaagaaactatatacatggttcccccccgccactgcctcactcactagttgctctttcctgacctgctttgatggcttctctgctctgattgttttttttttgttttagttaatatggagaattgtgttgtatttttttatattgtggtaaaatacacataacataccattgtaattatttttaagtatacaattcagtaaaattaagtacattcacattgttgtgcagacttcaccaccatctgtttacagaactcttttcattttgtgtaactgaaacttgattccattaaacagtaattccccatcccccttctccgcccccaacaaccaccattctattttctgtctctgaattttttactacaataggtacttcatataagtggattagggatacctatatgtcaaaattgcaaacttctgtgcatcaaagaacacatcaaggttgagcgtccaaaatccatatccataatccaaaatccaaaatccataacttttgagtgctgacatgacaccagaagtggaacattttatatctttccccatgtgggttgcagtcaaaatagtagtcaaaactttgtttcatgcacaaagttgttaaacatattgtataaaattactttcaggctgtgtatgaagtgtttatgaaacagtttagacttgggtcccattcccaatagatctcattatgtatatacagatattccaaaatctgaaaatatttgaaatctgaagcacttctgttcccaaagggatactcaacctgtagtccaatttatctatttttttcttttgttgcctgtgcttttggtgtttatctaagcaatcattgccaaatccattgtcatgtatctttcctcctatgttttcttccaagaattttatggttttgctctctcacatttagtctttgatccattttgagttaatttttgtatatggtggggcccaactcttcattcttttgcatgtgaatatccagtttttctagcaccatttattgaaaagaccatcctttcccaattgaatggtcttggcctcattttcaaaaatcatttgaccatatatgtgagggatttatttctggactgtcttattttataaattttaatatgttgtgttttcattttcattctgttcaaaataccaatttatcccttttgatttcttctttgaactatggattatttagaaatatgttgtttagtttctaaatatttggggattttcttgatctttctgttactggtttctaatttaattctgtagtagtcagaaaacataccttgtatgatttaaatttattcaaatttattgagacttactttataatttagaatatggtctatcttggtaaatgtttcgtgtacacttgaaaataatatatattctttcattgttggataaagtacagtcatacatcacttaacagggatacgttcggagaaatatattattaggcaatttgttaaattaatctctgagtagtttctttttagatacttttgtaagtgattttttaaattttatttttcacttctttgccaatatatagaaatacagtcacacatcacttaacaacatatctcctagctgtgatcacaccactgcagtccagcctgggcaacagagtgagaccctgtctctaaaataattaagtaaataaataaagtaaatcattcaattcaaccttagcttattgtaacttttttactttataaactttttgactcctgtaataacacttagcttaaaacacaaacacattgttgtctgttaaaaaaaatttcctttctttagttccttattctataaactttttttctatttttaaaattttttactttttagacatttttgttaaaaactaagacacaaacacacatattcacctaggcctacactggttcaggatcattaagatgtcactaggcaataggaatttttcagctccattgtaatcctatgggaccaccatcacatatgcggtctaaacaatgcggattaaaacaatgtcctgcagtacctggctgtattctgtaaatgttgattagatccaattgattgatggtgttgtttacttcagctacgaccttactgattttctgcctgccggatctgtcagttactgacaagggtgttgagggctccagctataataatggattcatctgtttctccttgcagtatccatttttgcctcatgtattttgacactgttgttagatgcatgcacattaagaattgttatgtcttcttggagaattgatgcctttatcgttatgtaatactcttcttcatacctgataacttctcttactctgaagcctgctttgtctcagaataatatagctactgttaactttctttttattagtgttagcatgatatatttttcttcatctctttacttttaatctctgtacagtagtccccacttacccatggaggatacatttcagtgtcctctgtggatgcctgaaaccgcggatatagtaccaaaccttatatgtactgtattttttcctgtacatacctataataaagtttaatttataaattagtcacagtaagagactgacagcaatacctaataatagaacaattctaacaatatactttattaaaagttatgtgaaagtagtctctctctctcaatattgtaatatttttcagatacctgttgactgggccactgaaattgcaaaaagcaaaactatggatgggggggtctactgtatttatatttaaagtgggtttcttatagacaacatatagttgggtcttgtttctttagtccgttgtgacagtctctttttttttttttctcttattattataccttaagttttagggtacatgtgcacattgtgcaggttagttacatatgtatacctatgccatgctggacagtctcttttaattggtgttggattaatatatatctaccatatttgttactgttttctattcattgccctcccttgttgtttcctttttttgccttctgatttcaattgaacattttatgttacttcattttttctcctcacttactgtattatacttgtttttacttttttttactagttgcccttgaatttgcagtatacatttacaactaagccaagcccactttcatataacatagcacttcatgggtagtgcaagtaccttggaacagaatattcttaattacttacactagtcccttataacattgctgtcattcattttacttatccataagctatagtcacctaataccttgttgctgttattttgaacaaactgtatatgtttagatcgataaaggataagacaagtaaaagtaaagtttctgacctaagtagttttccttctttctgaagaaattttcacatttcttgcaaggcatgtctgctggtgacaaattctctccatttttgtttgaaaatgtgtgcatttctccttcatttggaggatagtgtcacttaatacagagttgtaacttggtggttttttctgggaacactttaaatattttacttcactctcttcttgctttcctggtttctgaagagaagtctgatgcaattcttgtctctgttctgctataggtaagatgttttccccccctctggcttctttcagcattttctctttgccttgattttatgcagtctgaaatatacctaagtgtagatgttttggcatttatcttggttagtgttctctgaacttcctgggtctgtggtttggtgtctatcctctctttattttttagcagtcttttttttctcccaacttgtctcttcgtttggccctgtcttcaaaatgtatgtggaagttaaccaattcttactacctgcactgctactcctttggtcaacattcctatctcttgcattatttcagttgccttccagttcttcctgattctgcccttgaccttctcttttacaaccagagagaccttttaaaaatttcagtggaaacttgacatcctctgctcaaaactgtccagtggcttcccacgcataccaagtaaaagctgaagtccttaccgtggcctaaaagcctgtatttagctctctatttaatatcttaccttctcttctcctaatgacttcctcattgtcctccaattatagtgccctacttgttccttatcgaagtcaccaggcatctcaaggcttttctgcttccctcagatgtctgcccaactctgtcctctaactgcccatcatctttagttgtttactcaaacatcactcttctagattataaacctacatgccatatggactacgatctccccattgctttttgttttctggaacactttaccagctgacttgtttctggcaggagagtgcatgatgcattggagaagatgtaagaaagccagttggctggagtgttgagaatgaagggagcactgttgtgaaataaagccagaatgggagttagggacccaactgtgcagacccttgtaagccatgttaacatctttggtctttatctttaagggaaatgggaaatcactgaagtatctgaactggagggattcggaggaggtcactaagtgattaaatttgtcattttacaaagttcattttagcttcattatgaatatattggagggggaaaagattggatgtagggagatcagatgagaggctattatagggatccaggtgtaagctgatggtagcttatttagtctgttatggttgatggccatacaaaaagaatgattctctgaagtaatgtatttatatacatctgtggtcagcaattcataactcctgattgccaggttaagatttccaatttaggggccgggcacagtggctcatgcctgtaatcccagcactttgggaggctgaggcggggggatcatgaggtcaggagttcgagaccagcctgaccaacatggtgaaaccctgtctcaactaaaaatacaaaaattagccgggcgtggtggcgcatgcctgtaatcccagctactcaggaggttgaggcaggagaatcacttgaaccctggaggcggagcttgcagtgagccgagattgcgccactgcactccagcctgggcgacagaacgaaactccgtcccagaaaaaaaaaaaaaaaaagcaatttccaattgagaggatctctttttggttccatggtaagaaagtagaatgactttcccaacgtaattcttcagaataaaccctagaaattctgttagtcaaatagttatgtatctttttttgtgtatttcttagcatttggcacaaaatcaaagattccttattaaaccaattattatttaatggtcacttctagatcctgttcaaactgattcatctctcatgaaggcagggctttaactaatttccttgtttttcccaaccttctctcatctgaaaaaattaacttgattggccgggtgtggtggctcacgcctgtaatcccagcactttgggaggccgaggcgggcagatcatgaggtcaggagattgagaccatcctggctaacatggtgaaaccccgtctctactaaaaatacaaaaaattagccgggcgtgatggcaggtgcctgtagtcccagctactcgggaggctgaggcaagagaatggcgtgaatccgggaggcggagcttgcagtgagcagaggtagcaccatcgtattcaggcttgggcgaaagagcgagactccatctcaaaaaaaaaaaaaaaaaaaaaaaattaacttgatcagggctaagattgttcctcaatcagatgttttcaaaacaaaggtgtctagggggtgttatttctcttcacaaaattaatagctctgggaacaaaaaatttgtgtagaactgtagcacttacgaggataggaaactcataacactctggccatactaagagagatttgatgctcttatatgagcaaacagatttaataaacagcgattctaatagttttctaatgtggcagtgtttttatcaactaaaacattgattctcttcactttagtttgggaaggaaaaaagcattaagcttctgtacctaaaatatgttattaaatatgttgtttacttaacagaaaccagtgaggtatcttagtccagctttgttgtgtaaataaagaagttgaatattaatgaggataaatgacttgtcttggctcacacaacttatagatcctgattttggacccagatattcctgcaaaagtctctttggttttgttgttgttgttgttgtgtttttgacacagtcttgctctgtcgccaggctggagcaagtggcatgatcttggctcactgtaacctccgactccctgattctagtgattctcctgcctcagcctcctgagtagctgggattacaggcacgagccaccatgcccagttaatttttgtatttttagtagagacagggtttcaccatgttggccaggatggtcttgatctcctgacctcatgatccacccgccttggcctcccaaagtgctgggattacaggcgtgagccaccgtgcctggccaaggctctttgtttttgatcagaggttgttaatttgggttccctggtctccaacatttccctcacttcccccagtgtatatattcttttcaaataactggatttactggattaaggaatacaataaagttaagaatcaataaatttgattatactgcctcctgatttggggttcctaatctgacagtgctttccattcttgtcttgcattacctttccaaaattcttctcaaaatatcaataacactctagttacattaataaagtagtgatagtagtatttttaagtggataattgccaggcactctcctaagtgctacatatgcattatctaatttggtgttcacagcaacattgctgaactatgtcccttactttaagattagccctccatctaaatggtctcaccacattttaaagattgcttggattaattgaattaccgaatatagtggaaaaggtcttaggcattagtgttagacgacacctagctttgaagccaaggtcaaccccttttttctttcattcaataaatgtttattgagcatctactattttccaactattgttctgagcactaggaatggcatcttttatctgcattttgaagggaagataatgtctgccttgaaggttgctaaagtctaagaaaaaggcacttaaaaaaaaaaggtttgcttccttgccctcctaactgatcttccttctctagtttttcattcctctgttgcaatctacagagtactcatagagctttcttttttctcttcaaactcttgctcaaaagccttagatggcttttctcatctgataggaaagtttcaagttcataggatgtcatagaggaacttttatagcctgctatttaaaaccatatatgggccaggcacggtggctcacgcctgtaatcccagcactttgggaggccacggagggtggatcacctgaggtcaggagttcaagacgagcctggccagcacggtaaaaccctgcctactacaaatacaaaaaaattatccgggcatggtggcacatgcctgtagtcccagctacttgggaggctaaggcagaagaatcgcttgaaccaaggaggcggaggttgtagtaagctgagattgcgcaactgcactacagcctgggcaacaaagtgagactccgtctcaaaaaaaaaaaaaaaaaaaaaaaaacaaaaaacaaaaccacatatgtactaagtcctttcctctctcaccctttcacagtaaatgctcaggccacctagacttttttttaaatataagttttctattagatcatcacagagtctcttgagtctctgccttttttctggaattccatgtctataacattctgtctacctacacccccttcctctccctgggcttcaagaaatacatacaaagtacacagtgaaaaatctcttttctttccatgtcctgtcattcctcagcttccttcccaaaggtattctatgcatatacaagttttatgtacatgaatgaatacaggcagattggcatgttagattgtgaaccctgaaaccaggttgcctgagtttaaatcgtggcttttcttcctagatatgtgactttggggatattactagtatctgccttgtaagcttattgtgaggatttcttacagcacttcctggcacatggtaagcactcagtaaatgtttgccattactattgttgtgttgttgttatataacagcataatatattcaaaagagagcaacatttaaaatctagagacataggtttgaatacagcttcctaattactttatgcttaagtcatttaatccaagttaagccttgtatgtttctttatagtgggggtaatgacatatagttttggttttgattacctaaaaaataaaaaggaaagagcattgtaagtgacagaatgctatataaagtttagttgctgttggttacacggttttactttcccttcaaggaaaggttataacattttagctggataatagtttgaaaaacaaagatatcagaaacttagttataattatgcatttttacttataattattccaaatttatactttttcattagctttggcatgctttagttttggtcatatatagtttatgtggcagtgctgttaagggaataaagttagagagtgaatacctctatttatggaaatgtatcaagattccagaattgataaacttagctatacttggcataatttagtacacctgaccaaatgtatcttttaaggaaaataatgttttggtcaacctagaaagtattagtcatggccttaaattttttctgcatggtttacaaattttttgtttgtctgcaatgataatagttatactgaagaatattcactttacttaagtagatggtaatacatttaaaaagcagtctttcatttccatttcacttagtcaaacatttactggtgatgtgcttttgatgatttgctatgttgctaaaacaggatatgcattcactgttttttgacagctcatggatccaagagcacatgtagttcctaaaggcacagagtataggatatttttggatactgtgatattcccccctttcttctggtaattagaagcattcccagtattaaacatttaggaggaaaagttatagtcaaagaagaccatctctttcttttaaatcattttaatatgaagcatatattttactttagagctttaaaatgatttaaagtaacaattttagtaacctttgggtttgtcttgaaagtattttcatttcatttgtttctaaaatacttgtttctctgaagagagaagatggctcaatctgatgacatacgtaaccgtgatgactgacagtttaaactgaaatcaataaagggagaatagtttttaaatgcattgagacaaagcatacaggaaagatataattttgtataatcttttgttgaagtcttcaaaacagtacaagtgttatttgcctcatgacatgaaaattcacagtaaacaaagctattatatttgaatttcacaaaaatgtttactttcttagttatccttcagaaaaaaattcagaatgatgactcttctcaaattaagtatttatactaatacctgcaaaaactgtcatttagggattatttgtacagttctatgtggtaacactcagccatgcaacatgtgcatatattagtttccatatgtaaaatctggaattactgaaacaatctgtcttagactttttttgatgaagaattagattaaaaactccttatttataacaacatggtagtcattgaatgtaagaactcagatcacattgcagatattctaaaaatagaatgtaaattaggttttaacactaattctgagattattatatgtggcaaataatttgaatgatattcagcagtctaatttaggtaatcaaatcacagagatttaaaaaaaaaaagcattgatttgcatttgtgatcagtattgcttaggaaaaatgcctgatactataagagtatataaagttttgactcaaaggggtcagggaagcatatcttagggaattaatacttgtgctcagatccaaggaaaagagcaggcattattaactaagtggagaaggaagaagtcattgcaggcaaagggaatagcttctgcaaaagccctgtggcagaagggagcatatcaggtttaagaaactgaaagatggccagtgtggctgtcatagagagtaaatagggatatggagcaagatgaagtggatacaggccaaatcattaggagctttgagaacttggagtttaatctttaccctatgagcaaaaggaaatcatttaattttctgttttgaaaagatcattctggctgcaatgtagaggaactcaagtgagcaacaatggactagttaagaggctatttcagtagtcccaggaggttgcttaggctagagtcatgtagtggaaaagaaaaggaactgacagattctttgcctggagggtaacggttctttgctcaggtcattctgacactcctaccctcctctcctgtttctccactctttaaaaaaatggcgatagaaaatacaaagtagtattctgtgattaaattatcacacttttattatagattatattcttgataactaatattcataattttatgttgagaatattataaagaaatgttttcatcaaatgtagattcatggctgggcatggtggctcactcctgtaatatcagcactttgggaggccgaggcggctggatcacttgacgtcaggagttcgagaccagcctggctaacatggcgaaacctgtctctactaaaaatacaaattagctgggcgtggtggcccgcacctgtaatcacagctactcgggaggcttaggcaggagaattgcttgaacctgggaggcggaggttgcagtgagccaagatcgcgccatcacactccagcctgggcgacaagagcaagactccgtctcaaaaaaaaaaaaaaatgtgggttcatgacttctcactgtgaagaagtgcatattggccatttaagattttttaaatgaaggtcccattttacaactggaaacctaaaggaacagtatcaaggaactgacataagatatgctcagaggctaaaaagtaagtgaaagctagactcagcactcagagcctatttttgtcttgatggcacctactgaaccagctaaacctgggcttatggtttcattgccttcgcagacatagaggataggagactaagctcagtctatgaggagactccaccgagtgtctgtgcacccctccccacccctactcctgccaactccgaggaaactggactgtcacaaatgttggcactaagttgaagtggtggtgcaggtttgggggttgttattctttgacattttatagttgcaacctagcctttatgtttccatatctaaatcacactttttgggttagcccaaaagtatcttaaaatttgactatggttcaaagtaattctggccactagtaactccaggcacttgcagaagcaaatgcacatcacagtaaaagatcacacaactcaaaaagaaaaagagactgaaaatacggattatccaggataacagacaactgaattggacccccattgacttcatattttggaattattagacaggaatttaaaatcagtgtgtttagcgaggtaaagattaaaaatataagaatgatgggattatgatagctaacattttgtagtgcttcctatgaaccttgaactcttcagtactttacatgttaattaatcctcacaaaaactctaaagtagggtttattattatccccattttacaggtgaaggaatgaagcacagaatggggatgtaacttgaccaaggttagtaaagtagtagaaccaggattctagccaggcggtatgggtcctaaagtcaggcttttaaccattttactatactgcttataagaaagatagcgaggttatgagaagttacaaatagcttttttgtgtttagggggagaacttttagaaatgaaatatataggctgtatgcggtgatgcacatctgtaatcccagcactttgggaggccaaggcaggtagatcacttaagcccaaggagttcgagaccaatgtgggcaacatggtgaaatcccatctctacaaaaaaatacaaaaattagctgggcatggtggtgtgtgcctgtagtcccagctacttgggaggttgaggtatgaggatcccttgagtccaggaggtcaaggctgcagtgagctgtgccactgcgttccagcctgggcaacagaatgagaccctatctcaagaaaaaaaaaaaaaaaaaaaaaagaaagaaaagaaatgtataaataaaaatcttaaaagtcaatggacaggcttaacaatagattataattagtgacctggaagatgacctgaaaaataagttaaccaaaataaagagacagaaatggaaaatatgtaaaaaggaaaaaagaaaattggacaaccatagcctaaattgctagttttccctgataccattctgtgtctaataagtagtggatatattagttggatgctctgttgcctagctaaaacttctgtttcattgccttcctgatagtgagatttgactatgtgacaaggctttggtaatttggggtgcaaattgaaatgtgtgtaacttctagatcatgcctgtgagaggaaaggggatatgccgttttctttatctttcttcctgcccatgaactggaatgtaaacatggcaatgagatatttttgcctgtgtagaagggggcaatactctaaggatgacagagcaataagacataagagcttggctctctcagactacctagctgccaaacaagagtgtcatgtgagaggaaaataaccctgaattttggttaagccacttttgagtctcttattaacagcagccagtgtctacatcttaactaatccaagaagagcatgaaaaggtctaatagttgtctaaccagaatttcagatatgaagaaaaatcaagtagatacagtatttaaggagattacaattagaatttccaaaactgcaaaaagatacaaattcaagaagtcaaatcctaagcagagtgaatagaaatgtaaacctaaagtcttcatagttaaatttgcagatgatcagagatgtcaaaaataaccagaaggacaacacagatcactttcaaaagctctgcaattaggctagcagctgacttattgaaaggaaagtagaaatcaaaagacagtagaatagtaactacagtgtactcagagtaaataactattaaagctaaaatatccttgaagagtgaagcaaagttttcagataaataaaactgggagtttttttttgttctcactatttgcacagcactaagaaagattccaaaagatatactttaggtagaaggaaagtgacccctaatggaggatctgaaatattaattaggaaagaaaaatggtcccaggcgcattggtgcattcctgtaatcccagcaccttgggaggccaaggtgggcagatagcttgagcctaggagttcgagaccagcctgggcaagatggcgaaaccctgtctctaccaaaaatacaaaaaaattagccggacgtggtggcatgcacctgtagtcccagctactctggaggctgaagtgggaagattgcttgagctcaggaggcggaggttacagtgagccaagatcatgccactgcactccagcctgggtgacagagttgagactctgtctcaaactaacaaacaaaaaaaccaaaaatggctgaaattattgaggcaggtatccaacttaggttagaaaaacattagaataaactaaagaaaggaaataataaacataaaagcagaaattaaagaaatagaaaagaggtctacaatgaaacatcaacaaagccaaagttggttgtttgaaaaagactaataaaagtaacaaacctggtaaaatgaccagaagtaaaagaggaagggcacagataaacaatccgaatgaaaaaggagatataactaaagatgtggcagatttttataaaagagagaaaagtgcacacactaacacatttttgtgcagggaataatttcagatggtagattattgtatctgttgtcataatagtatatcaagtctatcaagacgacttgtcaaacttgccaaaaattttactcttgaatatgtaagatggttggattaaatattttaatcctttacttgaatatttggagagttacaaaggtgcaatgaatcacataactctgcttcagttatactttactaaagattgtggtaaagatttatctggggatatagatatggataaatttctttaaaacagtagaatatgtgttcccttttaatacataaggaagatgaggggaaatgcgtaaacctgagaaattgtggaaaccttgtatttttaaaaggctggctggagtacagtggtacagtcacagctccctgtgcccatagaactcctgggcccaagcgaccctccagcctcaaaggtgagagccaccacgcccaactaaaacatactgttgtgtgaagatagaattcaaagggctagatgaccatatctagatatgtttttagagtggattgccacaaatgaaagttgctgtatttcaggaattctgttgtttttaaatactgacttcatttaaaacaagaaaacacaaaatcagctattcataaaaagtttgcctcatgtaagtcaagtatactattttcttttctttctttctttttttttgtttttgaggcactctcattttgttacccaggttgtcgtgcggtggcgtgatcttggctcactgcaacctccgcctccctggttcaagcgattcttgtgcctcagcctcccgggtagctgggattacaggcacatgccaccacacgtggctaatttctgtattttcagtagagacagggttcaccatgttggccaggctagtcttgaactcctaacctgaagcgatccacccgccttggcctcccaaagtgctgggattacaggcatgagccactacgccctgccagctccagtaatttttgacatgttacattttaattattatttagttcaaattgtttaatttccatcttgatttctttcttcacttatggattatttagaattctgtttcatttacaaacatttggggataatgtggttatatttttatgttgatttctagtttaatttcattttggttagaaattacactctgtatgatttcagtccattgaaatttcttgagacttgatttatggctcagcatggtctgttctagtaaattatccatgtacactggaaaaggatgtatagtttgcagttgttgggtgtggtgttctatatgtctcttaagttgattcattatctgctcaaatcttctatatatccttcctggttttgtcttccctttctgtcatttactgagtaagttctgttaaattctattcatgattcccattctgtcaagttttgctttgtatgctttaatttatatttaaattttatttttctattgagtgctattaacataaattaatattaacatatttatatacatggattgtctgacatctttccatttattttcagtttgttgatctgttctttgtttctttgagattgttatttaggatactgcaagaaattcataatgtcttgggtataaaattagggagtagctcagctgggtgaatcgagtctaaatctctgatgatgttgcagtaagatggttgctgtctgggatcatcttgaagcctttattattcacagatgtgggaagacagaaacagctgggactctggcaaccatgtctttctctgtggtctctccaaagtggtgactgcacggcagcctaacacttaggactccatagataggtatccccaaagagaaaaaattcaggaggaagctctgatgccttttctaacctagcttaagaattcagacagcagcaccatgttggctggattttgttcattgctaaccctgcctgtattcaaggagaggggaatatgttttttctttctacaagttttttaggattttgtctttgtttttagggtttggaattttaactacaatatgttcaggtgcaagaatcttttttctttcctcttcccactgtgtttggcattcattgggtgtttgaatctgatgattcctaacttttcttagtttacctctggaaatgttattctgctgttactttgggtctggtgttctttctacattcccatcagatagctggtgaaacctttgggtgtatcctccttacctctgtctttcatacattccatctctctgctcttttgttcggcactctctggtttgtgtattggtatatttatgtgatttcacattaccaaaaagtacagtttttcttatgatgtactctaaagagcactgtcctttgttgtggaaagttaaatcttaccatgatttccatattcactcccctccccaccagcatgttgtggtgagttgccagttttaaatatttatgatccctgtaaatatttaaagataactaataatatactgcttaagaaactaccttcactgttccttaatgtaaaaaatttttctccaaagtttctgatcactaaatttcctttaatgaattttgttttataagttcagttctacaggagaaacttttgtctgtaatacattcatttatgttaaaaattgcagaaacaacaaagttgggatcaatttaattcacaaagacaatcaagtcatattatttttgtaaatgttagaagtaggcttcctgaaggaagaatgaagagttagattataacttggaccataatgttagggactcagaattgacttaaaatttaaacatagtgtaatgtttattcctgtcttccatatttgtcagggaatcttaaccagagtaagaaattttctggtgctgtgtcgggagtgcagggcacaagagatttccataaaaaggcatgggatttgcttggaagaacatagaggttttctaacttggcagtaatgagttagaactaattccccttagaaagaaaaattaacttacattcttattgggagttcatttgtgtgtatgctttcttgtgtgacctatttattatatttgtgagtgtacctgtgtgtatacattcgtgacccatggtgtttgttaggtgtaaataaaattttctatacatactctgtgaaaaatggctttggaacttgaatgtcttgccattttagttgaggaacaggggccaaatattttgttgttgcagaatatccaaaataatttgaccatctctgagttctttccctagtttctgttgctgtagaaaagctggaggcatttggggaatataaatgatccatgctatattaggattctgtcttgaaagatacgcatttttggattagagagatgatgaattcacatcttgttaaaatgtcagcgatccccagactggaaagggggtagggatgtaggcatccttttacgtgaaatatatgctcttgtgtttagctgtcagtatttttcttttcatggacatcacttttttttttttcatggaatcacctaatacagatagaggtataagatgcctagtgtcccacacaaaactctcccacctcactctaccttttcaaaaatgtggtggttatttttaaaggctcacccagttcttaccttgcttctctttctcattggttgacctcatccactgctatggtttcaatgctaccatcttgaccaccattgactcccgagtctgtacctctagtccattggtttctacagaacctccagacttggcttttaaaatatctatcagatacctttacttgttcttcccataggaatctcatagttaatttttggaagaaagtattatctttctttttaaacctccttttgtatttcctgtcttaattggaggtaggctatcaaccacttacttgctcaagctagatacctaggagttatcactgactcttcttcattccttttagtagcttatcagttatggagtcctgtcagttttatcctcagaaaagcattgcccctcttcagccctattgctcctgtacaggcccgtgtcatctctcactcgagttactgcagtagcttcctagctattctccctgcctctagtctcttctttcttcagtccatcttgcatactgtcagttgtttttccagaatacaaatctaatcatattaattgtttttaaatcactttgtcttttccccgttatttactagataaaatatgagctctttaacatgacaaatgccgagctatgtagtatccctggatcttttgtatttaattctttagtgtgtttgcttaagctgtttcctttgcttggaatgtccttctaagcattatagctgaaatattcctattcagttttttgcttagctcttcatatgagctagtcaaaatttaaaaaactgtcctgggccgggtgtggtggctcacacctgtaatcccagcactttgggaggccgaggcgggtggatcatgaggtcaggagatcgagaccatcctggctaacatggtgaaaccccgtctctacaaaaaattagccaggtgtggtggcgggcacctgtagtctcagctactcgggaggctgaggcaggaaaatggtgtgaacccaggaggcggagtttgcagtgagccgagatcgcgccactgcactccagcctgggcgacagagtgagactctgtctaaaaaaaacaaaacaaaaaaaacagcctggagtctcctctgttcgtccatccttccctagcccattaattttgtcttgtaccagctttattcccattgctttgtagttatttgtttctttctcctttataagctccttgaggatggaaaacacatacttttcatttttgtttccttgacacctagtacagaactggtacctagaaaatactttgcaaatgcctgattcagaataatgatatttgccattatgtctgctttatagtgtcctcactatgtatgtatattagttcattttcatgctgctgataaagacatacccaagactgggcaaaagaaagagatttaattggactttgagttccatgtggctggggaagcgtcacaatcgtgacagaaggcaaggaagagcaagtcccatcttacgtggatggcagcaggcaaagagaaaatgagaatcaagtgaaacaggtttccccttatcaaagatcttgtgagacttattcactaccacaagaacagtataggagaaactgcccccatgatttcaattatccccacctagccctgcccttgacacgtggggattattaaatttaaggtgaggctgggtatggtggctcacgcctgtaatctcagcactttgggaggctgaggacaggcggatcatgaggtcaggagttcgagaccaggctggccaacatggtgaaaccctgtttctactaaaaatacaaaaattagccaggcatggtggtgggcgcctgtaatcccagctacttgagagagtgaggcaggagactcacttgaacctgggaggcagaggttgcagtgagccgagatcatgccactcaagcctgggttatagagagagactctgtctcaaaaataaaaaataaataaggtgagatttgggtggggacacagagccaaaccatatcagtatgtaactggtattctgagaaatttcccaaataaataattcaaggtgagatttgggtggggacacagagccaaaccatatcagtatgtatctagtattctgagaaatttctctctttcccgcattgaattaacttaaattaactttttaagctgtgatttacatgtaataaaatgtatatattttaaataattcagttcaataagttttggtaaataaatatacctatacaactattaccacaatcaagatacagatcattctcatcaccccaaaaagtatcctcatgctcctttgtagccattacccctgtgccaccaccactggccccaaacagctttctgtcactgttttatcttttctagattttattttatcttctctagatttttttttttttaagagaccaagtctttctctgttgtgcaggctggagtgcagtggtacaatctcaactcactgtaccctccgcttcccatgttcaagcaattctcctgcctcagcctcccgagtagccaggattacaggtgcgtgccaccacacccagctaatttttgtatttttagtagagatgaggtttcaccatattggccaggccggtctcgaactcctgacctcaggtgatccgcctacctcggcctcccaaagtgctgggattacagacatgagccaccgtgcccggccttttctagatttttataaaagtagaattacagaatattactctttgtgtctgtcttattttgctgaacatgtttttgagattcatccatgttgcaagtaattcattccttacattcattactgagtagtattccgtcagttggatatatcacaatttatctactcacctcttgatagatacttgggttgtctgtagatttttggctattacaaagacagaagttgaagttaacattgtttctcagcttggcttgttgaaaataatgtcttttacacattgaattacttgtgttaatgatctattgctctgtaaccaattgacccaaattttattggcttaaaacaacaataatcattttttttctgtcaacagtttctgtggatcagggatttgagagtgacttggttggagggttctagctcatgatatctcacgaggctgcagatatttgttttaaggctaaaatcaagataagcttcaaaggtggttcactaacataattggcaagttggtgctggttcttggtaggagtcctcagctcctcttcaggtgtgcctctctgaagggctggtgttcacctgacatggtgactggcttctctcagagcaaatgatccaagagaccacaccacaacctgcggtgccttttaggatctagacttggaagtcacatattttagcttctgccgtatcgtattggtcacatgacgaatcttgattcagcatgggagggaacttattcaaggatatgtataatgagagggaacgatacaaggtatgaatacaaggagaccaggatcattgattgagagctgtcttgcaggatggggtgtcacaatatacctttattaaaaatgaattaatgtgttgctgtgtttcgacttctggacttaatttggtttccctgatttgtatgtttgtcgttatgctgatatcacacaatatgtattactacagttttatagtctagaaatcagataatataagactttgttcttttttaaaaccatattagcttttctgaattatttgcattttcatataagttttaaagttatcttgtcagtttctacaaacactgctgattgagtttgcattgaatctgcagatcaacatgaagagaatgacatcttactaataatatgggcaaatactaatatatggcatagctctctattaagtctttaatttcagccatgttttgtagttttggtatataagtcttgcacatattttgctaaatgtatctctaagtagtttcttactggatgtttttgtaaatggcattttttttaatttcaattttcagttctttgccagtgtatagaaatacagtcacatgttgcttcataatggggagaaatgccttgttagtcaatttaatcattgtgtgaacaccacagagtgtacttacacaaatctggatgtataatatagcataccacatacctaggctgtattgtatagcctactgcttgtaggctacaaacctgtacatcatattactgtacagaatactgtaggcagttgtaacacaatggtatttgtgtgtttaaacatagaaaagttacagtaaaaatgttattataatctataagaccaccaccgtatatgtaatagagtctgttgactgaaatgtcattatgcagcacatgactgttcaggtgggtttttttttttgtatcaactttttatcctgcaacttcgctaaattcacttgttagtctggtagcatttttgtatattccttaagatttcctacatacaggattgtcatctgtggataaaagcagttttacttcttccttttgcatatgtactatacctagcttagtgcaatgtcaatagaagtggtaagagtagacatattgatacaataaaaagaaaaaccatatactatcagtaaatgcagtaaaagcattttgggaaaaaaaatccaacatcttttcctcagaacccagataaatgaaagctcttaagaatgtaaaagtgggggttccgggtaagatggccgaataggaacagctccggtctgcagctcccagagagaccaacgcagaaggcaggtgatttctgcatttccaactgaggtacccagttcatctcactgggactgggttagacagtgggtgtagctcatggagggctagcagaagcagggtggggcatcgcctcatccgggaagtgcaaggggtcagcgaactccctcccctagccaagggaagccgtgagggactgtgccatgaggaacggtgctattcagcccagatactacccatttcccacagtttttgcaacccgcagaccaggagattccattgggtccctacaccaccagggtctggggtttcaggcacaaaactgggcggctgtttgagcagacactgagctagctgtaggaggtttttcttttcttttcttttctttttttttgtacccagtggcacctggaaccccagcaacacagaactgttcactcccctggaaagggggctgaagccagggagccaagtggttttgctcagcaggtcccaaccccatggagtccagcaagctaagatcactggctggaaattctctgcacagcattctgaagttgacctgggacactccagcttggtgggaggtggggcgtctgccattactgaggtttcagtaagcagttttcccctcacaatgtaaacaaagcctccgggaaggtcagactgcagcatggcaaagccactgtagccagactgcctctctagattattcctctctgggcagggcatctgaaagaaaggcagcagccccagtcaggggctttatagttaaaactcccatctccctggtacagagcacctgggggaattggcagctgtgcacacagcttcagcagacttaaatgttcctgcctgccagctttgaagagagcagcagatctcccagcatagcactcaagctctgctaagggacagactgcctccttaagtggatccctgatccctgtgcctcctgactgggagacacctcccagtgtgtccagagttggttccttccggtgggttcttggtctcgctgacttcaagaatgaagccacggaccttcatggcaagtgttaacagctcttaaaggtggcacggacccaaagagtgagcagcagcaagatttattatgaagagcgaaagaacaaagtgtccacatcgtggaaggggacccaagcgggttgcgactgctggctggggtggccagcttttattcccttatttgtccctgcccatgtcctgctgattggtccattttacagaatgctggttggtgcatttacaatcctttagctagacacagagctctgattggtgcttttttcagagtgctgattggtgcatttataatcctttagctagacatagagtgctgattggtgtgtttttacagagtgcatttacaatcctttagctagacgcaaacgttttccaagtccccactcgacccaggaagtccagctggcttcacctctcaccagcaggggttgacagacgcctcatacaggagaggttcagctggcatttggcaggtgctcctctgggatgaagcttccagaggaaggagcaggtagcaatctttgctgttctacagcctctgctggtgacacccaggcaaacagggtctggagtggacctccagcaaactccagcagacctgcagaagaggggccagactgttagaaggaaaactaacagaaggaaaactaacaaacagaaagcaataacatcaacatcaacaaaaaggaagcccatgcaaaaacctcatccaaaggtcctcagcacaaagactaaaggtagataaatccatgaagatgaggaaaaaccagcacaaaaatactgaaaactgctgggtgtggtggctcacgcctgtaatcccagccctttgggaggctgaggcagacggatcgtgaggtcaggagtttgagaccagcctggccaacatggtgaaaccccgtctctactaaaaatacaaaagttagccaggtgtggtgcatttataatggttggtgccagctactcaggaggctgaggcaggagaatcacttgaactcaaggaggcggaggttgcagtgagccaagattgtgtcattgcactccagcctggacaacagagtgaaactccgtctcaggggaaaaaatgctgaaaattccgaaaaccagcatgcctcttctcctccaaaggatcacaactcctccccaacaagggaacaaaattggatggaaaatgagtttgatgaattcacagaagtaggcttcagaaggtggataataacaaactcttccaagctaaagtgcatgttctaacccaatgcaaggaagctaagaaccttgataaaaggttgcaggaactgctaactagaataaccagtttagagaagaacataaatgacctgatggagctgaaaaacatagcacgagaactttgtgaagcatacacaagtatcaatagctgaattgatcaagtggaagaaaggatatcagagattgaagatcaacttaatgaattaaagcgtgaagacaagattagagaaaatagaatgaaaaggaatgtacaaagcccccaagaaatgtgggactatgtgaaaagaccaaacctacgattgattggtatacctgaaagtgacggggagaatggaaccaagttggaaaatgctccaggatattatccagaacttccccaacctagcaagacagaccaacattcaaattcaggaaatacagagaacatcactaagatactcctcaagaagagcaaccctaaaacacataatcgtcagattcaccaaggttgaaacgaaggaaaaaacgttaaggccagccatagagaaagatcacgttacccacaaagggaagcctatcagaataacagtggatctctcagcagaaaccctacaagccagaagagagtgggggtcagtattcagcattcttaaaacataattttcaacccagaatttcatatccagccaaactaagcttcataagcgagggagaaataaaatcctttacagacaagcaaatgctgagggattttgtcaccaccaggcctgccttacaagaggccctgaaggaagcactaaatatggaaaggaaaaaccggtaccagccactgcaaaaaccataccaaaatatgaagaccaatgaagctatgaagaaactgcatcaactaatgtgcaaaataaccagatcaaattcacacataacaatattaaccttaagtgtaaattggctaaatgccccaattaaaaaacacagactggcaaattggataaagagtcaagacccatcagtgtgctgtattcaggagacccatctcatgtgcaaagacacacataggcccaaaataaagggatggaggaatatttaccaagcaaatggaaagccaaaaaaaaaaaaaagcgggggttgcaatcctagtctctgataaaacagactttaaaccaacaaagattaaaaaaagacagtggcattacataatgataaagggatcaatgcaatgagagctaactatcctaaatatatatggacccaatacaggagtacccagattcataaagcaagttcttagagacctgcaaagagacttagacttccacacaatcatagtgggagactttaacacaccactgtcaatattagatcaacgagacagaaaattggcaaggatattctgaacttgaacccagctctggaccaagcggacctaatagacatctacagaaccgtccaccccaaatcaacagaatatacattcttctcagcaccacataacacttattctaaaattgaccacataattggaagtaaaatactcctcagcatatgtaaaggaacggaaataataagtctctcagaccacagtgcagtcaaattagaactcaggattaagaaactcactcaaaactgcacaactacatggaaactgaacaacctgctcctgaatgactactgggtagataacaaaattaaggcagaaataaataagttctttgaaatcaatgagaacaaagacacaacgtaccagaatctctgggacacagctaaagcagtgttttgagggaaatttatagcactacatgcccagaggagaaagcaggaaagatctaatatcaacaccctagcatcacaattaaaagaactagagaagcaagagcaaacaaattcaaaagctagcagaagacaagaaataactaagatcagagcagaactgaaggagatagagacacaaaaaaaaccttcaaaaaatcaatgaatccaggagctggtttttttaaaagattaacaaaatagaccactagccagactaataaagaaggaaagagaagaatcaaatagatgcaataaaaagtgataaaggggatatcaccactgatcccacagtaatacaaactaccaccagagaatataaacacctctatgcaaataaactagaaaagctagaagaaatggataaattcctggatacatataccctcccaagactaaaccacaaagaagtcaactccttgaatagaccaataacaagttctgaaattgaggcagtaaataatagcctaccaaccaaaaaaagtccaggaccagacagattcacagccgaattctaccagaggtacaaagaggagctggtaccattccttctgaaactattccaaacaacagaagaagagcgactgctccctaactcattttatgaggccagtgtcatcctgatacccaaacctggcagagacacaacaaaaaaggaaaatttcaggccaatatccctgatgaccatcgatgcaaaaatcctcaataaaatactggcaaactgaatccagcaacgcatcaaaaaccttatccactgcgatcaagttggctttatccctggggtgcaaagttggttcaacatatgcaaatcaataaatataatccatcacataaacagaaccaatgacaaaaaacacaagattatctcaatagatgtggaaaaggcctttgataaaatccaacaccccttcatgctaaaaactctcaataaactaggtactgatggaacatatcccaaaataataagagctatttatgacacacccacagccagtatcatactgaatggacaaaagctggaagcattccctttgaaaattggcacaagacaaggtgccctctcaccacatagtattggaagttctggccaaggcagtcaggcaagaaaaagaaataaagggtattcaaacaggaagagaggaagtcaaattgtctctgcagatgacataattatatatttagaaaaccccatcgtctcagcccaaaaactccttaagctgataagcaacttcagcgaagtctcaggatacaaaatcaatgtgcaaaaatcacaaacattcctatacactaataacagccaaatcatgagtgaactcccattcacaattgctaccaagagaataaaatacctagtaatgcaacatacaagggatgtgaaggacctcttcaaggagaactacaaaccgctgcacaaggaaataagagaggacacaaacaaatggaaaaacattccatgctcatggataggaagaatcaatatcgtgaaaatggtcatactgcccaaggtaatttatagattcagtgctccccataaagctaccattgagtttcttcacagaattagaaaaaaagctacttcaaatttcatatggaaccaaaaaacagcccatatagccaagatggtgctaagcaaaaagaacaaagctggaggtatcacactaccggacttcaaactatactataaggctgcagcaaccaaaacagcatggtactggtaccaaaacagatacatagaccaatggaacagaacagaggcctcagaaataacaccacatatctacaaccatctgatctttgatgaacctaacaaaaacaagcaatggggaaaggattccttatttaataaatggtgttgggaaaactggttcagaaaactgaaactggactcattccttacacctcatataaaaattaagtcaagatggattaaagacttaaacataagccctaaaaccataaaaacccgagaagataacctaggcgataccattcaggacataggcatgggcaaagtcttcatggctaaaacaccaaaagcaatggcaacgaaagccaaaatgccacaaatgggatctaattaaaccaaagagcttctgcacagcaaaagaaactatcagcagagcgaacaggcaacctacagaatgggagaaaatttttgcaatctatccatctgacaaagggctaatatccagaatctacaaggaacttaaacaaatttacaaaaaaaagaaacaacctcatcaaaaaataggcgaaagacatgaacagacacttctcaaaagaagacatttatgcagccaacaaacatatgaaaaaaagctgatcatcactggtcgttagagaaatgcaaatcaaaaccacaatgagataccatctcacgccagttagaatagcgatcattaaaaagtcaggaaacaacatatgttggagaggatatggagaaacaggaatgcttttacactgttggtaggagtgtaaattagttcaacctttgtggaagacagtgtggtgattcctcaaggatctagaaccagaaataccatttaacccagcaatcccattactgggtatatacccaaaggattagaaatcattctactataaagacacatgcacacatatgtttattgcagcattattcacaatagcagagacttggaaccaaccccaaatgcccatcaatgatagactggataaagaaaatgtggcatatatacacatggaatactatgcagccatgaaagagaatgagttcatgtcctttgcagggacatggatgaagttggaaaccatcattctcagcaaactaacacaggaacagaaaaccaaacaccacatgttctcactcataagtgggagttgaatagtgagaacacatggacatagggaggagaaggtcacacgccggggcctgtcggggggtggggggcaaggggagggatagcattaggagaaatacctaatgtagatgacaggttgatgggtgcagcaaaccaccatggcacatgtataccaatgtaacaaaccacgttctgcacatgtattccagaatttaaagtataataaagtgattattgatactgttggaaaaaaaagaatgtaaaagtgttggctaggcatggtggttcacacctataattccaacactttgggaggccgaggcgtcttgagccttacttaatggcctctttcattatgttgcgcaggctagtctcaaatgattcaaattcccaaaagtgagaatcacttgtgcccaggagtttgagactagcctgggcaacataatgagaccccatctctgcaaaagagaaaaaaaaagaaaaagaaaaagaaaattacccagttgtggtggtgcatgtctgtagtcccagctactcaggaggctgaggcggaaggatgacttgagcaagggaggtggagactgcagtgagttgtgattgtgccactgcactccagcctgagcaacagagtgagaccctatctcaaaaaaaaaaaaaaaaaaaaaaagttagtttataaagaagacctggaaccaaaaagtttgagaactggactaaagtaacctaaaatggtaactgtttaaagtaggtagggattcttaatccagggttcccaatactcttatagaaagaaaaaatatttttatatctatatatcttttttttttcactaacctctgaatgaaattcagtgtttctattttgaatgcaggcaacaaaacacagcagtaatattagcagcaactgtgactttgttgccaatagatgttttttcctatatccatatttaaagattgtttcttgaagcaacatatagttaggtcttgcttttttatattgcctttgaattggaatgtttagacaatttgcatttaaggtaatgatgtgatttcctttcaattctaccatcttgccttttgccttgtatttgtcccatttttttctttgcttttttttgcttatttgtttgcatttttcatactttctttttgattgagttgaatttttttttttttttttgacatggagtctcgctctgttgcccagggtggagtgcagtggcataatcttggctcactgcaacctctgtctcctgggtttaagcaattctcctgcctcagcctcccaagtagctgggattacaggcgcctgccaccatgcccagctaatttttatatttttagtagagatgggattttgccatgttggccatgctggtctccgactcctgacctcaggtgatccacccacctcagcctcacaaagtgctgggattataggcgtgagccaccacccctagcctgagttgaattttgtttgttttttagtggttgctctgggacttacaatatacttctttaacatatgagaatttactttcaaaacatactatattacttcatatataatctaaggaccttaagtattctatttctctctcttctactattgtaatatattttacttctacatgtaaaccctgtgattgttaccatttttgatttaagtggtgaaattacttttgtggctgggtgtgctggctcatgcctgtaatcccagcactttgggaggccaaggtgggaggagcctttgagcccaggagtttgagaccagcctaggtaacatagtgagactctgtgtctacaaaaaaaattagaaacattagccaagtgtggtggtgcactcctgtagtgccagctgctcaggaggctgaggtgggaggattgcgtgagcctaggagcttgggatcttgggtgagctatgatcacaccgctgtattccttgtactccagcctgggcaacagagtgagaccctgtctcaaaaaaaaaaaaaaaaaaaaaaagacttgttcacgatttaaatgtatgctggtgaactttttgcctccagctttttttttttttttcctgcccccaccaggaggataaggtctgggaaaaatcttttactttcatttcttcaacatatattcattgtatttatcgttgtaggttgaccagttttttctttgttttatagatgttctattttcttgtcttgcatagcttcacaagaagtctgtgtgtgtgtgtgtgtgtgtgtgtgtgtgtgtgtatatatatttttttctttctttcttttttttttttttgagacggagtcttgctctgttgcccaggctgcagtgctgtggtgcaatctcggctcactgtaagcactgcctcccaggttcaagcgattctcctgcttccgcctcccaagtagctgagacgacaggctcacaccaccacgcccagctaattttttgtactttagtagagacggggtttcgccgtgttgcccaggctggttgcgaactcctgagctcaggcaatttgcccaccttggcctccgaaagtgctgggattacagacgtgagccaccgtgcctggccaaagtctgtatattttaactttgtttctatctaaattttttccctctggcttcttgtaagattttctggttttgacagcttttcaggaatttgattattgtgcctcgttgtggttttctttgtgtttatactccttcaggaggggggctcattgagttacttggatgtgtagatgggtttttgtttttgtttttttttttttgtttttttttttgtttttttgttttgtttttgagacagggtctcactctatcgcccaggcaggagtgcagtgggacaatcacagatcactgcaacctctgccttccgagctcaaggggttctcctacctcagcctcccaagtagctgggaccataggcacatgccaccacgctcagctaattttttgtatttttggtagagatgaagtttcaccatattatccaggctggtctctaattcctggcctcaagtgatctgcccatcttggcctcccaaagtgctgggattacaggcataagctactgcacctggccagatatatcagttttatcaaatttcgaaaatgtcattatttcttcaaatgcactgctccccattccagttacatatatattatactgcttgatagcttggtattgtcctgtagttctagtcttttttttttctttttcttttctttcttattacacccctaacccttctacccttgcttctttcttccctctctcctgtctccctttccccttctcttctttcctcttattctcatcacatttgaactttgtttaaatttgtgtattttctgttgctgtgtcttcagatcccctgaactttccttctgcagtatttaatatattgttaataccctccagtgatatttctatttcacatactgtttttgaatactgtaagttcttcttggttcttattatatgtgtgccattttcttcctcatttttttctttaaatttttgagcgtatttataatagccgttttagagtcctcattggctaatttcatcatctcgtttctgggatggtttcagctgatttatttcactctggtttcaggtccctttttttttgagacgcagtctcgctctgtcgcccaggctggagtgcagtggcgcgatctcagctcactgcaagctccgtctcccgggttcacaccgttctcctgcctcagcctcccaagtagctgggaccacaggcacccgccacccgccaccacgcccggctaattttttgtacatttagtagagatggggtttcaccatggtagccaggatggtctcgatctcctgacctcgtgatccacccgcctcgacctcccaaagtgctgggattacaggcgtgagccactgcgcccggcctcaggtcacattttctttcttcacatttctattaattttttattggatgctggacattgttaattttatatggttgagtggtggaattttttttttctgcttcttttaaagaattttggactttgttcagacaagtggttgagttacacgtggatcaactccatccttttgagccttgttttaagctttgttaggaagcatctagaatatcatttactctagagcttatttagctttgctactaagataagagtcttttgaggtttctactgaattcctagtttttcaacaaggaagacttctagtcagaaccatatgactctgggaattgttccacctgtaaatctctatttattctttgccttaccttttgaagttagtctgtgtgctgggcttggccacagactcaagtgaatccttctgcagatttctggaattttatatgcttagcttccacttctctggcccacttccaagctctgcttgagttctttctcccttcaccacagtctgaaaaatgcctctaggcagaaagccagggcagtgttaggtctcacttcatttcttttgcatctcagaaatcacagtcctacactgcttattatccaatatctaaaaagagttttatatttttttgttcactgttctggctgttattgtgggttgaaaagtctgtttctagttattccaccgtggccactgaaaattatttcctgtttttataccttttaagataatcatggagacaaaaaataaagtttacgttccttttattttctctggctatttgggccttatggcgtatattgctaataactgcctatagtgtttagcaatttcatctgatctcctgttcacatctttaattattttcaagatgacattttaaatggttcagctataatacaataatgaacaaaatagtatagaattactgtaggatattttaaacaaataaaatagcatgtacattatattaaagctcatgagtgaatgtttttaaacagtacataagttgtttaaatgatagctttgcaaagaattgggtttatcattgtagtcataaggttatcaactgttggatttaatcatcttgttttctaatcaaagatttttagaagtaatatgaacataattgatgcctagtcaaagatgatcttcggtgaattaaaatatctgaaagtaatcctataaacttatgttaaaatctgtatggattttgccatgtagcttctgttgtccctttgatagtcttacaaggaaaaaaacaaaacaaactcctatgtttgatgcagtagtgtacattattagactgttagcatgtttcttaatctttgatttttttgtttgtttttcagatcgtcagtatttaaacagatcacatcatgcgtgagtacaagctagtggtccttggttcaggaggcgttgggaagtctgctctggtaagttagccacctaactgtaactgattaatataatacaagaagaattttgacatttccttgctttcagacttctagatgccaaagagaaaaggtggcattattatatatctgatatctgtcccacaaaggacaggaaatcatttaataaccacagatgtatatagttttataacattggctcatttattcttatatttaccaaatatttattggctatcttatatgtcaagcaccagtgttgatgatgcagagaggagtaagattgttctctttttaaggaatttacattgtattgggggaaactgattattacagattctagtgggataattcctcacctgcttccaccctagacttagatggaatgaaggtcattttttgtgttcatgctgtttttatttagtacatagttactgagtttctatagtgtcagattctagggtcacaacagtgaatgaaaacagtcatagtttcttatggagcttgcattatagtggaggagatgtaataaatacacaaagaactacttggttctacttgtgagcgagatactctgaaagaaaaatacagattaatttagaagaaaggcagagtggatgtgggagacaaattgggagttaatactgtataccagataattgtttatggaagcttggattaggaccatggcagttaagaaaagagaagtaaatgtttgaggattgagtaagtggtagaactgacataacttggtgctagattgatatggggactaggagagaaggagctgtcaaggatggctcccaagtttctagtttgagctactaattttatggatggattaaaagaagaagggaaacagtggagaaggagcagtgagagtccaaatcaaagagtcatgtcaaattttatgtttgtgacatgttgaagtaataaaaaagagaggccggtgatatgattttgggtgccatcaatatggtgatgatatttaatttcatgagagttacattgctgttaggcatgtaagtcagtacctctgtcaagaatgtttgagaatatctgtcatttttaatggcatataactttcaattcagcgattccctctctaaaaatgtagcccacatataagttcacatgtgcaaaatggtgtggtcagggaacatcacaacattctttacagtgactagagtctggaaacaacctaaatgtattccattaaggggctagttaagtaaattttaatacattttcagagtagaatacagccattagaatgcaatagctctatatataccgatatgtaatgatatccaagatacattattagagagaaaaaaggtactaaacagtgtagactataatttgtgttttatatttaaaaaaatgtaggctgagggtagatacctgtaaaatcatagagtatctcttcaaggttaaataagctatgaataacatcagttactttcttgggagtaggattggatagctgggaacaagggtggtagataagcttagttatcactgcatagccttttgtgcctttttgaatttagtcctatgtccatgaattaccttttcaaaaataattttggaaaaagtccataggagtgaaagaggtctagggagatactagagagagaagagcagagcccaggactgagctctgagtacctctcaacctttagaaagtagataggattggaggatctagcatagaagaaggtgtctttacttgattcctcaaaagtcaagtaaaaaagaggaaagagatgatcagagagcatagaggcagttggacatgataaaggaagcagctttagtcaggtcatgttgccataaccataatggggtgggttgaagattaaatgagagctgaggaaatggaatatagacatttgaagaagcttgattatgagaggggacagagaatgggggcagaagctggagagatattggggttaagggaggtttttgtttttgttttagaattggagatagtaaagcatatttgtatgctgggggcaattcctctccactggagaggaaaataaggatacaggagagggaaagaggagatgatccagtacaaaaacctgaggaataaaattataatctatgtgaatgaatgaatgagatgtccctgaaaattaagacagaggataagattcagaggagtagtcaaacattacttttagtaagaaagaaatgagaaacgttggattgttttgcatttttgcaagtcttattaatgtctggcttatagaaggcacatgggctcttttgcctgcttctgtatccagtctctttcaatagcacatgttctataccctttggaagattccactgtaaacttatgagagaagaagaagagtacctcttagaatacatcttagtattgttaggaagatagtttgaccttagggagcctctgccttggaccatattttgagactctctgctctagcctaaagcatattaggaagctgtattagactgccttttttttttttttaaatcttgaatcagcatcttgccctggagtgcagtggcgtgatcatggctcactgcatcttcaacctcctacacttaagcaatcctcccaccttagctacccaagtagctgggactacaggtgcatgccaccacacctggttaaatttttaaattttttgtagagacagtctcactatgttgcccaggttggtttcaaattcctgagctcaagcaatcctcctgccttggcctcctaaagtgctaggagtacagcatgagccactgcatccagcgtagactgctttgtatatttaaattatgtgtcgtacttagaagatgaggtgattaaatccttgataaaaatcatgattaaggtttttggtgtgattatatcttgagttgcctttgaataatagaagcttagtaggagaaagaagtttgtttactatatttgagttaatctctttagctcaagctaaaatagtatatcaaatattcctctgagtaatttaagtgtagatgacctcagtccacattcttacccttgctttttaggcaataatgtaccagaccctgttttaaagttacctaggaaatatcttaaaaccgtcttctgtacttttttcacttactgaatgataaatacgtattttctagtatgtgcttttggatgcctttaaaagttgataatatctgaaaaagatgaatgggcaatattttccaatggaaaaagtaaggctttggaatcaggaagatgtatgtttgaatctcagctggcaaataggaagaataactatttctgggacaaatgtgaaatttgaatgtggttataaattaaaagtgactagcttaatgtctggaacataatagacattcagtaagtttaaatttccctttctcttttccaccacaatttagaaaggctttaacaaatttacaagatgctgcttgaggtccagctacctgggaggctgaggcgggaggatctcttgagttcaggagttcaaggccagcccaggcaacatagcaaagaccctgtgtttaaaaaaaaattagaacctttgtcactccattaagggcagagggcatgggataaaagttactatagatatataaaggggcaataggagtttaaatattgataatttttcatgttttaattagttcagatatgttatttgtatccttgtatattaagacttaatgtaattaacagtgtattatcagtattgatgacagtttttaacatgactacctcctttcataataaatgtactcttagttatggatgtatccttatattgaaagaattaataatatactttacatttacgtgtttacccagaattttcacataatttcaattaatcattataatttgtaggttaagtaacattcaaaggagttttcctttaattttttaatatttctctttttttttcccccagacagttcagtttgttcagggaatttttgttgaaaaatatgacccaacgatagaagattcctacagaaaggtaaaatgtgaaacttgtacacacatgcttacaagtagttccttatgatgttaaaatttgatctgtagatttgctttttgaaaatagttttgagaaataatacaaatattgtgcatctgtttttaaaagtttcatcaagacagaacatttcttaacagaatactactttgatattcagagctctatgttctgttactgattagtgacttgttccttaatgtggacattttcctggtggggaatgttgccacatatgaaaaaattgcatataaatagtaggtgtgttttcaacttactcttttgttaccaacaattaagaccacctttatgcttgaagttatccagtgactgaacatttttatttttgtttagttttataagtttaaagatatctttagactaccaaaaaattagagtctgtgtaatactataattgggttatatgccatacatttgtcaaaacccatagaatgtaccatgccaaaagaaaatcctaatgtaaactgtggactcttggtgataacgatgtgttcatgtgggttcatcagttgtaacaaatgtaccactctggtgcaggatgttgatggtggggtgaggctatgcatttgtggtggcaaggagtatgtgggaaatctctgcaccttcccctcagttttgctgtgaaactaaaactgctctaataaagtctatttaaaagggaaaaaaaattaggtacttggtcttgacaaaaaatattctgtagaagaccagccagagttgtggaaaattttcagtattttctatgtcaaatatattgggtggggtggaggttataaaaggctagtagccaagaatattttttaaaaagattaaactttaataggaaaggattgcttttgaagacatttttagaatttacctttaatagtgctgtaacttttgttgaattaatttgttagttcatgaaggactactagtagagcagtttcattgtcttcaaattggaaacagaattatgctctagatacatcaagaaactatagtcctaattgattattcactgaacattcccagttacaaattttgcagattatcacacttgtcccataagtggtggggtggatgagtttgtggtctgaccagtggtgcccctcatcaatgtctgatctgacacagaagcagagtttaaaatagtctttaggttagcacatttatttttagaagacagtgttgctctactgaaatttccccaaagtaagttgctagttaaagctttaactgcaaagcaagatctgtacctaaaattctaagggactaacttttcttaatcccttctttattaaaacagttttccacacagttgatagttgatactttcattagaccaaccttcttttcttttataagaccaatgggtaaatagaactcagtgtataaaatttcacctttcacatagagcttttctagaaaagtgcctttttcttgaggcactgttttagctcattgctgtttattttagtactcctgtgtttcttttatgtcttaaactcagattttactgtgtatttaattttctgcatattttagtaaaattttaacaacttgaacatggtaagttggcaagattttctttaccccaaaatgttgtgcgcattttgagccatttaatatttttgtactttgttttctttggagataatataaatacacatatgtacttttttttctgttagaactatacttgttcgttgaagttttccttaaatttcaaaatatgacttttgccttttctaataacaaataagaatcgttacagaggtcagaaaatatctaaactcagcattaaccatcttggcttctgtaatatgaatagactgtacttgagaccgctgttctttattgtggtaccaagtttacccccagccattacagcatactgctggagacaggctttgtatttgttaatagttactttgatggaagaggtgggaagaaaacagaatgagattttgatgttactctttaaccttttttttttttttgcccccacagcaagttgaagtcgattgccaacagtgtatgctcgaaatcctggatactgcagggacagtaaggatgttttctctttttttgatagattttaatttgtgagcaggttttgtcatctgagtaggttttgtcatccagataattctgagtaaaagtaatcattctgattaagaagaaattctctgaacatagggattcttaagtatatgaaatcaactctgatgtagttcatgctcacatatcacaaagttcacctgtaataatctgtgtgttgggtttcttcctacattgaggtaaggattatgctgtcagtgattttttaaaatttattttaaatttagagctttagttaatatttgtatttctatgggtttaaataagaccttgtctcttggcaccatagtcattaatttttataattttttcttttcactagcattttgacatctcaaggggctggtgacagatacatgttttctgaggaaggcaaaaatcttcctcagaagatttagaattattttgagcctcctttttctaatctttaaatgagtataatgatgttagtacatcataaggtgtttgtgataagcaaatgagttaataattataaatcattaggcataatgtctgttacacagtatggaattgtgtatttgcttttattcttcttcattaataccatcacctttataatttttattaataactgatggtttccagttatactgccacataaaatacatacattaagcaatctttgcttttctttgtttatttttctccatgcacatagacttgacacattaggcaattcttagctttaaaatggatgggttcgttttttgttttgcttaagagacgaggtcttgctctgtcacctaggctagggtgtagtggtgcaatcatagttcaccgcagtctcctgggctcaaacagtcttcctgcctcagcctcctgggtagctagaattaaaggcacgtaccaccacccccagctaataaaaaaattttttttgtagaggtggtttcgctgtgttgcccaggctaatctcgaactcctgacctcaagtgttcttcctggctctgcttctgaaagtgctgggattataggtgtgagccatggcacctggctggcatttttaaatgtgataagttgtttaaaattcagcacaaagttttccactataatttttataaatgatggaaacatttcagatagttcaaaaaagcatgtaagcaaattggagtgattttatacaacaatatagtactaattatactgtatttttccattcttttttgggaaaatggcttaactcttatcagggacctttgccctcacaacaagcttctggtaaagaccttctgaaactacattttctatcagctgaatcaagctatctctccctctcccaccctcctgctctctaatgtttttagcttctgaatcagcagaattcccctttgtttccagagaccctaatagctaaaatgaatactttctgctttttttttttttaaatcacatccacagtgtacgggcattcttctttctctgtccagattgtaagaaggaagttctctatcacagagatctttactttgtgctatccaatatcgtgtctgtctcccatctagcactcaacacgctgtgttataaggcctatttgcttgtttgtgtccccagtaccttgcataaaaccttacaaacagctgcataatcttgtctcaaaatcactccttacactttgaagatttttgctttctctctttcacatacactgattcaatcagaattcttagtgattttactatccatatagaatctatatggatattataaatgatttactaccctggcttggcctgtcatttccttgatgtccatcctacctttaaggcattcataccatggttttactctaggctatgtgattaccaataagtataatacctctctaatctaatttccaagcatcttatcctccattactcactacttttttctttatccatctcacttcctcttttttttttttttttgaaacagggtctctctctgtcacccaggctggagtgcagtggtgtgaacacagatcactgcagcttcaacctcccagggtcaagaaatcctcccaccataacctcctgaggagctggtgctactgcaggtgcataccaccacacctagcttttttttttttttaattttttgtagagacagggtctcactatattgtccaagctggtcttgaactggactcaagggatcctcctgtctttggcctcccaaagtgctgggataacaggtgtgagccactgcacccaggccatctcatttcctttagtgcccttcaacttcgttacaacctgtagtccatttatcctaacatctttttattatcccttatatcttcaaccccctctgcatatagcttcaggtccacggtccatcatttataattctcttgaatatatcctcaactcccttgacttttcagcagcctttgactcagtttatcattgctttctaatgtaaaacctttattcatttggcttccaagaaacaatacttgcctgatttcctctgtctcattggttactcctaagtctcctttcctaattcctctttatctcccctacctcttaatgttggaggacctcagggttcaatacttgcacttctctttcctaacaacactgctttggagatcttgtagttgcttggttttaaatacaatctgtatgctgataaatactaactttgtaaccctgtctgtattaggccgtttgcattattgtaaagaaatacctgaggctggataatttatgaagaaaagaggtttaattggctcatggttctgcaggctatacaagcatagctccagcatctgcttctggtgaacacctcaggaagcttacaatcatagtgaaaggcaaagaggagtaggtgttttacatggcaagagcaaagagtgagcgggagatgccacacacttttaaacaaccagatctcacgagaactcataattgtgaggatagcaccaagctattcatgagggatccacctccatgacccaaatacctcccacaggcctcacctccaacactggggattacatttcagcataaggtttggaggtgacaaacatccaaacaatatccctatctctcatttcttttctgaacttcgagctcttatatctaactgcctcttcaatatctctttttgtatgtcttataagcatctcaaatataacatgtccaaactgaactcctgataacctttccctgacctgggtctttccagtctttcccatctcagtaaatagtacctttttagttggttatgcctgaaaccatggagtcgtccttgactgtattttttgttatattatgtgtacatccaaactctcagaaaaccctactggctttaccttaaaaacttacccagaactcagctaccaccactagaatctaatgacactatcttggtctaaacagttgtcatctctcagctggattatttcaataacctcaaaactgatctccctgcttctcttcttcacccccttcagattgttctccacacagtaaccatcataattccatttaaatgtaagtcagatcatgttttcctcagcttaaattatgcattaaactcagagtaaaagcccaggtctttattacatttccctgaaaggtccaaatgagaatcctctctctttgtcccttctctggcccccactgctatactcacccactaggtaacaatgtttcaatgaatccagcctccttacagcttctcatacactttagacatgtttccctttggggcctttgcatttgctctttcctgtgcttggggtagtcttcctccacataaccatagagcttattccctcacctccctcacatggttgctcaaatgttacccgtgaggccttccctgagcatagtcttttaaaatataactttatattcctaccctcaaaataaactcccaacctttacttttctctataacatttattaccatcttgcatacttgatttttgtctgtctccatgtatactcctccagggcagaaatttttgcctctcatgatcactaacatatccatagggctacaactatgtcagtggatatttgttgtgaatggatgaaacttgtagaatgtccttaagaaggaggttggcattctcaataggagggaacaccaaccacagcagttctgtaaggacttttcttaaactggattttcagaactcaggttgcctgtatgtttattcttttgatttaataagaagcagagaccatgatctctagagaacatcatagaaatagtgttgctagtatttgtagcacttaacatttgtaagtaaactcatttattatataaacatttggacagtggcagaatttaattggttaccatagtggtgcaattctggaatatgcaaactttatcaatgaaaaatccaggaaacttccagtttttacatctttcccagaaaatacactggcagcagtataggaagctcagccatgttcctgtggcacaccttagacgaatttgaagctggggaaatggctgagtggtagcatagctaactccctggaatacaagaaagagtacatcagccagggtagaacaaccagaactattttagatgtagtagacaaaatagaggtagtggtcatggggaacaaggaagccaaggcacaacaagcttaagaaactttgtggatttatcttttacgtttaatgcatccagaggtaaaaagatccaaactgtatagttatttaatataaagacccaagacatacacatttttaatattctgccatatgtgctttttaagtaatatatatatataataccaaaacttttctaaaagaagattttgtcttatattaacctccatagttacaacataaagtaatgattgtcaccaaataaaaggaagtttaaaattaagtaattttaatttggcatgactaaagctcagtaactaaatgttaaccattagtaaatttaactaaaggggatagatagtcattgcactattctcacatcttttctaaaggtttggaatgagggggaaaatgaaaatacatgaacaagctcttttttttttttttccgagacagagtttcactcttgttgcccaggcttgagtgcagtggtgcgatgttggctcactgcaacctccacctcccgggttcaagtgattcttcttccaccaagtagctgggactacaggtgtgcaccactacgcccggctaatgttgtatttttagtagaggcagggtttcactgtgttggccaggctagtcttgaactcctgacctggggtgatacacctgccttggccttccaaagtgttggtattacaggtgtgagtcattgcccctgaccattaacaagctcttataaagagtttattgactgtcaagatgataaaaatattgctatgccatgggaatagaaaaagaaagatgataaaatctgccagtagagatattgattctggatgatgaagtcatagtttagtattgggcttatacctcagattgttagcacttgggcagtagttgtgtcataaatttgcaaataaaattatttaggatcaaaagatctgtttctaaaaaattatatacagctctaaatcacacaaaagcaaattaaagtggttaagaattcctttttaattctagtttactgtcattgtttctagtcacctcagttgctagaaacttgtgttatgtcttgttttctgtcaggatagcaagtaataaaaaatgttactcacttgtaattatgctgttttaaattgttgcagtatacattcaagaaatttatatatttataattgcatattttttaaatcataggagcaatttacagcaatgagggatttgtatatgaagaacggccaaggttttgcactagtatattctattacagctcagtccacgtttaacgacttacaggacctgagggaacagattttacgggttaaggacacggaagatgtaagtattttttctctctgtaagatgttatgccatctctctgtggccaaataaaaaagtgcctgttttctctattagtagaggatttggaagctatctaccacatgcctgaaagagcccctgtgaccaaaagaaaaaaatttaactttcaaaattaacctcaaaattatgtggtgagatgtttagaaaatgaggacatatgtgataaagtactcattgtgctataggttaaaaagtgcagtagaggaaaaagaggagccaaagaatacttcatagaagtgggacctgagttgagctttgaaaggtgatggttgtgtcagaaacagtgttcaaagaacattattaagatccatagtggtgtgtttttatttctaaaattccattggtataattcacacatcacagtctacctcccgggctcaagtgatcttcccacctcaaccccctgagtagttgggactacaggtgtgtgccaccctgcctggctgattgtttttgaattttttagtagagaccaggtctcactatgttacccaggcttgtctcaggctcctgagctcaagcagtcctcctacctcagcctccctgggattacaggcatgaaccattgtgcctggccaggattatattcttaaaataatttggcatatctatgtagtaggatctcttccattttttttttttttttgtctcttccttcttccttcgcctcttcccctcaacatatacttttcgttagtatttgatgaagcttgcggtcccaactaatgcatttcagttggtggcagataattgcttatttatttttttaaaaggctaagtaatgagtatgttattgttcattttacgtttttttcttcccacaggttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgaggtaacctacaactgctgggcagcacaaacaagtgcctttttagtttgctttaagttaacagccagacttttaagaaaaaatttttatcttttaagcaatcttgattccataattttataggaaacactaagtaattcctggaaactatattttttagcttgcataaggtcactttgatggctgtatgaggatacttaaatttaccttattgtaaaagaggaagctaaaattgaagaatgtgtgtaaaatcctgctaagcctctaagtgatatgcgataaagtggtgtgtaaaaattgttacatcaccttatattgtaataattatttacccaaatgtatataaataggttgtaaagtcaagttggaaaataatatgtttttatggatatcacagaattgtgttctgagtcttacctcacctttggtgcatgactcataagtgggtaatctgtgtgggtatggacatgtacctggaattcactcagtcctttaggcctgatacagctgatgcacaaggcttttgtgtggggcatgggggtggggtcactgggttaagcactccactatcttgaaaacagctgtggacaagaatacttagcaaataagctgcatgcctgggtgtaaagggccaacagtttactagtttactgggcccctaaaaatttagagcaatttccaactgtccccaccagtcaaccttaaatagttcccttgcttttgttaaccttaacataagccttttaaaaaaataaaaacaacagagtgggcttctttcctgccgttgcttttgccatttgtagcattacaggtaatcagtcagaattcagatcacttaactacataggtgagagtgagagtgggttaagttatgagtcctctgtttttgctattctctctggcctgtggttctgctggccactttttcttgactaatattatgcttatagactatttgacttttaaaaatgaccaggttactttaaacacctggcaggtaaaaaaaaattaagcttgcttcaacttctgtattttacagataatcaagaatgccaaagcttgtttttttatgtgaaaccatttttaacaagtacataaaaacaagaaatttataaattgtatttattcagcaaatatttattgactattgtgtgtctggcactgtgtcaggccctcaggtaacagtcactcagacagacactattcctgccctgaagaagtttgcatcctactgggggaacaagtctttcagcaataattaaagaaaaaaagtgattttgataaagaatttgttagaaattgtgaatatgtttggctagcagaacagtgacatgaggtcactatctacaagataattggccttacgggatgtggttccttgctgtccttgtccttacctccatgggacccaccaaccaagttcatcagactccaggctccggtggggctgggttgggcctgagtccagtgcataggacttctccctttgggagccagaggacagtacactacatgtttgtgagaacctacatgctattaaacttcctctggattagtttccaatgcagcagagatactttttcatagcagtcttgttaaagcagagagtttataaacgagggtttataaaaacaaacatagaaaaaccataaaatgaaatgcattagccatctcaagaatctttactttttggaaaacatacaaactttatgctcagttcttgagagtggggagaatggagcagataatttgagtttcttttaatatttttctctttataacccaataatccagctacaggatttctttggtagttaatagttcctcacacaacttttgccttgtaaatttttttgtgagttttgaatgcctgaagtatagagagatactttcaaaaattcacctcttggccttaaatttgaaaacagacaccaggacatactgcttggctaaagagccccctaattcattcatatatatatatatataatttttcaaaaactcttattcacaccactttgcaacgttcttaaagtagtatatggctatgccagaatcacagtagtcttaatcaagaattaattgttctttgctgaggctggaatagtaattggaatcaagacaacccaatttaggaatgggagagggattgagaaactctattctgtgttccctttagatttttctatagttcagagagatgaggaagaacctaggctggggcctttcagcatttctaaccaaatattatagttcgaacttgccctcatcactgaaccatctgctgctgtgaggtaggcaatgttttccaaagaaataatttagaataatactacaagcattagttacctttctatatagtaccagaaaccagaaactggctagtatgaagaaactgaaatagaaactacttgtaatttttattaacttactgttttagtttacttttattatttttttatcttatagcttatgcattgagtatagggaactaatgaaaactcatttgtggcttaagcacattgagttcttgaagttttcagagttttgaaacaacttggacttcggagttgtaaaacagaaactacaattttgtttataaattctgttttcagactttctttagaaataagatgacagagagttaaatgatttgaagaggatgggagtgggaagaatggagcagaaagaaaagaatttaaatgagtcacttttgtagcttttggataaatcattcaggtttttttttaacggttaatttagtcttgtagtctggaccatttaaaaaaggaaataggtaattatcattttaaagaaatacaattatttgccatctatcttaaaatacatgtagaccgataatttaaaaatattttactcttaaaatgtactcaaatgatgtaagaacaataaagaagaatttgtttacccttcatcagattcacccattattaaaattttgccacttgtttacagaaattacacttctttacccctaaatattttagtgtatgtatcctcagatcaaagacattgtcttacacaaccacagcacaatgattagaatcctaaaaattgatgacacagtctgtgtttggtatatattcagattttaccagttgtccctgtaatgctccttaaagccagtccattttttaatatactgcaaagaattatttattccagattagtatcaataagggacttctgtgatatttgtttttattccaaatcattagtaagtgttgtatttcatagcaaagcttatctgtttcatgttttaatactttggcatcagaattaaaatagtctgcttttatgagataagtagcattgtatttttgtctttgatactttgcacttttcatccaaaaatgaatccacaagatgtattaacaaacattatttgggctgggcacagtggctcacacctaaaatcttagcactttgggaggctgaggcagccagatcacttgacctcagatgtttgagaccagcctggacaacattgcaaaacccttgtctgtacgaaaaatacaaaaattagctgggtgtcgtggtgcacgctgtagctcccagccgttcgggaggctgagatggaaggatcacttgagcctgggaagtggaagttgcagtgagctgattgcaccactgcactccagcctgcgtgacagagcaagactctgtctcaaaacaaaacaaacaaactaaaaaccacaaatatttgttatttcaaatcaaggattagcagactttttctactttttacgtttaaccaaaattaacatcaaaaaaaggcaaacaaaaatcatgcgcctccgcatgtgataccttgaaagggagacagtatctcttttgtcctattttagacaaaaatgtatataacctgaatctaatcacgagaaaacctcagataaacccaaatcaagggaagttactagcctttatttttcagaaatgacaatgtcctgaaaggcaaaggccaaagaactgttccagatttttaaaaactaaagtgagaggaaataaactgcaatgtgtgatcctgaatggatcctgtccttggaggggaaagttactataaagtacattattggggcagttgacaaaattggaatttgctctgtagttatacaaaataatgtgtcaatccttaaatgtctcaagtgcaataactataacgtgtttatgtaagagaatatccttgttcttaggaacaacttaactgttaaaggacttaatagttaaggtctactctcagatgattcagaaagtgtgtgtgtgtgcacgtgtgtgtgtatgtatgtgtagtaaaagtggcaaaatgttactaattggtgaatctgggaagaatagaaccgaagttgttggtactatttttgcaacttttccgttggtttggagttttcactatttttcactaccagttctttttcttgatttgatgtcgaatatctaggagcaagggcatttccttcattataaataggtaagtcctgctttctaccctgattgaaagtcagcagagccttctaacaaacctgactttaaaagaaagaagcagaatgcagatctaagaccagaatagtacttaccagaattgttttgtggaacaaagtctcaaaaactggtggagtaagtactttttttcttgtttttacttagatattttatgacctggtcagacagataaataggaaaacaccagtggaaaagaagaagcctaaaaagaaatcatgtctgctgctctaggcccatagtcagcagcagctctgagccaggtaagatgctaaaagcagaacaagtgcctttctcatgctcctattttggctttttccagactttagctacttcccatttcatctgttatggtatttctaagcttctgtaacttgtaaatgtgatatataacttgtaggtacgtcatctgttggataacttgccctctccccttgagattctaagctctctgacagcagggaccatttctgttttttcttgccactgtgtccccagtgcttgatacagagttgggttttaaaaaatagtagttgaatgaatagaacgccttcctagatgactcccaaattcattcttaattgaagtgaaacagtagttgctctgaaaaagtttaagtgcacatttggtgaattatcccaaagtgacatacccgtatataacaacaagagtcacccttccccaaattaaattaaaactctgccctgatttctaactccatggattagttttgcctctctttgaactttacataaacaaaaacgtagtgtatttcctgtgtctggcttcttgcactccaaaatatgtttttgagaattatttatgttaaatgtatcagtagttcatttttattgcatgacagtactggcagtatgtttatgtattcttctgttggtgttcatttaagttctttctttgggggaattagtatgaataattctgtgcacattcctatatgtctttgtgcacatgtacatgcatttctgttgggtatatatctaagaatggaatggccagatcatatactatacatatggacagctttagtagatactgctaaaaagtttttcaaagtggctgtaccagtttacacaccctgcaacggtttttgagttctacattctccccaaaattgatattgtcagtcttcttaacttgacccattccaggagatgtgtggtggtgtatcagtgtaattttggtagttatttccctctctggtatgagtcaacttctttcaaataaaggttttctatttgggcttctaagtattagttgactttaccattttagtttccactaagtgaccccattggaaagaaatttatgacagcatttaagctgactctcaagtgagaaaccaggatctatggggacttttttctttaatttgtattgtatttaaatcccctgaaggtttctacttaatcagttctataaataataccataaaagattattttcatggagtggatttattacataatttggtgcttattacatgattattactaaacttggtctccagttggagtaaactggtcccactggaaagttggttacactaactcttgtaagtctcttggtctatttagtagattatcccttaagagctcccaattaactactgtgtgcttccttagagatatgaatctctctattaagggaaacacctgagtaattgtagttccttttttaaatgaaggtacatagaggaaaaatgggcagaaaggagaaaagggcctagggattatctctggtagtcagatttaggaaagacagcatctggctaatgtttgctttaggcttttaatgaaatcttaattcaataactttttttcttttttttgagacggagtctcgccttgtcacccaggctggagtacagtggcacactctgctcactgcaacctctgcctccctgggttcaagctattctcctgcctcaacctcctgagtagctgggacttcaggtgtgcaccaccatgcctggctaatttttgtatttttagtagagacaaggtttcatcacattggcctggctggtctcaaactcctgacctcaggtgatccgatccacctgcctcgacctcccaaagtgctgggattacaggcgtgagccaccgcgcctggccttgattctataactttaaatcatcagttccctgaaagtgattattaagattactggtgtatgtatttgtttaggtaaaggtgcaaagatagagaaaatgaagactccagttccagttcttaaatactatattatttaactctgttatagttgactggcttattgacagctcattaccatggctggccctaatttaatttccagttctcacaaaatatccttttagcttatgttaaaggaaaaggtgccatctcctggcctattacgatttttaaaattcatttatacacacccaacaatgtgacagtcccttgtgagttttaccttagagaagataaatcttgacctagatctggaataagactttagtcttgcttgcataaattcttagactctgatgtgtgataaagtttacttaataagtcatccaagatctctgtggatgtttgataataccaaataataggtgacttagcaatcagactgctttgcatacattttagtgtgattgtagatttgaagtgccatgttgttcctgtacttttaaaagtactgagatacaggatagatttaaatagaaattataaacgtttttagtaagagtacatgaactctgaggccaccttatctagtccatagcctttaggcaaaattgtattgaatcatgttaatctcctttttatatgtcccagttttaaagacatctgagagaaattcatcatgtggattattttacctgattcttgtctgttgacaataagactaactttgattcttctgctcttgactatggggattagctctttctgtatcatcccttgccttaacctgtattagaaatggtaattctaatatataatcataaaatgcttgaataaagaatatcttatggaaagtttatggaggcaggtgtgtccttcagtaaaaaaggaaagtaaaaataagatggtaatgagatagaataaaaatatcattgtcttcctttgtacagacaggattgtcagatgtaatgggaaacactataattgagtataactaagtataactgaggataattcaagttgatcagttatagactcctcttgtaaacttctatttttgattttttaaaacatttttaaagggaatttaaaatagcactgttactgtagctgtttagcataatttagttctcaagttatgatcagctaaaatcattatttttttattttattgaatacctgcttgtttagtaccattttctgacatcaagagattaaccatacatatatgtatatctgtatccaatgtcttagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttc

SEQ ID NO: 36145 - DNA, 11495 bp, Homo sapiens
ttggtctaagacatgggctgacaaactttttccataaagggccagaaagtaaatatttcaggctttgtgggatatctatttatgatttattttactcctagtattatttcatcttttatacaggttattaaggttagtattgctgcataacaaattactccaaaatttaatcatttatattcaagaagagttcagctgctaggttcttattttgggactctcatgatgctgaggtcaagatgccagctggaggccaggcgccgcagctcacgcctgtaatcccagcgttttgggaggccagggtgagtagatcacctgaggtcaggagtttgaggccagcctggccaacatggtgaaaccccgtctctgctaaaaatataaaaattagcctggtgtggtggcatgcccctataatcccagctactcaggaggctgaagcaggagaatcgtttgaacccaggaggtggaggttgcagtgagctgatattgcaccactgcactccagcctgggtgacagagcgagactgtctcaatcaatcaatcagtcaataaaatatgtcatctaggacagcaatcatctttaagttggactaggatggaaatccaagagggctcactaagagggatggcagttattgctggcttttggattacaacacagctggagctgtcaatcaaagagcaaatatatggccttttcagcatggtggtttcagggtaggaagaattgttacatggcagctgcttctccaagagtgaatattccaaaaatgccaggcagatctttgtggggtgttttgacctaacctcaaaagtcacacaaagtgatttacactgtattatactgatcaaaatagtcgcagggcctcccaaattcaaaaggaagagacaaagtccacatctgtcaatgcgaagaatggaaaggtcacatatcatatgtggagcgggacataacaacttcggaaattaaatctcttccccaggtaaataaatggatgcaatatgcatatagatattcaatagatcaatgttgttaatagtaaaagtatggaacatttctaatgctaatcaatggagaattgattaaataaactttggtaactctaaagagtagaatattatgcaaccattaaaatgtataaggtagtcctatgtagactgacatgggaatgttctgaagatatagttttaagtgaaagaatcaagtagcagaacagtatatacagtacaatttcattaaatatacaaattgtatatgaaataagcatagaaaaatttagtaaaatatagcatacaaccccaccctctacattatatgtatgtttgattttctgtagtttttataattaacaacatagtaaacatttagctacatatatcaataaatcttaaaattctcataacttttgatccattaattcaagttcttagaataaatccaaataaaataatcaaggaaatgtactaacatataaatattaaaacatgcataatagagaaaaattatgtgactttaattcaatccattatagtgaaaatctgcatatataatactttgaaataatcaatattatgacagatttttatcacagctttattgagatataattctcatgccatataattcgcctatttagggtgcataatccaatggttttttaatatactcacagagttgtgcaaccatcatcacaatcaaccttagaacattttcatcacctcaaaaagaaatctcatgcccattagcagtcactaacattttcccttcaatttcccacccctagccctatgctactactaatttaccttctgtctctatggatataccaattctaaatgttgcatattaatggactaatacaatatgtaataatttgtgactggattatttcacttggcacaaggttttcaaggttcattcatgttttagcatgtatcagcactttgttccatttttttgccaaataatattccattgtacagacataccatattttatatatctattcattgagtgataggtatttaagatatttctactttctaactataatgaataatgctgccaggaacatacacattcaagttttgtgtaggcatattgtttcatttgccttggggatatacttaggagtggattgttgcgtcataaggtaatgccatgtttaacattttgaggaactgcccaactgttttccacagtagtgtgccatttgatgttcccacctatagtatgtgatgtttccaatttctctacatttttgcaaacacctgtcattatatttcttgtttattatatccatcctagtgggtataaagtggtatctcattatggctttgatttgcattttcctgatggctaatgatgttgggcacattttcatgtatttattggccatttgtatattttctttggagaaatacctattcagatcctttgcccattttaaaattgggtttttaaaattatttagttgtaagtattctctatgtattatagatacaagtcccttatcagatacattactcgcaaaaatttttcctattctgttagttgtcttctcactttcctgatgatgtcctttgaatcataaaaattgtgcattttgatggagcctcatttatctatatttcttttgtttcttgagcttttgttgtcatatctaaaaaaccattgcctaatccaaggtcataaagaattacacctaagttttcttctaagaatttgatagttttagctcttacaattaggactttaatctattttgaattgttttgtagatggtgtgaaaaagaggcccaaattcattttttctgcaggtagatatccatttgtctcagcaccatttgttaaaaagactattctttcatagttgaattttcttggcacaactgtaggtatgagggcttatttctggactctcaattatattccattgatctatatgtccttatgccagtaccacactgccttgatagaaatctggaagtgtgagacctccaatgttttccttttttttaaatattgttttgtatattctgggtttcctgcattttcatgtggattttgggatcagcttaccaatttctgcaaagaagccagataagattttgatagagattacactgattctatggatcaattttggaaatactaagtcttcagatctatgaatatagaatggttttccatttatttaggtattcttttatttctttcaacaattttttttagtttttggtgtacaagtcttggaccttttattgaatttatttctaagtgttttattatctttatgctattttaagtggaattgttttcttactttcctctttgaatagttcattgctagcacataaaatacaattaatttttgtatatcaatcatatattcagccacattgctgaactcatttgttagttcctacagttctttagtgaattatttgggatgttctatatgcaagatcacatcacctgcaaatagatagttttacttctttcctttcaacccggatgccttttatttcatgtctcttgcccaccctgaagatatctgaatgtatgtcagaaaataaagctcttcattttccctcaaatatttaactaattatacaaatatagtttctataatagcctattttttactactgatcagaaatgtttccctatcacacactaaaaacttgtatatttgggtgtgttagtgggctttcttgttttatttctcttattgtgcttatttcagtactatattggttaaaattgtagccttataagtcattctgcttccttgaagtgtgaattgtcccaccagggataaatgaaatagcacgccagataagacaatgtagctagcacagtgctgctaacgtaagtggcatctctagagggcaatatcacttacttgtggctgtcctttgtgtcccgccacacataatagtgtcactatcaattgggttgatgaacagttaataaagaattatttttactgtgtattaagtgcccaatatataaggattaattatttttataaaccaaacacccaaagataaccagattaaacgggtatactaagaagattatgtaactaaacctgtaatgatggacatttgtgctgttccattttttttaaattataaactaagccaatggaatcactattgtagttataatacaaacaaagaataagtgttcaataaataattgctatgggaatctttttaacataaattttttgagacagggtctggctctttcaccgaggctggagtgcaatggcacagtcacagctcactgcagcctctacctcccgagagcaatcaatcaattctcccacctcagcctcccaagtagctgggactaccggtgtgcgccaccacactgggctaaattttgtaatttttgcggaaacagggttttgccatgttgcccaggctggtctcaaactcctgggctcaagcaatccacccaccttggcttctcaaagtgaaaatttgaaatataagactactttagcactgtattaattatctctgtgggtacatcaaaaagctagaaagatatcaagttaacaacctaacatcacaactaaaagagctagagaaccaagagcaaacaaaccctaaagctagcagaagacaagaaatagtcaaaatgatagctgaactgaaggagatagagctatgaaaaacccttcaaaaaatcaatgaatccaggagctggtttttggaaaaaataaaatagatagactgctagccagactaatgaataaaagaaaaaaatcaaataaacacaatcagaaatgatagggggatatcaccactgaccccacagaaatataaaaaccatcagataatactacaaacacctttatgcacataaactggaaaacctaaaagaaatggataaattcctggacacatacagcctcccaagattgaaccaggaagaaattgaatccctgaataggccaataacaagttctgaaattgaggtagtaataaatagcctactaacagcaacaacaacaaaaaagcccaggaccagacatattcacagctgaattttaccagaggtacaaagaacagctgggatagtttctattgaaactattccgaaaaaattgaaaaggaaagactcctccttaattcatattaagaggtcagcatcatcctaataccaaaacctagcagagatacaacaaaaaagagaaaacttcaggcaaatatctttgaagaacattgatgcaaaaatcctctataaaatactggcaaaccaaatccagcaacacatcaaaaagcttatccatcacgatcaagttggcttcatccccgagatgcaaggttggttaaacatatgcaaatcaataaatgtgattaatcatataaacagcactaaagacaaaaaccacatgattatcgcaatagatgtagaaaagccctttgataaaattcagtatccctttatgttaaaaactctcaataaactacatattgaaagaacatacctcaaaataataacatccgtatatgacaaacccacagtcaatatcagactgaatgggcaaaagctggaggcattccccttgaaaaccagcacaagacaaggatgctctctctctcaccactcctattcaacatagtattggaagttctggccaggacaatcaggcaaaagaaagaaataaagggtattctaataggaagagaggtagtcaaattatctttgtttgcagatgaaattctcctatatctagaaaacgccattgtctaagcccaaaagcttcttaagctgataagcaacttcaacaaagtctcaggatataaaatcaatgtgcaaatattgctagcattcctatataccaacaataggcaagctgagagctgaataataaatgaacttccattcacaattgctacaaaaagaataaaattcctaggaatatagctaacaagggaagtgaaggacctcttcaaggagaactacaaaccactaataaaggaaatcagagaggatttcagtgaggacccaaacaaatggaaaacattccattctcatggatagaaagaatcaatatcatgaaaatggccatactgcccaaagaaatttatagattcaatgctatttccattaaactaccattgacattcttcacagaattgaaaaaaactattttaaaactcatatggaaccaaaaaagagcccaaatagccaagacaatcctaagcaaatagaacaaagttggaggcatcacactacctgacttctaactatactacaaggctacagtaaacaaaacagcatggtactggtacaacaacagacatatagactaacagaacataatagagaactcataaataagaccacacacctagaactatctgatcttcaataaatctgacaaaaactagcaatggggaaaggattccctatttaataaatagtgctgggagaaatggctagcaatatgcagagaattgaaactggaccccttccttataccatatataaatattaactcaagatggattaaagacttaaatgtaaaacccaaaactacaaaaaccctattagaaaatcctaggcaataccattcaggacataggcacaggcaattgcaacaaaagcaacaattgacaaatgagatctaattaaactaacgagcttctacacagcaaacaaaactcatcagagtgaacagacaacctacagaacgggataaaatttttgcaatttatccatctgacaaaggtctaatatccagtctccaagaagcttaaacaaatttacaagaaaaaaacagcccattaaaaagtaggcaaagacatgaacacacacttctcaaaagaagacatacatgaggccaaaaaacatgtgaaaaaaacctcaacatcactgatagagaaatgcaaatcataaccacaatgatataccatcttaagctagtcagaatggctattattaaaaagtcaaaaaacaacagatgctggtgaggctgcagagaaaaagaaacacttttacactgttggtgggagtataaatcagcaaccattgtggaagactgtggcgattcctcaaagacctggaaccagaaatatcatttgactgagcaatctcattactgggtatatacccaaaggaatataaatcattctgttataaggatacatgcacccgtatgttcattgcagcactaatcacaatagcaaagatatggaatcaactgaaatgcccatcaatgatagactagataaagaaaatgtggtacatatacaccatggaatactatgcagccataaaaaggaatgagatcatgtcttttgcaggcacatggatggagctagaagccattattctcagcaaactaatgcaggaacagaaaaccaaacaccatgtgttctcactgggagctgaatgatgagaacacatggacacatgtcagggaacaacacacacaggggcctgctgggggcagggagggagagcataaggaagaatagctggtggctgccaggcttaatacctgggtgatgagatgatctatacagcaaaccaccatggcacatgtttatctacataacaaaccttcacatcctgcacatgtgcccctgagcttaaaataaaagttgaagaaagaaaattatcattgtgggtaactattagaagtgaaattactggcacaaaagatcaaatattaatttttttttttgagacgaagtctcactctgtcgcccagactggagtgcaatggcgtgatctcggctcactgcaacctctgcctctcgggttcaagcaattctcctgcctcagcctaccgagtagctgggattacaggcgcccaccaccacgcccagctagttttggtatttttagtagagatggggtttcaccatcctggtcaggctggtcttgaactcctgacctcaggtgatccacccgcctcagcttcccaaagcgctgggattacaggtgtgagccaccgtgcctggccgatatttttatttttaaataatttacaaagttgatcttcagaaaaatttcaccaacatattcaataagagcaggggagagtgcatgtgtccccagtccttcaacaaatctgttaaaaattttcatgtaatctaatctatcagcatttgtctctttgttgtacagtcacactgcgtatcgattggtcaacgacaacggacagcatagaatacgataggctatagtatgtagcctaggagtgtagtaggctataccatatagatttgtataactacactctacgatgttcgcaccaccacgaaattgcctgatgcatttctcagaacatatccccgttattaagtggcacgtgactataaaggccttccacaccaaaagcttatgtggagataaacggagtctacccataagagaacaaacaagtgctacttattcacagcttttttatagcaaggaagtcaagccaccatcatttgagtctggcagagattcaaagacaggcaggggagtgggaaagctttatagtggaaaacaaaaacacaaagacttcagctacgctctgattggatgttgttgacgtgaggaagctagaggcaggccaactagaggcaagcatcctatgtgattgaatatgggttcatatttgggtttttcttgtttgtcatcaggtcaaaaaaattaaaaaggccagaaaggctagcaaattgattaaagtcctgaacatttctgcagatgctatactttggctttttgagctgcttgcagcaaaggttgtgggtcacagttctattttcgtatgtggtctggtcattgtatattcagtttctcacttaagataaattaatcgttgttttattttgcttcaaatataactttattttttattcatttgaaaatttatgtttgtacatgtcaggaaaaagggacaatttcatttattttggaaaatttttcttaagttttttctaaagggcaatattctattctttatacagtacttaagttcacattcatacgattttatcgggtgggtctacgttatttcagtggaatttaagagcaacattatcaagactcctcttctggaccgcccaactcattaaaaaaaaaactgtgattttcattaagattctttctttgattaatttcttaacaagaaaaaaaggacaaaagggcccagggaggtaagagggtacctgctggagaggtggtgggtggctggaagcggctggctaggaggcggggcgtggggcggtggaactcctgggctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattgg

SEQ ID NO: 36146 - DNA, 124137 bp, Homo sapiens
agagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaagtgcctctctggcctcgcccttccttccctcgtcacccgcggcctctgctcacgggttcgagtctcctactcgctctgcgcctcctgcctctgccctctggacccccagttctccccgtgcctcccctccgctccgggatgacaccctgcccacctcgtcctgaagccccatttgtgttgtcttcctctcgacccagcttttctccttaggccctctgacccctggctaaaaactgcgtcttgtttcctctcgcctctgcctatcaccgctttctccctccctccccccacccccacacattcctagctttctctctgagtatcttctccgtctcccatcttcagcctggggtcgttccctgtttcatgttgcctgctccgtgatcgcatcctccccgttccttgccacatgtcagcgctccactctggtattgccccagctcccactctcttccatcccggagactgtggccttctgctacctcccattccgaaagtgttgatcatccccccacactctcccttctttcatctgcatttcccccattcagattttgagaacaaatggctgacaaatgagtgactcttgaggtaagactctctcaaagaaggaaaataacctgtcaggaagtgaacgagaatctacattaggaactaaaattacagtgacatagccaagaaaggttaatttgctttattgaagccttccacctatttttatcatcaaagtgtttaataagcctttccccaagtagtataaagttccaaggctggtttattagatactatataggctttcagaatttcgtacatttcattttgaaagggtgtgccttgtgttttattttattttattttattttattttatttttgcatttccaacctgaagcacatttggctttgtagtacagcgctctcactttgtgctataccggaatggtgatataaagcccactaagctcctctcccttttttagaaaatttagaagatatcaaatcgaacccatctgtgaatgattgcatactttgtgccagtcattggtgctacaaaccaaataaggttggtggaccctgctgtaggaacttctggtttacagacaaatcattaacttccattcagtgtgactgagatatacatgaggcattttcttgaagtggtgatacttaagcctacctttgaagtactagttagaggagtaaaggagcagtaatagcatgtgcagaggaagggaggcctgaaatggcatggtatttagagaactaagaaaagctgaatggctggagaggaggatgggagaggaagagttggggcaatgaggcagtagtagtaataaggagctagaccatgagaggccttgtgaaaattgtggcgtttctctgaaagtttaagtagagaaatgacattgtcagatttgtacttaatgtaatcaacaacatttgttgaagacctgtaatgtgctctggtagcaaagtggaggagagattggaagaagggaaatggattgggaagctcttccagtaatccaagcaagaaattatgtgagcttgaattaagaaccttagtaggatgaagatgaaggactagattagaaagacgttaaggagttagaatctgcaggaccttgtgaaggtctggtgatgggcattgtaactagtaagtgagggggagtttaggaagtctttggcttgtggtttgggcaactatatgtaataagagaatgaaggatacagattttcaaccttttgcattttaaatgtttatggtatgtccaagtaaggacatctggttgaacaccagatatagatagtctaaacagtagggagtactgggccagagatgttaattggggagctaacagcaaaaagtgtcagttcagtctcaaggattatgtatgttgtgaaatgcactgagtactaaagctgtaagcttagaggagcactggtgtttaaaagtcaagtagaggttactgggaagaagactgagaaggagtaaaagaaagaggaaaatcatgtgagagtaaggccctcggagctgaggaaggcgagaacttgatgagggtgaggaatggtcagcagttttgcaaatgcagcaggggtcaggtaagaaaaggatagaaaaatgcttattggttttgagaaggtggaggtaacttggaccttaggacagtttcagtaggatagtggaggcagaaagcatagttataggataaggggttaaaaagtgaaatatactatttcaaggagcttggctgtgaaggatagcagatgcaggattgtagatagggaatgtagaaaaaaggaacagattttctttatccttctaccactctcctggtccaggccaccatcttttctcaacctgggctatgatatgatatgtgtcttcttctagcaattcttcctgcttttgctcttggtttcctgtaataattctcaacagtagttacagtgagcttttaaggcataatttagatcacaacattgcctttttttttgagatgaagtctcactctgttgcccaagctggagtgcagtggcatgatctcagcttactacaacctccacctcctgggttcaagtaattcttctgcctcagcctcctgagtagctgggactacaggcatgcgccaccatgcccggctaatgtttgtatttttagtagagatggggtttcactatgttggccaggctggtcttgaactcctgaccttgcgatccacctgccttggcctcccaaagtgctgggattacagtcatgagccaccacacccagcctaacattgcccttttaataacactcaatggtttttgattgcacttaacgtaaaatccaaagttcttaaatggtgtataaggcccttgagactctgcttcctgccatttcttggaccttatacacctctccccttatttcttatgcttcagacgctcttttttgttgttaaaccagccaaccacatttgtggctaaggtttttgccctcactgttgtctatgccttggatgctttttgcagatctttgcatgctagttgcatcttgtcattcaagtctcagctcaaatgtcaactcagggcagccttttctgaccacctgatctagatctaaagtagtcaatacaacccccttgttcctacttgttgttctcaatcatatcatcctgtttattttcatcattatatttctactgtccagtatggtaacctctaggcacatgtggttattgagcctgtgaaatgtggccagtgcaactgaggaactgaatttttaaaattcaagttaattttaattaatttaaatttaagtagccaaagtggctaatgcctataatatagtatggcacagttataggtgctaaaactcaggtacatacagattgaatacttgtccaagttacataggcagttggggatataaatacaccccaaacatctagattaatttgcactatacctatagatttataaatatggtttaatgtatttctcttctaaatcaaattcttgagtttatgtatgttgatattattgtggctatgatcagttcatgtagaaaatgaacagaatggacctcttcaccagtgagcccctttgtaaaacctgtacagatgatctcagacttatgatggtttggcttccaattttttagctttacagtaatgtgaaagcaatgtgtactttgtagaaaccatacttcaaattttgcactttgatcttttccagagctagtgatacaatgggtaagatactcttttgtgatggtgggtagcagcagcaaatatgagagactgtactctacggtattcaagaagtactgtattcaagaaattacatgagatattttcaacccttcatgataaaatagactttgtgttagaagattttgcccaactataggctaatgtaagtgttctgagcacttttaagatagtctaggccaagccgtaatataaagagttttgaacgtaaacttttgtacagtgaaattttacagagaaaaaatgacattagcagagcaggtaaataggacctgacttaaactgctgatggtatttgcctttgcttttcttcactttatttattaatgttataaatgtttattgggaagcagaaatcatgagatcatcttaaatttttttagctgatatagttgtaatttcttaacctagctcatctctagaggatatgtaaaaacataaaacacctcaattacttgtgaattatagaggtgtatcagttggtttaaaagtgcttttattgggctgagctcttggaagactcaggtccttgggtcataggcatcacggaccaatctgaagaaaactgcatttcagggcctgttgaggctaaaactccagttggaggtccagaacatgttctcgtgactcagcaatttccttgtcagaatccattacctgcaaatagtggccaggctcagtgggtcttgtgtccttcaaattcttcgcagcgtgttcctttgcaagcacaaaagcttgtctccagtcacaagccagttcagaatcagaagcagaagcaattgcaggcaaccagtgtacctcatcctgcctccaggccactgaataacacccaaaacagcaagcagtccccgctgtcggcacctgaaaataatcctgaggaggaactggcatcaaaacagaaaaatgaagaatcaaaaagaggcaatgggctttggaagaccttgaaattggtcgccctccgggtaaaggaaagtttggtaatgtttatttggcaagagaaaaacaaagcaagtttattctggctcttagggtgttatttaaagctcagctggagaaagcaggagtggagcatcaactcagaagagaagtagaaatacagtcccacctccaacatcctaatataatcagactgtatggttatttccatgatgccaccagagtctacctaattctggaatatacaccacttgaaacagtcaatacagaacttcagaaactttcaaagtttgatgagcagagaactgctacttatatcacagaattggcaagtgccctgtcttactgtcattcaaaaacagttattcatagagacattaagccagagaacttacttcttggatcagctggagagcttgaaattgcaaattttgggtggtcagaacatgctccatcttccaggaggaccactctctgtggcaccctggactacctgccccccgaaatgattgaaggtcggatgcatgatgagaaggtggatctctggagccttggagttctttgctgtgaatttttagttgggaagcctccttttgaggcaaatacataccaagagacctacaaaagaatatcacgggttgagaattcacattccctgactttgtaacagagggagccagggacctcatttcaagactgttgaagcatgttcccagccagaggccaatgctcagagaagtacttgaatacccctggatcacagcaaattcatcaaaaccatcaaattgccaaaacaaagaatcaactagcaagtattcttaggaatcgtgcagggggagaaatccttgagccagggctgctgtataacctctcaggaacatgctaccaaaatttattttaccattgactgctgccctcaatctagaacactaaaagaaatatttgttttactgagcaggtgtgccttaacctccctactcagaaagctccacatcaataaacatgacactctgaagtgaaagtagccacgagaattgtgctacttatactggttcataatctggaggcaaggttcgactgcagccaccccatcagtctgtgccaggcatggtgtcctcccaggaggcaaatccagagtctggctatggggaaagtgaccactttgtgctgactcgatcggttaaggagctgtccaataaccttccaagtacctgagtgagtgtgtaacttattgggttggccaagcctggtaaagctgttggactgagtacgtgattctttttaagtaggaaaataaagatatttgtacagaaaaaaaagtacttttattttactgtggacagctgctagagatatagtgataccactctcttctatatttgaattatcaaagtatgactttatgttactttgtatatttaattacaaaagaagactgtcctctgtagctttaaaagatgctgaaccctaccctttcccaatgtttacattaatgacaactgttaaattttgtttttataaagtaaatactatctacttaagacatgaagtctggtcttactgctttgtggcttttttgtttgttttgtttttgttttttagagacagggcctcactctgtcacccaggccagagtgcagtggcatgatcatagctcactgcagccttaaactcctggattcaagggatcctcccacctcagtctcctgtgttgctaggactacaagtatgcagcaccatgcccagataatttttttggtttttgttgagatagggtcttgctgtgttgcccaagcaggtcttgaactcctgggcttaagtgatcctcccacctggactctcaaagtgctagaattataggcatgagccactctccctggtttattactttgaagttgcagggatgggtggagtataggtccccactttatgggtccccatttaacctatagtgacataatttccaatgcctagaccagaactttctgaaatttacagttgggttgggcaaaaatataaataaatatataaataaataaatacatgaatagagagggagagccagaatagttggagataatttgggtattataatattgtggatttcttgatttacctaatagtaaaataatttcttattgacatactaaaaatgtggaatagttttccttcttgcctcttttaccaaccagaatataaagcatgtagggaattatgttgaaataatcaattcatgtttttaagcaatctctgagaaaaatgtgctttatttaggataacctaaaatcatagaatcactttgcataatgggctatcacaaatgatataaaatactctattttttatatgtagtaaaatattttctctagtttgagatcatactaggagagaaaataatctgaaaatagaacatttatagagatttcagaaaatatatagagttactgggtttctttaaaattggaagaggatcatacagataaaattttaccagtgaggaaattgagatttgagtgttcttcagtttcttcattcaggtagtatttattgagcatctactatgttctaagcacaaaatgagtttaaagataaataaaataagtccctcaagcaattttcagctaataaaagaagacacgtatgtgaaacgattgttagaggtgttatgctatgatatggcacatgatgggagagaatgaaggagtgttggtctagtctatgcaggaaacccagaaagtcttcatataggaggtgatatttacacattaatagtttaaagatgtccatcagatggagagaaaatagacaacagatgtgaaacagtatgggattcagaaagctgcaaatagtaaattgtggtgggagggtgggatgtgttcagaggtgaaattgaagaggttggtgaaggagtttagattttattcagtagcagggtctttagattgaagtaagagtaccttgggatcatggaaatttataaaaggttgcttgggaacagatgattttaagtaaatcattttccacatgtacctgtgaaagtgcctactttctcaccctgccttctcccactttatctctgacacgtttgtagtcttattatagtaagttgcttcaaggtgtaaaaaaaacctcccctttaatcaaagtgttgtaaattcctccattcgttttattattagttttccaaattttactttttgtttaattatcaagatttatgatatatttatgttgttttcctcacttatttacataaaataattgtaataactcaagcaagaagaaaaatgttaatacttaagagtcttatcacaggaaaatgttttcttaattcatatccttttttgcagagagagttttgtactgataataataaaaatctgtgtttattagaatagcattctgtggaggaagtagaatagaaataagtattcaaggagaataaaggacttgtaaaaactgttgagaaggtcagcatttttttttaatggatgtcggtgggtatcatttccctatagtgtttagaatccactaagttttaaaaagtaataatagttttatgtttaaatgtacatgtttatagtataacagaaattacatattttttgcaagagatacatactaaaaaattcttttggggcatatatgaacaaaaaatttgaaggtcattctcctgtaagactcagtgattcccagtcttgtcttttcttttttttgttggcataatagcgtacataagaaaaatgagatatggaccccaaacagctaaaacaattttggaaaagaagaaacaagttagaagattcacactttctgatttcaaagcatattgcaaagctgtaataacccaaactgtatgatactggcataaagacaaacaaaccaatggaatggaatagatagctgataagtaaaccctcacatacatggtcaagatgatcttcagcaagtgtgccaagagcattctttgggggaaaagacagcttcttgaatatatgatgttagaggaaatggctatccatatgcaaaagaatgaaattgaatccttatcttataccatatacaaaaattaaatagattaaagacctaaatgcagcacctaacactgtaaaactttagaataaaacataggagaaaagcttcatgacattggacttgcatgcttttggatatgacaccaaaagcataggcagcagaagcaaaagtggacaaatggggctacactaagcttaaaaactttgtgcatcaaaggacacaatcaacagtgtgaaaaggcagttttcaaaatgggagaaaatatttgcaaatcatgtatctgatatgggattaatatccagaatatataaagaattcctgcaactcaataacaacaacaaaaaatcaaccctatttaaaatgagcaaaggacttaagtagacatttcttcaaggatgatatacagatgaccaaaaagaacatgaaaagatgcttaacatcactaatcatcagagtgatgcaaaccaaagcataatgaaatgttacacctattagaaatggctactataaaaaaaaaaaagtatcaggatatggtgaggatgtggagaattataaacttttgtgcattgttggtgggatgataagatggtacagccattaaggaaaaaataagagttcctcaaaaaattttaaaaaaattatatgatccagcaatatcacttcaaggtgtatatacagcagaattgaaagcagggtcttgaagagatgtttgcacacccatgttcatagacagttcacagtagccaagaggtggaaacaacccaaatgcccatcgatggatgaatggataaacaaaatgtggtattatacacacaatggaatactgtttagccattaaaatcaaagaaatgtcacatgctataacatgaatgaaccttgttaaattatgctaagtgaaatattccagtcacaaaaagacaactactatatgattccacttacatgaggaagctaaagtagtcatttatagaaacaaaaaatagaatggcggttaccagaggctgaggaaagggagaacgggaattgtttaatgatacagagtttcagatttgcaagatgaagttctggagatctttttttttcacaacagtgtgagtacacttaacactactgaactgtccacttagaaatggttaagttgataaattttatgtttttttgtttgtttgtttgtttgtttgttttttcttgagacagagtcttgctctgtcgcccaggctggagtgcagtggtgccatcttggcttactgcaagctccacctcccgggttcacaccattctcctccctcagcctctcgagtagctgggactacaggtgcctgccaccatgcctggctaattttttttttttttttttgtatttttagtagagatggggtttcactgtgttagccaggatggtctcgatctcctgacctcgtgatctgcccgccttggcctcccaaagtgctgggattacaggtgtgagccaccgcgcctggcctgtgtgttttttttaaccaaaatacaaaatgtcaatcaattagattaataataaatagattatttaaaaacgcgacaaagctgcttatgatggaaagtgacataagttccagtagttccaggccctacctgactgcttttactgctaaaaggatcaatatcttggctcacctgcaacccatttacagcatactaagaatctctgctatgggcagagggtagccattgatggttttaagtaaaagtgtagcaaaaatattttaagatttgagttctaaacagatatatttggtagctgtaaagagaatagattgggcagttcaaagctagaggcaggtgaccattagatagatagttgtagaagtccaagttagagcccataaaggcagaactaaggtgatagcaatggcagtggagtttgagactattagaatttgagctgagaaataggatagccagacaaatattttagagacatttctttgtcagcaaagagaagaatggatgggagtgatgggtaaagtggaagtggagtgaccagttaggaggctattgcagtattccaaaagaggagattatcttttccttagcatggttttcataagaggttattttatagtatacacagtgacagtcctggaagtatgacaagtatttttgaatgagtactatgcttaatacaatttgggactattgagaccttgaatgaagagtaagttgttgaaccttcctcatagagaagaattcttgaaactcctaggtatctgctgtgaccatatcttgcctttaaaaaagagaccagaaatggtcccttgaacatagattacttttctttgtacaatgtgagtctaaatctcacatttaagttccccagaagagagaatctcatcaggtcaagagagtagacattacttaccacattgcccccccttttttttaaagtatgtaaaatcagacataaaaaccaccacctggctactcatactctacctttcagacgttaaaacctcagtactgtgctgtctaacatggtagccactagctacatatggctatttacatttaagtttaaatcaatagtaattaaattttaaaaaattcagttcctcagtcacagtggctacatttgaagtgttcaagccatatgttgctagtggctaccatattgagcagcacagatacagaatacttccatgattacagaaagttctattggaagtattgccttagtaagacttttttcttcttcttcttcaacttttaagttcagggatgcatgtgtaggatgtgcaggtttgttatatatgtaaatgtgtgccatggtggtttgctgcacagatcaccccatcacccaggtattaagcccagcatccattagctattcttcctgatgttctccctccccccaccaccccaacaggccccagtgtgttttgtcctcccctatgtgtccatgtgttctcatcattcagctcccacttataagtcagaacatgtggtgtctgtttttctgttcccgcattagtttgctgagaataatggcctccaactccatccatgtccctgcaaaggacgtaatcttgtttctttttatggctgcatagtattccatggtgtatatataccacatttttccttatccagtctatcattgatgggcatttacgttgattttgtgtctttactattgtattgtgaatagtgctgcagtgaacatatgtgggcatgtatctttataaaagaattatttatattcctttgggtatatacccagtaatgggattgctgggccaaaaggtatttctgcctctacgtctttgaggaatcaccacactgtcttccacagtggttgaactaatttacactcccaccaacagtgtaaaagcattcctttttctctgcaaccttgtcagaatctgttgttttttgaccttttaacaatagtcattctgactggcataagatggtatctcattgtggttttgatttgcatttctgtaatgattagtgatattgagctttttttcaatatgttttttggctgcatgtatgtcttcttttgagaagtgtctgttcatatcctttgcccagtttataatgtggttgcttgttttttcttgtaaatttgtttaagttccttgtagactctggataattagacttttgtcagatggatagattgcaaaaattttctcctgtagattatcagttcactctgacaatagtttcttttgctgtgcagaagctcttttgtttaattagatcacatttgtcaatttttgcttttgttgcaattgcttttggcattttcatcatgaaatctttgcccatgcctatgtcctgaatggtattgctagattttcttctagggtttttatagttttgggttttacctttaagtctttaatccatcttgggttaaattttgtatatgttgtaaggaaggggtccagtttcgatgatctgcatatggctaggcagtagtcccatttattaaatttattaaatttattaaataaggagtccttcccccattacttgtttttgtcaaatttgtcaaagatcacatgattgtaggtaagggccttatttctgagttctctgttctgttccattggtgtatgtgtctgttcttctaccagtaccatactgttttggttactatagcttgcagtatagtttgaaataaggtagtgtgatgcctccagctatgttctttttgcttagaattgtcttggctatttgggctcttatttggttccatatgaattttaaaataatttttttttctaattctgtgaagaatgtcagtggtagtttaatgggaatagcattgaatccataaattactttgggcagtatgaccattttcacaatattgattcttcctatccatgagcatggaatgtttttccatttatttgtgtcctctctgattttgagcaatggtttgtagttctccttgaagaggtccttcacttcctttgttagctgtgttcctagatattttattctttttgtagcagtcatgaatgggagttcattcataatttggctgcctttctgtcgtagtgtataggaatgcttgtgattttttgcacattgattttgtatcctgagactttgctgaagttgcttatcagcttaagaagtctttgggctgagatgatggggttttctagatataggatcatatcctctgcaaacagagacaatttgactcctctcttcctgtttgagaaccctctatttctttctcttgcctgattgccctagccagaacttccaatactatgttgaataagagtggtgagagagggcatccttgtcttgtgctggttttcaagggaaatgcttccagcttttgcccattcagtatgatattggctgtgggtttgtcatacaaggctcttactattttgaggtatgttcctttaatacctagtttattgagagtttttaacatgaagggatgttgaattttatcaaaggccttttctgcatctattgaggtattcatgtggttttttgtctttagttctgtttatgtgataaatcacatttattgatttgaatatgttgaaccaaccttgcatcctggggatgaagccaccttgattgtggtagataagcattttgaggtgatgctggattcaatttgccaatattttattgagaatttttacactgatgttcatcaggaatattggcctgaagtttttttcttttgttgtatctctgccgggttttggtatcaagatgatgctggtctcatagaatgagggaggagtccctccttttcaattttttggaatagtttcagtagaaatggtaccagctcttctttgtacctctggaagaattccactgtgaatccatcttgtcctgggctttctttttggttggtagggtatttattacaatttcagaattcattactggtctgttcagagattcagtttcttcctggttgagtcttgggaagatgtatgtgtctaggaatttatccattttttatagattttctaccttatttctctgtgtttataaacacagaggtgtttatagtattctctgagggttgtttgtatttctgtggggtcagtggtgatattccccttatcatttcatattgtgtttatttgattcttctttcttttcttctttattagtctagctagagttctatctattttattaatttttttaaaaaaccagctcctgaatgcattgattttttttgaagggctttttgtgcctctatctccttcagttcagctctgatcttggttatttcttgtcttctgcaagctttggggtttatttactcttggttctctagttctttttacttgagatgttaggttgttaagtcgagatccttctagctttttgatgtgagcatttagtgctgtaagtttccctcttaacactgttttagctgcatctcagagattctggtacagtgtctctttgttctcattagattcaaagatctttttgatgtctgctttaatttcattgtttacccaaaagtcattcaggagcaggttgttcaatttgcttctggttgtgtggttttgagtgaatttctttctttctttttgtttttttttgttttgtttttttttgagatggagtcttgctctgtcacccaggctgaagtgcagtggcatgatcttcactcactgcaacctccgcctcccaggttcaagtgagtctcctgcctcagcctcccaagtagctgggactacaggcacgtgccaccacgcccggctaattttttgtatttttagtagagacatggtttcaccatgttagccaggatggtcttgatctcctgacctcgtgatccgcccacctcagcctcccaaaatgctgggattacaggcatgagccacgacgcccagccttttgagtgaatttcttaatcttgaattctaattcgattgttctgtggtctgagagactgttatttcagttcttttgcatttgctgaggagtgttttacttctgattatgtgatcaattttagagtaagtgtcatgtggtggtgagaaaaatgcatatgcagttgaatttgggtggagatttctgtagatatctatcaagtccacttgttttagagctgagttcaggtcctgaatatctttgttaattttctgtctccatgatctaatgttgtcagttggtgttaaaatctcccactattattgtgtgggagtctaagtctctttgtaggtctctaagcacttgctttgtgaatctcactgctcctgtattgggtgcatatatatttaagatagttaactcttctttttgaattgaaccctttaccattatgtaatgcccttctttgtctttttaaatctttgttggcataaagtctgttttgtaagtctgttttgtcagaaactaggattgcaacccctgcttttattctgttttccatttgcttggtaaattttcctccatccttttattttgagcctatgtgtctttgcatgtgaggtgggtccttgaaggttttgcgtctttatccagcttgacattctatgtcttttaattggggcatttagcccatttacatttaaggttagtattgttatgtgtggatttgatcctgtcatcatgatgctagctggttattttgcagacttgtttatatggttgcttcatagtattactggtctgtgtacttcactgtgttttcgtagttgttggtaatggttttttattttcatatttagtgcttccgtcaggagctcttgcaaggcaggcctggtggtaacaaatttcttcagcatttgcctatcggaaaaggatcttatttctccttcatctatgaagcttagcttagccaggtatgaaattctggcctggaaattcttttctttaagaatgttgaacattgacccccagttgagagatttgctgttagtctaatgggtttccttttgtaggtgacctggcctttctctctggctgtccttaacattttttctttcattttgaccttggagaatctgatgattatgtgtcttggggttgatcttcttgaggagtatcttcctgaggctctttgcatttcctgagtttgaatgttggcctgtcttgctagattggggaagttctcctggatgatatcctgaactgttttccaacttggttctgttctctccatctctttcaggtaccccaatcagtcatagatttggtctctttatgtgatctcatattttccagaggttttgttcattccttttcattttctttccctctattcttgtctgactgtcttatttcagaaagatagtcttcaaggtctgagattctttcctccacttggtctgttctgctattgatacttgtgattgtattgtgatcttctcatgttgtatttttcagctccatcaggtcagttaccttcctctctaaactggctgttgtggctatcagctcctgtattgtttgatcatgattcttagcttctttgcattgggttacaacatgctcctttagctcaccaaagtttgttgttatccaccttctgaagccgacttctgtcaattcagccatctccacctcagcctggttctgtgcccttgctggaggggtgttgcagtcatttagagaagaggaactctgactttttgagttttcagtgcttttgtattgattctttctcatctttgggggctatctatcttcagtctttgaggttgctgacctctgaatgaggtttttgtggggtcttttttgttcatgttgttgttgttgttttctggttttcttttttttttctttgaaatttaaagaaaaaatttattgaagatctgaaaaacaattcctaaaagattgacttttccagaaaactagctacacagtgcattgcatctatcatgttaaaacgtgcattagacacaaatacaaaaaccatgaaacaagccaccattcttcaacaatttgagccaagataaaatgcctaagtaacaacatggatgccttgcaaaggatgggctctttactttaagcaccataaaaaaaaaaaaaaaagcacaaatggatgagtgtgttcagttatatacactgaattgaacctttggcactaggaatcagagcattttgtcatatagcattaacatgtattataaaagtgcatagtgtcaaaggaatagaaccaccagcattcaaaagcagctttgtcaactaggcaataaaacactctacagcatatccctctgttgtccatcattgaaaacactggcagcaactttgaaatgaaaaaaaaaaagaaaagaaaaaaggagctattaccccttttattttctctgtttaaaatcaaacagaaaacaaacatcaattgttatacactaacatcttcaaagcacattgtttgtacaagagatagactaagaacaaaaatgtgtttacggagatccaaacataagtgagtgagagtgcctctcacacagctttccgatggtactcaggaggagccacttcataatcgctggcactaaacaaagttgcagaattctttgccaggtactttaggaaatcgtgaagataattgagtaataaagcaaggctcttctcatccagaggtgtataggccaacattgctccaattcgtacaaataatctcaggagatgtggcgctccatacacctgggacatgggtgcatcgggatgatctgcaagaatttcggcatactgtggtctctcaaatttatagagtagctgggtacccaacattacgttgaagtattcttttatccctgccacaacttcattaaccgcatactccttattatctgtgtttccacgagatttcttgtaatttgcataatcctcaagaatggaatccacattcttcttggcaggaagataaaagagctgtttttgcctggtaattaagtcccagtcatcaacaagccacggttttagctattcaggaatctttactttaacttcaactctgttcatgaatgtttcctcattttcaacagtaggatctacccgggcccttttcttccaaggaggctgaggggtctcactggtactgccaccatctccatttccaggtgttttctgtttgttctttttcgttttcacttcaacatttttctgttgcagaccagatgtcttctttcctggggcagcccctctcatcttcccctctgcatactgctcctgattggctttttgaagttctcgctgtttctgcaaattggtgtccacgtatttgagtactctgctctccggaacccactcatcccaatttttattccaaccactgtaatgtatgaagtatttcacttgtttgtcctttatggcaacctttacacactttgcttcataaagaagaggcccatgaaagcacagcactcgctcaccctcctggaatttaggcttcgggtcctgcttccgcgccatttataagtgatttgccgcctcctccttctcccaccacccccgactaccgccccctactctctaccccacccaactccgcgtcagacgcgccgtcaggcactgccagctctacatcctgggttctggttttcttttaacagtctggccactctaccatagggttgctgcagtttactggggatctgctccagaccccagttgcctcagtttctcctgtacctggaggtatcaccagtgaaggccacaaaacagcaaagatggcagccagccccttcctctggaagctgcattctggtggagtactgacctgttgctggcccacatgtacctgtaggaggtggctggagacccctgttgggaggtcccacccagtgaggaggaatggtatcagggtcccaccccaagaagcagtctggtcacaatctgacaaggcagctgttcttcattgttggggaaccttcctcgtaaactgtctattctccacagccagcaggctggagtgcctgagtctaccgaaccacaaagatggtagccacccctccgcccctgggaacttggacccatctcagggagattccaatctgccaccattggctggctgggattccaagccagtgggtcttaacttgtgaggtgccgtggaagtggggcccacaaaacaatgctgcttggctccctggaatcagcccccttcttagggatatatacagacagatttcctgccttgccagcgatcccagctgtagtatgtaaaactcatggttctctgtgtgtgcctgagtggctgctctgccgagactctacacagctctgtgtatcagacccaaggccctggtggtgtgggctcatgaggagatctcctgatccatggaaagatctatgcaaagatccatgggagaagtgtggtttcccaggtagggtagcacaattactcactgcttctcttggcgggaggtgacggtttctttggctccgtgccccttccaggtgggccgtcgccccctccactccctcgtacttttcttcgttctctttgggtcaagctgtttgtccagtcagtcccagtgcaagaacctgggtatctcagttgaaggttctgaattcacttgccccttttcatttctctccataagctccacagaccacagctgcttctaatcgtccatttcaggtctgagacttctttcagactttctgtgctcagtcaacacacacatacacacaagctaattgggaattttatttatttgtaattttatattgtgatctcatttttataaaatgcatatctgcaacctttgtagtttaattatatattatataatatctatatctttccaagtcatttatagttttcaggtatatatagctctagcttgttttttttcttcattttctcttttttttttttttttttctttttttgagagagggtctcagcctatcacctaggctgtgccatcatggctcactgctgcctccaccatctgggctcaattgatcctgctgctgccttagcctccccaaataactgggactacagacatgtgccaccatgtccagctactttttctatttctttgtagagatggggatctcactatgttgcctaggctggtctcgaatttgtgggctcaagcaatcccaccacctcggctttccgtgctgggattacaggcatgagccaccgcacccagtctatagcatgttcttaatggttacataatattacactgaagactccactaggctctatttaataattgcctgatcagtgaacatttttaaggttatttctgatatttttgctgtaagaacagtgctccactaagcatccttatacatgtgggtcacaattgccaaattactctaaaaattggttttcaggttcagtcctatctatgataatcagtgcctatctacacatacacttattatcataatatgatcagtgtctttgacttttgttcttctgataaatgaaaaatggtatatcatggctttaattcatacctcttaaaattgagaaaagttgagcattttcaatgtgtatcagtcaagtagagcttgctttgtaaattaactattcacaatttttgctgactttttaattgtatctttaaactttttctattgttttacaaaagtttatcatatcctgtgtttatattttgcaaatatttatataatcatatctcttaacctttgcctttttagcttctgtttcatattctcctttgaaagatctttccaatcttaagcttgtaaaacattctactagattttaatctaaatctaaatatcttaatctaaatatcacatttgtgtgcatgtgtgtaagtgtgaaatctaaggtggaaacctatccttattttattgcaaatggatatgcaattgttttaacacaatttattaactaattcatcaacttcctactaattcgagatgctgtttttaccatgttaactagtcagaaatacttgcctccttttatggcttttcttctgtttcactgacttatttgtcaatttctgtccattttaatgcttagtagagacagtttctgccaaagtacttgtattactccattctcacactgctgtaaggaaataacctgagactggtaatttattaaaaaaagaggtttaattgactcactcttcagcatgcctgaggaggcctcaggaaacacagtggtggaggaaggggaagcaaacacattcttcttcacatagtggcaagaaggagaatgagtgagagcaaagttgggggagagccccttataaaaccatcagttcttgtgagaactcactatcatgagaacagcatgagaacagcactatcactatcatgaaccacccccatgattcaattacctaccaccaggtccctcccacaacacatggggattatctgaagtacaattcaagatgagatttcggtggggacatggccaaaccatatcattttacctgtctcctcccaaatctcatgtcctcacatttcaaaatacaatcatgtccttccaacagtcccccagagtcttaacttattttagcattaactcaaatgttcaagtccaaagtatcatctcagacaaggcaagtcccttccacctatgagcctgtagaatcaaaagcaagttagttacttcctatatacaatgtgagtacaggcatggggtaaatacaccttttccaaatgggagaaattgaccaaaacaaaggggctacaggccccctgtaagtccaaaactcaatgggggcagtcattaaaccttaaagttccaaaatgatctcttttgactccatgtctcacgtccatgtcacactcatgcaagaggtgagctcccagagccttgagcagctccccccctgtggctttgcagggtacagccttcctccaggcctccttcatggctgatgttgagtgtctgtggcttttcccggtgcatggtgcaagctgtcggtggatgtactattctgggttcaggagaacaatggccctcttctcacagctccacagtgccctagtggggactctgtgtgggggcttgtaccccacatttcccttccacactgccctagcaaaggttctccattagggttctgcccctgcagcaaacttctgcttggacatccaggcatctccatacatcctcagaaatctaggcagaggttcctcaacctcagttcttgatttctatgcacccacaggcccaacatcacatgtaagccaccaaggcttggggcttgcaccctctgaagcaatggcctaagctatatgttgaccccttttagccatggctgggacacagagcatcaagtcccaagactgcacaaagctgcaaggccctgggcccacaaaaccattatttcctcctaggcctccgggcctgtgatgggagaggctgccatgaagatctctgacatgcactggtgacattttccccattgtcttggtgattaacatttggatcctcattacttatgcaaatttctgcagcctgcttgaatttctcctcaggaatgggtttttcttttctattgtattgtcgggctacaaatttttcaaacttttatgctctgcttcccttttaaacacaagttcccattccaaactatctttctcaagtttaaaattccaccaacctctagggcaggggcaaaatgctgccagtctttttgctaaagtataacaagagtgaccttttctccagttcccaagaagtttgtcatctccttccgagaacacctcagcttggacttcattgtccttatcactgtcaccattttggtaaaagccattcaacaagtctttagggagttccaaactttcccacctcttcctgtcttctgagcccccaagtctctagaaagttccaaactttccgacattttcctgtcttcttctgagccctctaaactgttctaacctctgcctgttaaccagttccaaagttgcttccacattttcaggtatccttatggcagcaccccacttccagtaccaatttactgtattagtttgttctcatgctgccatcaggacatacctgagactggataatttataaaggaaagaagtttaactgactcagttgagcctggctggggaggcctcaggaaattacagtcatggcagaaggggaagcaaacatgtccttcttcacatggtggcaggaaggagaatgagtgagagcaaagtgggggaaagccctttacaaaaccatcagatctcgtgagaactcactatgatgagaacctcccccatgattcaattacctcccactgggtctctcccatggcacatggggattatgggaactacgattcaagatgagatttgggtggggacacaagccatatcactacttttctttcaaaaaaagtcttagggttattcttatacatttttcttcccattgaactttagaattatccaaaaaaaaaaaaccaaaccaaatttatactgggattttaatgagaattgttttaagtttatatattaatttgggaacgattgacattttcccaaactctaggtctatttccccaacccctacccctacccctagctttattgaagtataatcaacaaataaaaatggtacatatttaaggtgtgcaacatgatgatttgatatacgttatgaaatgattgttacaatcaccttacatagttaatttttttttcttttggttgggagaacacttaagatctactcccttagctaatttcaagtacacagtacagtattatcagccatatttaccatgctgtacattaggtcctcataacttcatcttgtaactgaaaacttttaccctttgactgacatcttatttctactctctgcttctagtagtttgacttttttagattccacttataagtgagatcatacagtatttatctagatagttttattcattttttttgcatcttttagcaaagttttttgcttctcatataaatcttacacttcaatatatatctgagtgtctagttactttattaaatttatggttgtgacctggatctcataatatttttatttaaaatttattattttattggtttttgtttacatttacttctctttatcaagtctaatttttcaaagtttctaattaatttctattttcatctttattcatttttttcatttgtctaagatctgtagaaaagtaatactaaaaaaatttccaagtggttctttttaaaattttttcatttagttatctttttattgctgattgctgttttgctctattgttattggggagtatagtctgtatgttttctgcttcttaaaatttcaacagtttgggggtacaggtgaattttttgttacacagatgagttctttagtggtgaattctgagatttttagtgcacccatcacctgagcagtgtacactgtacccaatatgtagtcttttatccttcatctccctcccaacctcccctcatcgagtcctcagagttcattatatcactctgtatgtctttttgtccttagcttccacttacaagggaggacatacggtttttgcttttccattcctgagttacttcacttagaaaactggcctccagctccatccaaggtgctgcaaaagacattatttcattccttaatatagctgagtgatattctgtggtgtatatataccacattttctttatacacttgttggttgatgggcacttaggttggttccatatctttgtagttgtgaattgtgctgctataaacgtgtgtgcatgtgtctttttcataaaatgacttcttttcctttgggagatacccagtagtgggactgctggatcacctggtagatctacttttagttctttgaggactcttcatacagttttccatagaggttgtactaatttacattcccaccagcagtgtaagagtgtccctttttcaacacatccatgccaacatctattgttttttgactttttaatcatgatcattcttgcagtagtgaggtggtatttttttgtggttttaatttgcatttccctcattattagtgatgttgagcaatttttatgtatttgttggctgtttgtatatcttctttagagaaatatctgttcatgtgctttgcccactttttttttcttctttttatttatttattttttattatacatgtgcacatcgtgcaggttagttacatatgtatacatgtgccatgctggtgcgctgcacccactaactcgtcatctagcattaggtatatctcccaatgctatccctcccccctccccccaccccacgacagtcctcagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgtcctatttctccacatcctctccagcacctgttgtttcctgactttttaatgattgccgttctaactgcaatggtatctcattgtggttttgatttgcatttctctgacggccagtgatgatgagcattttttcatgtgttttttggctgcatagatgtcttcttttgagaagtgtctgttcatgtccttcgcccactttttgatggggttgtttgtttttttcttgtaaatttgtttgagttcactgtagattctggatattagccctttgtcagatgggtaggttgcgaaaattttcggtgtggatgtcctttctgtttgttagttttccttctaagagacaggaccctcagctgcaggtctgttggaataccctgccgtgtgaggtgtcagtctgcccccgctggggggtgcctcccagttaggctgctcgggggtcaggggccagggacccacttgaagaggcagtctgcctgttctcagatctccagctgcttgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggggcttcccggctgctttgtttacctaagcaagcctgggcaatggcgggcgcccctcccccagcctcgctgcctccttgcagtttgatctcagactgctgtgctagcaatcagcgagattccatgggcgtaggaccctccgagccaggtgtgggatataatctcgtggtgcgccgttttttaagcctgtctgaaaagcgcaatattcgggtgggagtgacccgattttccaggtgcttccgtcaccactttctttgactcgcaaagggacctccctgaccccttgcgcttcccaagtgaggcaatgcctcgccctgcttcggctcgcgcatggtgcgcgcacccactggcctgcgcccactgtctggcactccctagtgagatgaacccggtacctcagatggaaatgcagaaatcacccgtcttctgtgtcactcatgctgggagctgtagaccggagctgttcctattcggccatcttggctcctcctctttgcccactttttaatgagtttttttttttcttgctgatttgtttgagttccttgtagattctggatgctagtcctttgacagatgcatggtttttgaatattttctcccactctgtgggttttctgtttactctgatgattatttcttttgctgtacagaagttttttaatttaaatagatcccatttatttatttttgtttttgctgcacttgcttttggggtcttaggaatactttgcctaagccaatatccagaagagtttttccaatgttatcttccaggatttttatggtttcaggttttagatttaagtctttcatctatcttgagttgattttttatgagagatggggatccattgtcattctgctttgccaaagatcagttggcagtaaatatttggctttacttctgggttctttattctgttccagtggtctaagtgcctatttttacatcagtaccatgctgtttgggtaactatagccctgtagtataatttgaagtcctgtaatgcgatacctccagatgtgttctttttgcttagtcttgctttggctatgcgggctctttttttgttccatatgaattttaggattttttttctagttctgtgaaaaaatgatgatggtattttgatggaaattgcattgaatgtgtagattgctttgggcagtatgatcattttcacaatatcgattcttcccgtccatgagcatgggatgtgtttccatttgtttgtgtcatctgtgatttctttcagcagcgttttgtagttttccttgtagagatcttctgccttcttggttaagtatattcctaggtgttttatttttttgcggctgttgtaaaagtgattgagttgctgatttggttctcagcttggtcattgttggtgtatagtagtgctactgatttgtgtacattgatttggtaactgtagactttactgaattcacttatcagatccaggggccttttggatgcatctttaggattttttgtacgatcatatcatcagtgaacagcaacacttttacttcctcttttccaatttggatggcctttatttctttctcttgtctgattagtcttgtgaggacttccagtactatgttgaatagaagtggtaaaagttgccttgttctagttctcaggggaaatcctttcaacttttcccattcaatatgatgttggctgtgggtttgtcatatatggcttttattactttaaggtagtcccttctgtgcctgtgttttctgcttttgggatgttgtatcaaagtttgctttctgggtagtaacctaattaatatttgtaaatagactttgggcataagaaaaaactattttctgtaggggacaaaggtattttctgtatagctctatagctttgatctccatagcagcacctcgttgtattgctgtttaacgtgttatgctaatagagactgtgagtggactcaaaacgaccagtgacagcatcataccagattcaaaagactatctcaaataactgagatggtactgaagatgatgtactctggaaaacagttgactgaaaaagtagatggaagatggcatctgagctagcctgcgtgggtccgaatcccagttctgccacttatcagttgtgtgaccttgagcgagttatgtaatctccatttgcctcagaaatttcatcttagaaatggaagtaacagtagtacatacctcagagggaaagctgttgtgcttagagcaatgctttgcgtgtagtaaatacatgtgtttattattatgtttttttttttttttttgagatggagtctctctctgtcacccaggctggagtgcagtggcacgatctcggcttactgcaagctctgcctcccaggttcacaccattctcctgcctcagcctcccaagcagctgggactacaggcgcctgccaccacacccggctaattttttgtatttttagtagagatgggatttcaccatgttagccaggatggtctcgatctcctgaccttgtgatccgcccccctcggcctcccaaagtgctgggattacaggcgtgagccgccgtgcccagcctgttatatcttttttttaaaaaaataaaggctgatgttgaaggtgcatgtggaagggttttgtttcctgaaaaacgaaaatgaataaaagcaagagttctaagtcagtgtattttctgtcattgggattttgaacatttttatctctaaattaatgttatatgatgtgtgacaattaaatgtcacatgtaggcatttgattatgtcatctaagtgcctgcatttgcaatgtatagtattcagattgcccaaaaaactttgtatttttggatcttctgtttggaaaaatagatgattaccttatatttgaagtcacattttctctactcatttaaaaaataatggttcgtaaagttgtttagcaaggttggaaacagtttgtaaagtcaaaaaatcagtatacagtttcatgttacaaggaagtgcttataactgcaaaaaagttaaaaacaatacctgatactagaaggttgattaagttatgctacattgacacagtggtataatacggagctgtgaaagaataatggcttgtatctgtattaattgcacggaaaccttcatttcaatgtatgtggctaacttttttccctagtttccagttttttttttggtaatatcagccttgtgttgcatttgtctgttgatgtctctatattgtgcactaaattatacaccactttaggccagggaatgagtaatatatttcttatatccccagcattggtacacagatgatttgtagtaggaacttaataacgaacaaatgtctattgtgtgttggattgtgtctgagttggatgtttgtccttgttttaggaatgctaactatgaaataaaacaatgataaatatgctatctacaattttttctttactatggaaccaaaatattccatgttatcatgtgatattgttaaaattattatcagactttctctgtgtgtactttgaagaaaaacagtaatagcaaaattaggctggtttaggaaggatttaatttaaatataaggagatttctcagggacagtactcaaatagtagagtaggttaaggaaggaaaatatagaattggtttctctagaacatgcagaaattacctttagttagcaatttttgcatacctttacctacatttcataatgttgcagccttcttcacctttttagacatgcttaactttttctgttgttttggatataaaaaataaataatatataaatatgaagttgttaaaaaaacagaattataatagacatgtacatttttaatgtttgtaatataaccctttggtaagtgactaagtgactaatatgaaatttattttcaaattagtatttcttgctaatatgaaatttcatgctaatatgaaatttattttcctattttccatttccctagagatggaaaaaattaataattccgatgtataggaatataagaggcagcttctctattctttagacttttcttttgtcttttagctttgtactgctgggtgatgcttttcttgccttggccaagtagagccaagtaaaatttgctgaatcccctaaattatttacaagtcataggttgtagaggttcttactttttatagaagcaagtacattatctctgtttttttctcatctcagaagaacggaaatgaatttacttctgtactaagatcttttattagaccacagaaactaaattaaattttccttttcctaacatttaatgttttcagtttctcatttagtatttgaacttgacatactcatattggaaaaagcaaatactgtcaaatcaattgcccacttctagaattcaatttcctttctagcttcaggttcttgttaaatgaaaaaaaacatacactcagtttatgaggacagactgttcagaagcaaattaggataatgtattttgggaattaaatagagctgtggaaagcagaagttgaatttcttatttaagcttctgttgttagaataattcattgaatggaaatacccctaaacaagacatctataatttttttgatgattgattaaaatatgttttctgtatggtttgaaggtttcatttatcaaatgagagacataacaggtttttcatactagtaaaatctaatctcttcaaggaaaaaattctcttcagaagggaattgtggttacattttacattttgaagtcattggttttatttattcagtcaaaacatttaacttggtgagggtaagaacaggagtttatggttatgttaccgattattctagatattaatagttcaaatagtcctgttcagtgataggtataaaaaaaaagttaaagattgaaaagtcaggttactaatcaatgaggatgcagttgcttttttgttactattatttgtaactttatctcgctcctctttatttctcttcatatcatgtaagttggttggagatcagcttattaatcttatttagagaaagggtatgattcaagatgtggtataaaccagagtgaaagaaaatttcagcaactgaggtggacaaacaaaatattttaagatgacaaatttcttgaaagacccaaatgaaatctttaatgcaatctttgattttctgtgaattttaaggaaaaaaatggataagaatgtaaacagaataaattttaaaggaagttcaccccttaagaagggattgaggaaaaaaaagattaaagatttaaaacaaagtagaaatatcttatattcccagaaatgctattttatcaaattgtacaacaaatgagctgagaaagctcagttacaaacatgaatctgaaatattttccttattgctggaacgctgtcctgatgtaatacagttgtaacatggccactttaggaacaacatctcctaaacgtctcctatggatgtgaatcgtagcatgaaagtaacaagacctgagaagcattctcatcatctatttttagatttctccagtaagcaatatttgctattcttgaactgtttttagtgtaacctgttttagtcactgttggcaaaaagaatatttgcataatagactacagacacaagaatgatgtggtgttcttttttttttttttttttaatcttcaaaatggcatggtgtttatttgggaactcaatggcttttataattatttcttctatccctaccatgaaatcaggttgttgaaagtcccatgtaattgagcaaattggttttccattattgatgtaggatgttttgttagtaatgatacaaattttgttctgaaatgttgaaaaatacattgtgtgtgcacgtgtgtgtgtgaaatataaaaatcctttaatgcatatcaagccatctactctgaactaggtttttagaagatcttcaggtttaatcaaattctgcctcttagacttgaattcaaacaaaatactatactattcctattatttcataatcaaaactaaagctaagaaattgtgctttttaattattttttctcactaattaaaatgggatggaatagaaaaaaattattaatattgtaatgttacatacaaaagttatttgaaggccgggtgcagtggctcatgtctgtaatcccagcactttgggaggcagagatgggcagttcgcttgagcttacaagttcaagaccaacctggtcaacatggtgaaaccccgactctgcaaaaaatacaaaaatttgccggacatggtggcatatgcctgtagtcccagctacttgggaggctgaggtaagagaactgcttgcgcctgggagatagagcctgcagtgggccaggatcacatcattgcagtccaccctgggcaatagagctagaccttgtccctcccctgagccccacaaaaaaaaagttgtttgaaaaagatggtttggatcctgaatataagtctgtatatataaagtttataaaacataatcttttgtatttgttgtatttcttttgaaatgcaaaaggtttagaaacaaccactgatttgttcattatattataaaatattaatttaaatacagctgcttttatgggggtatatgcggaaggatttgagtaagaatgtcattttcaattactattcgtttagcaaatatttattaagtacttatgatacttttatgtatgtgtatgtgtgtgcacatacacaggatacacgttctctgccctgtaagagcctaatagttgtgtagacagggtgtacatttatgttagataagtacatgttaactaacaatgcagcaaatgacccaaaacagtatataattaagttctgaataagaaacacagtcaaatgctgtagtttcacaagagggaaagatcattggtggatgcaagaaaacttcataaaggattaaccttagtttggagaagttggatttggagaggtagagtcacttaggaggcatttagttaatgggtgtaggataggcaaaggcagagagtaagagagaatgttgtatttggagagtggtaattataacagctattaagggtgtctatgtgccaggcactgtaaaagtgctttgcatattttaactataacaactctgtgagataggtgcagtttttaactccatttttgctgaagaggaagccgaggcagtaagaaattaaataaattgcccaagatcatataactctttagaaggtaaaactgggcaaccaatccagtgcaacctgacaactcagttaaacctgagattgagttgatgttctagacttgagctgtcttatactgtagccactagccacatgtagttttgagcacttggaatgtgactaggaaaaactgagatgtgctctacatgtaaaacacacatcaccagcctgggcaaaatggcaaggcttcatctctacaaaaaaagagaaaaaaaattagccaggcttggtgatgcacacctgtagtcccagctacttgggaggccaaggtgggaggatcacttgagcctaggagatcgaggctgcagtgagctataattgcaccactgcactccaatctgggtgacagagagaccccttctcaaaactaaactaaactaaaaaaacactcatcagattttgaagagtatatatgaaaaatgaatgtaaaatatctcaccaataattttgcattgattatgcattgaaacaatattctggttgtattctgatcaactatattattaaggttaatttcacctgttgttttttttttttttactttttaatatggctattagttaatttaaaattacataggtagctcatgatatatttctattagacagtgctcttcaagattgcataccagtgaatgaacagtccaactggagtgaaagaatagaagagtgatgacaggcaaaggaaaacaatatttaggattaaattagaccagcacttaggtttatcctttaggtgatccatgcatgcaccatctgcctcaaatttttagggtgggaaaagttgttaaatagagattcctgtatccattgcagacctcctgaaacagaatctctgagagtagagccatctctaaaacttcagtcatccctaactcattattttaatttcttcattgtaaaggttttaaggcctacccatcaaggggggatctgcaggagaaactataacgctggttttatgaagacaattaatgtgaatgctgttttcttaattttctgaccaattttgttagattggactacagtaaaacgaaagacataggcagttgataacagtgtcatttacagaattgctttttggagattgggtggttgctacttatttaataaatagggaaagtaactgtttaaattgccgtataatttgtagtctagtctttcacggaaatgagagccacatagctctggctatgggatttggtgattggtggaatgtttggaatctttacactggatctagactgtcctaaagaagttggctgtcctggtgtccttaattccatgataccttttgttaaattgatttgcctttttaagttataccagagcttagggctttcaaattaccctgtcttataaaagatattgatctatttattcttctaagaaacaatcatggtgagccatttttagcttttttggaagtaattgataataaattaggcaaatcagtcttatttcttcatgatgacgtagagtttgtgaacctcaaggccttatagtaatattccatattaacctaaaacagtacatagttctcaaagttatgttgaacattgctttggctacctacattcttgaccaatgatcaattaaaaaatactaatgatattgattaaagaataccatccttcttggaaaggttaccagaaggaagtaccgtgcctgaacagaattctttacatgaatggcaattttattagacattcatcagctattttctcaatatatacctttttttttttttctaaagaatgtgcttgacctgcttgcctaacctgaaggcgtaagaaataactttggtaaagtgctgggtttctaacactttttaatagctgaaaattgctgtccactacctccttgcaaatattctcaaatgattttcaataggacataggaggccacaaaaattaaatcactggcactgagtagaaatagccacaaggggcggagcgcagtgtctcatgcctataatcccagcactttgggaggccgaggtgggcggatcacgagttcaggagtttgagaccatcctggccaacatggtgaaacccccgtctctactacaaatacaaaaattagctgggtgtggtggcacatgtctgtaatcccagctattcgggaagctgaggcaggagactcgcttgaaccagggagttggaggttgcagtgaaccgagatggcaccactgcactccagcctggtgacagaacaagactccatgtcaaaataaataaataaaaaataaaaataaatagccacaagggtattgccccactggcaaaacatttcccatttttaaggtgactataatttggaatgcattctctcatagtattataaataggcttagtcttctagagcaacctacaaaaaatatcttaaacttagctgaataatagtgctgtttcaccttcctttatcttgacttggttgggaaaaatgtattcctatgataatagaagatgcccaattaaattctctttcctttttgttgaaagaagctttccagtcaggggcattgagaatgggtaaaccttcataaacctaaatatcttgtataaagtatttctcaaggtctttcttttcttggaggttctgaattgtggcatagagagatactgggtctctgcaggggtaggaaatccaaattactgctgtcttctatttgcttatatgagtcatttgtgaattgagtcaggtactttttataccaatatggaggagaaataacacactttttatagtttattttatacacattcaacagaggttatgtacacaaactaagctctttgaaggcttatttgcttttatatttccagcacttagcacagttcccagaacataaaagatgtgtttgttgaatgcatgaatgattacagccttcctgaagagtctaaattctgcatggtcttttcgagattgtggtaatttgatatatacattatttttatagcaatttaaaaattgaatcatgaactttatagtaataagctcttttagattctttgctttctaatgtaagagataatacatattctgaaactttaaatgggatagccttgttgcctgccttaaactcacaataagacaattgtttctggtgcaatggaaaaattagcaaaataaagagattgcttaattgaattaaatcgccaaaaaacaagctaattttccaagttaaaaatatctctaaattgcaatatcaagggaatgtttctatttttaaataagaaccttcttacttttggccttaactgtaaactccacttttccctaatcttacccttcatgaggcatagtaggagtacatgtagtctaatacttaggagcatgggttttggaactcagacctgaactcacactgtactctgccacttactcctgtgtgattttggtcgaactacttaaactctccaagaaatctgttttctcattgtaaaatagggacaataaaggatcctgtgatgtttaaatgaactaataatgtctataaagcatttaggcatacagaaatgtttaatacatgttagtcgtcatatacattgcatctttctgcctctttcattcatgttgactttttcccctagcctttctagctactttttaaggactgagtttaagttaactattcattgtatttttttccccatctcttactttctcatccaagttcccattagtagtccattactgcactcaccatatattatggttccatgtttgtctgccttctacagtagatcatgaattcttcaagggcaaggagtatgtttgtacttttctcagctcctactacaggatttgccacatggtgtttaatagagtatttgttaaattgctaattgacttgtatatggaactcttctataaattgtgcaatgttaatcaaatgatagtgctattttaggacttaatatatacctattaggaagtaattatttggcatttaagtacagaagattagactgttactacaaagctaattgaacaatgactccaagtactagactataacaaattctttaatcatctgtatgtaattgatttcagcaacctttaaaacctcgtatataagtgaatctatttgcttcctgctgtaagccatcaggatcagtcccatcttttaaattgttttccccccagaattttaaagctgattgcttaaatataatattttatttagctaaaccttgaccagcattgagaacttggtatgtgtcaggcactgaggactttagtatgctatctggtgtaagtccttacaacaaccctaccagatagaggtagtcatgttttccatgcctttatgattaaaaactaaagtttagatgggtaatttgcactaggtcacagagacagtaagtgctagatcaggatttgaacaagcattcaatactttatatgtattacctcaaggccgggcgtggtgatccacgcctgtaatcccaacactttgggaggccaaggtgggtggatcacttgaggtcaggagttcaagaccagcctggccaatatggtgaaaccctgtctctaataaaaatacaaaaatcagccgggcgtggtggcaggtgcctgtagtcccagctactccagagactgaggcaggagaatggcttgaacgcgggaggcagaggttgcagtgagccaagattgcgctattgtactctagcctggacagcagagtgagactccatctcaaaaaaaaaacacatacactttatatgtattgcctcaaattaaatttttaaagatgataaagttcaaataaaacttaggcagcgtgattctggggcctaaagttttatttgtactttattaatgcatacaaagtatctcatgcttgtctcagagtagttgttcaaaaatgatagctttttctcttctgataaattaaaagatgactatgtaaaaaccagtcacctggaccttgtaagggaacatactgtccaaacctatctgggcttttacattccttgttgcattgttgttgaccgtcttattttcctctgagaggacgatccaacatataagaaatcacagaatatcagaaaagggtgcagaatagtaggtttgtcttgtttcaaaattcagttttattttccattgatgattagtcttatcaaaaagcaagttacttttttaagacatctgtgaaattttaggtgttttttttatcaccgtgtatatttgtccagtatcttgagtaataaacatttgtcatttttagatttttaaaacgtcacctttgcagcttgatttgaatgtgaattaacttgatgtccaatatcttaagatccagataactcacacacaatttcactaataacttgcacacaattttgctaatatataaatttagaaattcagtaggtcaaatattttctgattgttattacatatagcaaaatcctggtataacacagtttacccttattttctttcttaatatcagcattatacaggggttggttctatgatgtttagaaaaaatgctttaaagatatttaaagccctatatttcatgcaagcattgttcatctttttaaaaacaggtaaatcaacagactgggaagatgatggttggggagcatgggaagaaaatgaaccacaagaacctgtaagtctttacaaatatatgcatgttttttgatagtggcattttccttttgtaatgatggtgacatatttccctgtcaagctgacattttaaattcgatgtcaagaatatttttgtgcttacttattagtacttaactagatacctcttcttaaggaacttaatgacattgtagctaaagcgggtgtcttcgttcacttggtgttgctataacagaatacctgagactgggtagttcataatgaacagaaattgattggctcacagttctggatgttgggaagtccaggatcaggggccagcatctggcaagagccttcttgctgcatcataatacggtgaaggtgataggaccagaggctggtggagagggtgggagggaagaaaacatgggccaatactcctctttttataacaaattcactcccacaataaggaacctactccctcattaacgtccttaatctattcactctgctctcatgacctaattacctctcattaggccccatttcccaacactgttgcattggggattaaactttcaacacatgttttttgggggcacattcaaaccatagcagtgggctaaatggagaataattgttttaggattctttatctttcataaattattcttttatattctttcactattcactcaaatatttgctgtacctaccatattctacgcatttttctagatgctgggagtatagcaaggaacaaggcagacaaagttcctatatatgttagtatattttcacatatgagtaataaaaaaatctaactttaattggcttaaatatgaagaaaatttattcgcttacatagaaggaagtccaaagatagaatggaatcctgggttggttgatcaggcaattcaaatatgtcaagttatttcattctgtctactttgtatatgcagtgttggcttcatcctaatgcctgtttcattcacagatgtagtgtggacaacatgtttcttcattaatgggtagagggagaaaaagacttgggcttttcatgactctttcaggagttagggagctactttcttagacgtctctagcaaacttttccttatgtcttcttggccaggattgggccacatgctcatttctgaactaatcactggcaagggatatgagatattcattgttgaatcatattattccctggagttagaggataagagggtcagcttctcctgaggcccatggccacacggaaggagttgatacctgaacaaaatcaggattttttttttaagaaagaagaatgaatattagataggtcttcttacagtcctatttctgggagcttacactctatgagagggagacataaaaaagaaagatggatgaaaaataattcaaatggtaatgtgatagcaagtgactgctatagattgggtggttaaggaagttttttcagaggctgtgacagttaaactgagatctaaaaggcaacagggagtcaacaacatgagaatctgacaggattctaggccagggcagcagctcatgcaaagtctcaaggcaggaatgggcttgagagtttgaagggacataaagaaggccagtgtgatgtagcaggactgagactgttccaagatggggcagagaagaaagcaggccagatgtcaagctttgtgaatttggtgtttattctaaatgcaatggaaaaccacacttacctgatttctgactttgacagctcaccttggctgctctatggaataggttgaagtagggagcaaaagtagaagcaggaagaccaattacaaggctgttgcagtagcttagttgagagatgattgtggctttgattaaggtggtattagtgaagatgagaaatggatgaattctggataattttcagaggtaatgataagactttccagtgagctggttatgaaggatgagaggaaggtgataaatcaataataaattctttgatctggggtgtggtgtgaaatagataaaacacgattgttgaaaggttgatattctcaaaaggtgagtaatagatgccattctctttacttttgttaatatttttaaatatccataataagaagtttttaaaaaaccctgccagatatttggcttgaataactggagggatgttgtgtcatacccagttggggaggatgaggaaaagaacagctttggcagagaaatcagagagcatcatgtgctaagaagtagagatatgctcatgtaatagagatgtatggaaaaactccatgaggagattaagaacaggaaaccatttcagaagacctctaggagaattaggatgtgttgaataggataaaatgcagctcagggaatttggttactgcagcacctccgcgaacaacacctggtcctctttctaatgctatgtcaaaatggagcctcagctattctgcttttcctaagactgactggttgctgcttactccggatttaaactattgcatggcttttgctatgtctcttgtttgtggttgtcttagattatttctccttctttgtttcacattcagagctcatgtgaagattttactgagtctgtggattacaacctaatataggatatttggggagggggacatactgtttacaccaggccacttcatgggacatcagcagctatattattgctgcctcctggtcaggcattcatcagcagtttaattcgctatggcaagaatgaggaggggagggaaggaaaggagggggtttgtgtaaacaagcttggagattcttcatgattctaggaaagtaacctttcagaaagggatgtgcttggagaatttcccagaaagagatagtgtaaatggcacttaccttacatgtgctatttggtagacttttagtatttgctttctgaaatcatgtagctaagttaccactatgaataacgtaagagacttccaagtaagtttgaggttttctggaataaacctcacaggcattgcatactaaagtggacacatgcatttataatttcagaagaggttccagtgtgacagttattattacatatatagaatagtgctggtgctgagctatagtataatatttcagacccagatggccacatcttaatgagcccactgatacatacttggctttttctgtaatggatttttgttaatatttgtgaatgacatagttaggcatttgtgtgtgaggcaagttgtccttaaagatatctactaattcttccctgatagtattaattgggttagtttagtcataatgtgccacagacttgctttttggctcatctaaaatgtgccttcctaagggtgtgccgctttatggcattataacctaatgagtagaaaagaaggaaaatgtgctatgcaatggggtcagagaagcaagtaggcctgatataaggctttataaatttggaatttattctaaacatgatcagaaaccacattatctgatttctggtttttcaagctcaccttggctgctctgtggaatagatgcagttagttttccttgtatttttttcttaattagctatattattcttttattttcttcttaattagctgtatttctcatactcatgagggtcgtgtgcctctttattttgcagtatttcattttgatgtgccactattgcagctgattctgagtgacgtggacaatgatagcatagttagaatgcataagtgttaacacatttcctttatatctgacctgtaaagcatgtcttcttttttcagcaaggatatactaaatctagggataacctaaatcgagggatctccagggataaatgtaaggatcttttaaacaatgtagttaaaagctgaaagatgcttctactcattctaaaaacacataaaaatactgacatgtagaacatttcttcatttggataaaatcggaatatttacaaatggccctaatggatgagagtagcttggtgttctttgtcttgatagatttgctcatactgtgacttgacaaacacagcaagtgaaaattgttgatagacctcattcacaaccattttgggtgtaccaattatttctagctgttcttattatccatttttgaacccctgtaccttgtcatgggtcatgtgtacatggtgagggagaatgcatttgggtgacagtaaaggtaggcaggtacaatgaagttcagaggttatctagttgttcaagttatcctggttgttcaagagagcctctttgaatttggatcctttccttaaaagacatctttgctaaaggagactggtgggtgggaacaaaaacggcactatggtcagggtaaggactgtgacctctcccttgaacagcagcatcaaccagaactttccatatatagcactattatgaagttttgctgagcaaaatgttttataccaggactattagaaatctactcagctgaagtaagagactcttatttctactaccatctatgattatgaacaactccagaactataaccagctccagaggcaagaattagaataaattttggcagatgtgtgaaatgtaaaagtatatgctctagttgcctagttagaatgtaaaggagtggaaagagaaccttttactctctcttattaggaacagataccaagctcaaaacctacctcctctgagagtctgagtcttatccacattaaagaaggaaccaggtttggaagaagtggaatgtcttgaagtcaacttacagtgtgtcaaggcgttataattataaaaacaattatagaggccaggcgcggtggctcacgcctgtaatcccagcactttggaaggctgaggcggtcagatcacttgaggtcaggagtacgagaccagtctggccaacgtggcaaaaccctgtctctaactaaaaatacaaaaattggccaggtgtgttggcacatgcctgtaatcccagctactttggagactaagggaggagaactgcttgaacccgggaggcggatgttgcagtgagccgagattacaccactgcactccagcctgagcaacagagtaagactctgtctccaaacaaacagacaaacaaacaaaaaacaattataggattctccaccagttgccattggtttgaggttattataaccagaagagggtaaacttttcttctgcattagtcgggtgttacggagatggtgtgttttgctcttcaggagtgctgcagtagtgtgtagataagccacaggaggggaagcaaagaggaaaggagcagcagccactgccacagaatgctgacatggaggccaactggctgctactgagttcggcaaaaacactaaaaactccacagtgctttttatctccacgagtgtgttagctctttgagagtagtttcttatttttatggcagaaaatgacttttatgttcagagtgacagtactgggatctggacaaggcttttttaggaaaggagaaagcctctttttttctgactctaggttgattctgattctgatttataggtgttagctataataatggcttagtgaagaaagcatattttaatatacactatcggccgtagccaactatgtccaaggaagtgtacatctatgacactggtaggcttaggagctttaaatagtttctgtgacagaagaccaacatctttctgctatagctatttcatgtctgtattcatctgctcaggctgccataacagtgtaccacacgctaggtgacttaaacaacaaaaacttattttttcgcagttctggagactagaagtctaagatcaaggtgccatcggggctgatttctggtgaggcctttcttcctggcttgcagacaactgctttcttgctgtgtcctcatttggcctttcttctatgtacacatgctgggagggaaagagtgagttctggtgtctcttcctcttatgaggacaccagtcctatccaactcttatgagctcatttgcatttaacctaaattacctccttaaaggccctatgtccaaccaagtacagtcactttagggttaaggcatcaacatatgaattggggtgggggcaaggggacacaagtcagtacattggcaagtgtactgaattgggcaagtgacaaaagtaaggttaaggaatttcaacttgcctataagtaaatacaataagagactgaaaaggcaagcagaacaaacttttaaaatggattgggatagaagaaagatggattgggatagaagaaaaggtaaaacaaagatcttcctctatactaacttgattttaagtgacatgatgacaagatagtggctggcttggggacattggaaaagaaggtagatgccatctgctgactgatgatcctataacaaatagtaaatagctttgctggtttttttttttttaagagtattataaaggcttttagttggtattacaatttttttgctatgagaaagaagtaattagaggagaatattttgttcagccttatgctgtaaagggaattgaggcagtttgggaagaagcttgaaaggcttaatttaatttcatggcaagactgatttaatggactttccttcattggtgtattaaggccaatggtaggaagtatagacttggggatttgctcaatagtaaacagctagtggttaataggtggtaaatgggtagtggttactggatcaggaatcacaggaaggttctgggtcaaggtcttcagttaaggtaggcagcatggaaaatttccattcaaaagagcctttgaaatgtgctccatctgttttacagaaactgttataacagtttagagaggcaattatgatttagcagattaacagggtgctggtcagatggaggccccagagaattgtttgtttacaggctgagaagtggaatatagcacgacctgattggagattcctagaacattaataatctgggatgatactggaaaatgttttgccttatttcattattttcagtagactctcatgccacctgccacacaggagacatgagcatcagactgaccagaggcggaagaagaacacttacaccataaggatatgccctaggttatcctctgaggctgggcaagggtctcctcattaggctgtttcttattaggactttggactttggattgttagaaacactcattttgctgaagatcttcctctctacattaatacaagcttagtctagcctagtgattctcaaccatgggtgatttttgcctcctcagtggatatttagcaatgatttggcatcatctagagacatttttggctttcacagcttgaggggggtgcatctagtgagtagaggccaataattctgctaagcatctttcaatgcacagaacaaaggattttctggccccagatgtcaatagcgctgatattgagagaccttggtttatttagcccatggctcttaatgtaaccctcccagtctgtcttttttgccttttccccattttgttctccaaaacttcttgaccttcagagcatttgatctataagatcattaatttaattttagtagagtttggtgaagtgatttgctgttgtgaaaagtgcagctaagtaattgccaggaaacaaaagttaatttaagttcttcttggatctttggccagagcaacaagttgtctaggcttggtctctgtggcattatttatgcctaaatgcttaagctccatgtagtcagctgcaccttttcctttctcttgtttataactgttaattttagttcaaatctgcgctccttaggcattcctgcagagtagcttctgttaagtgagttttggtttggtgattggggcctctggtcttctaccagggatctggctgggtggtgtggggaaagggagcctgggacctgactactggttaaacacacttgcaaccaagcctcctgcttttagccccatccatacctttacttctagggggacctggtgccaattcctaaggctgctggtgattttgcaatgcaactagggcagcttctcagctttcttctccatcagtttaggagttagctttctaggaactgtaaactcagtgaccacctgttcctttgttttctagctctcacattttgtgccttttctccttgattttgttcatttgttttttggaggaaagtttttttgtccttactggttttgcctttaaaaagaattcttttactgttgttcttactggtgctagggagactgagagtaaaattcatgtgtttaatttaccctgtttacctagagaccaaatagactttaattttacacattattctactccttgctttttctatttaatgtaatttggaggtttttccatatatgtaaattatttcattcttttcaaggaatactattttattgtatagctgtactgtgatttatttaatcacgcttctgctgaagggcatctagttttcctttgccctttttcttttcttttttcctataatgagcaatgctgcaataagtacctttatgtctgccattcatctttggtttcatgttggcacatagtgtcataattgagagtccgactgcctgaatttctgtcccaactctgccacttactaattatgaaaccctgggcaagttatttaacttttctaagttcagttacctcatttctaaagtgatattgataacaataccaaactcatagtattgccatgaggattaaatgatatatgcttagaatagtacctggagcatagtaagtgctcaataaatgttagctagccttattccatcagaataaattcaaaagatatatacattttcctcttttttttttttttttttttttgagatagggtcttgctttgtcacccaggttggagtgcagtggcacgatcatggctcacttcagcctcgacctcccaggcctctaatttttcagtttttttttttttacagatggggtcttaccatgttgcccaggctggattttacattttgacagaaattgttgcatggtgcttctaaagggctagccaatttgtattccaaatagcagtgtatgagagtacctttctttacttgttgtttacagaaataaaaacagctctgagccagttgcttattatcattggctgtgtgctattgttttttttttttaagtgaaatatttctctccacccatgtttttaacaaatattgtattgggaaacaagactgtgagagatgaatgcgcttttctcttgctgttctcaggtatttgaaattgttgactcctagtatgttatcatactttagtctttgctaaaccagatcaacgtaaaatgccatttcagtgttttaatctatattttaaattaatgggtaaagtttgtcattctttcatatgtttttcacttataattcttttggggaacgcataccattatcttattttttttctaaactccaatagcagtttaaggttcattgcacttactttagctattaaatctattctgatttatattgagtgagagttatttcttatttactagtattgtttatccaactagatgatagtttctgagcaggaatttttttgtcactttcttttactccatgacacctagatttagtatgtagtattaaacagttgtggtcagacaaagtgacatgtgcctgcctatagtcccacctactcaggggctgaggtgggaggattgcttgagcccaggaggtagaggctgcagtgagctgtgattgcaccattgcactgcactccagcctgggcgtcagagcgagacgctgactcaaaaaaacaaaaacaaaacaaagcaaataaacagttgttcaggcaatagagaagtatacatttagttttggagttccattgtaattgtttatgaaatgaattttgtatgagtaataaaatacatttgacacatgtttattatagaaaattcaagtattacagaaaaataaaaataataaaataacccatccctaacatctaaaaatgatcatcattattaactttcaggggttctgcatggctctacacaaataaaggggtttttgggggtttttctttggcactatatgaatagaaggttgagtgggcagatgaatgggcacaaagaacattttatgaaaatgagatcatattatatatacaattgaagaataaatggcagaattaatcctacttgaattgacagttgaagtaaataagagttactgagttagagttaagttcctctaatgctagaaagaaaggtaatttttaaaattgagattgaagttatagtttttttgtgattaatttatttgtgagaattcctttgggccccttcaaatcaaatttagaaagagttcatgtctttccttatgttgaaaagatctcaggatctttcatttgagaattttagtctctgatctgaaatgtggcctagactagtacttttcatgctatgtgtgagagagctctagggttctacagaggtgctgtgtagcttcctcatttgtgcttttatctatttcatatattgaatttttgtaaaaaattttgtttgggagtacaaagttctgctatctaaaaaaagaaagtttgaaaaatattgagcattttatagttagtagcagaatagaaaaaaaaagaaaaaatccttagtaactagtaatatagtgatgtttactttctttttgtgtttcaaaattgctgaagcactatgtgtcttgctttaaaagtatagatgaatattttatttctatggcttaggcagaaagctgctgagaattacagagaatgtgctgacagcccttagattacactggatcttactggtaccactaaaatgtgtaaatatctgtgaaagttagcaaaatgacagtaacaacataaattgcaaatgatggacttatcgtactaaagttgaaagctttgaaaaaccactcctggctacttcagtgactacgtaagtactacaatagctgaaaaaccaaaaaacactggccactgtgtttacccagtaattaccagtccctataatgccagctatagttgaaagactgatttaattactacaattttattgtctgcctgcattgtgtgcttaaaatcaaaagaaagaaaatttttaaagtatatgctctatcccatattgcgttgtttagaaagaattcctttccataatgcacattagtggcttctgtatttttgtagattaagaaaacttttttactggtcttaattcaaaaaaaattcttgaagtttaggccatactaaaatataattatagattccctcccctcaacaactaggattatgttttataggtgcattcattcattcattcatttttgcctttataaaagcaagttttattgttatttaccatagtagtgtcagaaagaggaacagattagctcagtccaacatgattggcagctggcaaaatctagtgaagcaggtgttctgattgctttaatttgggggatttaatttggttgcttttaatacttagccatctaacacttcaaacgtaatgcagaataaatatttcatctccttcctttttactttaacaccacacccacctcacttcaatatggaaatatcttcattaaatatgatttccaaaagaacaagttccctggagaatatagccatgaggacagtgcataaaaagaaaaactcgaaataaaaccctgtatgataattttctattctaagaaaacaaaagtttccagtatatgaagaaataaacccagtctcagatgcactaatatgtctgtgagaagcggttgtggtataataactgaaaactgccagctattttcaagatactcaagtggtaatggtgcacctagcccagcagcagccctcagaagaagccagggtgctctctccacgtaggccagtgtgttagtccattttcatgctgctgataaagacatacctgagactgggcaatttacaaaagaaagaggtttattggacttacacttccacgtggctggggaggcctcacaatcatggtggaaggtgaaagccatgtctcacatggcgacagacaagagaagagagcttgtgcagggaaactcccctttttaaaaccatcggaacttgtgagactcattcactatcagaacagggcaggagagacccacctccataattcagttacctcccaccggcttcttcccacaacacgtgggaattgtgggaattacaattcaaaatgaaatttgagtggggacacagccaaaccatatcagccaggtacaaaaaatccatcttcagcttttgcctcctaaagctgtcccatggttgggctgcactgtcttatccacaaacgggacagaggccttttcagcagcaagctggatcctactcgtgatgatgcacatggactgagccactggaataccaggtggcaccaaggacttctacttatcatggtcagcggtctgagagcctggactttttcataattgctggaactggctgggctattttgtgcggatcttcggggactccactcacctgcgttccaggagcgagactctctgaacacccacttcacagtggcagggaagggacgggctggctctcagagccatggagcttagcgcagccaccacaacgacgatgatgggggagactgcaggcaaattcagtgtcaactttagtaacagggtgggggaggcaagttttggtggaaaacccaaggtccctggtggagcacctttaagcagtgaggtgctttttttgttttacatttcaggcgtggcttgggaaattaccttgtcaaatgatattatttttggatcactagcttcaaaggggcagtgttagagactgtgggccccattattggggaagttttccaaaacgctaattagtaggcaaatgcccttatgacacaaaacaaaatgatgagcttgcatcttgtcagccactgaatgtgtgctgatgctctattaggcttcccagagcattgttgtttacagccctatttcttgcctgagctttctggaactggcgctggaaatcatattttgttgtaaaacctaatactagctcattgtgatccagcctagagagggcatttcctaatctccactataccaatattttcatcaagttatttgtgcttagacttgagacttccctgaaaaatctggcactggagtcacttcagatggactcacactctttattcttggtttgtatttctgcagcccttctggagcaatactgtggcagtgttgtacaggatacattaaagcagagagagagagatatgagaacatcgagggtctagtctttctcatggattctgacccacaggccatttcctcattcttcctcagacccctgattttagaagtgaaggaccagagttcctctgtaaattgtccagggactgtgtgaatgtatgttgctttaaatgtattatctatagtattggcatggttagtgaaaatccacttattctttttagagcttgatttcttttctggaaaaggaggaatttcactcaaatgatccctgtagttccttctgtttctgttaagattgaatcatcctgtcagttggcttcaagaggattatgacatgtgtaagaaggagattgttgatctgtacagacaagcagttctaggatctttgcttacattgtcttgcacttagtactacagtttcttaatttgtagatttattaaaagaaatttgatttacctgaggatttctcccatccacacctccagcagttttctgttttgaatttgcttcataatatggtaaaatttactctggctgggggcaaaatattatagctaagcttaaaacaatacatttttacctctttataattttaaggatattatttggtttgggttattgtcattagaggctttttgtccttgtattgaatctgatatgttgaatactgtgccttagtcacaaagaagttactttagaattacatgtgaccaggagcttgcagttggaataggtatacagctgctcccccgtgtggttgtggatccaaagagcttgtggagcttgtattaagagcacaacaccattgcattttgtgacaagttagcatcgttcttttttttttttaaattatactttaagttctagggtacatgtgcacaacgtgcaggtttgttacatatgtatacatgtgccattttggtgtgctgcacccattaactcgtcatttacattagatatatctcctaatgctatccctcccctgactccacaccccacgacaggccctggtgtgtgatgttccccaccctgtgtccaagtgttctcattgttcaattcccatctatgagtgagaatgtgcagtgtttggttttctgtccttgcgatagtttgctcagaatgatgtgacaagttagcatcattcttgagaagcacaactaaaagtttagatctagaattttatggcacttcaaactctaatgatgatataataatattatcgtattttctaacctatttttataatatgtaatgctcagttgtacatatccaactttaccatggcaaactgggaggatatatttttagtaccacagtaacagagaaagttggagaagtagaaaggacatagaaaataaactgcagtaaagaatgatggaagattttggctttttgcttctttattcccccgtcttcagtggatgaaaccggaataaaaatccacatcaagttttattctcaagtttcatgtaaataaaaatgtacatgtataagatggctaagcaggttagggatatcataattgattatggaatcatttttctgaatttgcttccaagcaagtgacatctatttccaatgcttttgtcatgggtagtccttttgggacaaaattcatgtttgcttctgagatcacttatagtccatttgttggggtagcagcagcttgatcataatctgacaccgagttttaggcccaactaagaagactatgatacagtggtattctgttcttatatctctttaacttgtacttaccatgaatatgtcagccagaatcttgaactattaaatcttagtattacttaagaaaaaacattactaaggactgaatatactagctttaggttgattgttcattgttatacagtttcaggtgtaagaatagataatatattatttaagagatagggaatgctgttatttactcctatattctattagtggactgtgctacatgtggaggtgaaaaataatataagccataggctttgccaacagagggcgtctcatctagtgtgggagaaatgcagtcacagaataaacaggtagcagggagtagtaagacttttaattgcagtaagtttgaaagaaggttaggagtcaggataggatgggtttgccagaggaactggaacttctgatggaaaaacagaaaggagagggaaagtatttttaaaggagttcttgaagaaatacctcaagaatactctggctcacatattcaaatacagtggtcatcttgtagctgtaaatcgactcaaagaactacagaaagattaggccggaataaagtgacaatacagtagttcttttggagaaaagggttttcactgaatatgagattagagtcaaatctcaagtaaagacaagcttccaaagagctagtacagctacccacagagatgagcagggtgatagagtggaaagaccacctgaattaggaattaggaagcctagattttagtttgggctctgacactaattctatggctggagcacatcccttaacctctccgagactccattttctttattataaaattagaatttggaccagttggcctctaaatgtcttccatctttgactctttgtcttttctgtgcacataaacatcagatctaatccttgttagtggcattattttgaaaacatgggacagaaacataggaacaatattctttattgaaaaaaaaaagaaaagcaacttttataatatttttaggatttactgattaaacatagttttggaagtgtgataagaggaaggaatctatttgtatagatgctcaattattaaaacaaatttttttgagaacatgcccaaataagggctgtattcctttcctgaagcattatattgattcttttttattgcattgagatggagattttaggataagagtcagagaccaatcaaagagttttggaccctcctaatttcttatcaaaagcaatgcctaaataatattcctatataagctgtcctcttctaagctcctacctgaaagtggatctctaatcacttagaaggtcctgtgcctcacagttggtataattggagtctcagttgttggaggaaaccatcgggtaatgttgtcctcagcttacagcaagccatcatgaggagtgatgtgttgggtaaacaaagactatcctacagcagaagttgtggaaccagggaaaaatttaattacaactaagttttaccttcataacttttatctttgggggataattttctaatttatctgtagaaaaacaaacattaaaaacaacaagctagatacagaattccttaagaaaagtagagctttaataaaatgagattttgccaatgttatgttctccctatctttcgggagatggtgcagcctccttagcttattttgcttgagaaaaaagttccaaatctgtttgtttcctaatatcccattgcaaaagaaaaataattgcatgactgtcccagaggtttcaggctcattttggggtatttctaaagattccctgtaacccatattttttttgtgttttaaacatttctttgatggtatcccagcaagaaataatttattcctggaaatatgatactactgtaacatttctgactaggatgattttctgtttctaaaatcttttaaattttataatgcttgtaatgcatgcttattacaagtttttaaaaagcatgaaattataatttttttataaaaggaaattaacctgcatagctttcccctccctttccctccccttttcaataattgaatctaaaagacattaggtagggctgagtaaggtaggagtctacatgacatcaaacccagaagctgtaagagaatagatggataatttagccacatgacaataaaaaatttctacatggaaaaacttaagccatcacaaataggaaaaactatttgcatcacttatgttcaaagggccaattttgtttttctttttgtatgtaaagagtgtatacaaagcaattagaaaaagagcatcaacccaacaggaaatctacaaaggaagggaacaaactattcatagaaaattatgcaatttgttcctttcctttatataaaaatgagaaattttcttaagtatatgagaaaatgcctaaattctcattaataagaaaaatgtagtttaaaagcatattgagatactacattttacctattaaattgacagagatccgccattaaaatattttttgaaatgcctgtgaaaaagcaagcactttcaaaaattgctgatggaattacaaattaatacaacatgtgtggggcacagtttgggaatattcagcaaatttactaatacacattccctttgacccagcaattttacttctgggaatttagcttactgatacacttccacacaaactgaggaatttataaacctatttattgcagcatagttggtaacagcaaaagatggtaagcaatacaaatgtccacgcatatcgggaactggttaaataaattatagtgcatccataaaatggaatactatgcagacattaaaaacaataaagaaacttcatgtggaagtggaatgaagtctaatgaatatgttaagagaaaaaagcaaagtatagaagtatatatatatatatatatatatatatataatgctactattcttgtaagaaaaagggaggaaaagggtagtaaatgtgcataaagtatctctggaaatacacataagaactgattgcattgtctctagagttaacaactagatggctagagtacaggagtataagagatttttcaaagaacacctttttatagctgttgaatttttaaccatggggatttacctatacaatacataaacgtctaatgaaaaagagaaaacacctgtaggccaaataaaaagaaagaagcataacgttatatcagatgcttttatagatcctataaccataataaacatcacattttttttctttgctgtctagctatctctttgtaaataggattattcactaaatttcctaatgctgaattcctggagtgattcctatgtgacattttttttttttccctgagacagagtctcactctgtcgcccaagctggattgtagtggtgcgatctcagctcactgtaacctctacctcctgggttcaagtgattctcctgcctcagcctcccgagtagctgggattacaggcacgcgccgccacacctggctaatttttgtattattagtagagatgggatttcaccatgtgggccaggctggcctcaaactcctgacctcctgtccttggctctccaaagtgctgggattacaggtgtgagccaccatgcctggccactatgtgacattcttttaatgccttgctagtttatatttgtttatatttaaattttttgcattaatattcaaaactgaagatttgtttatagtgggtattttgtttgtcagccatctttggcatgttttgataaggaatattatgaaactgtatgagaattggaaatatttccttttcttttttttcttccctctcaccccttgagacaggcaagctgagtttgaatactcttggtatttttgcatatgcagtaattgtagttttacccacaggaagaagaaggaaatacttgcaaaacacaaaaaacttcctggctccaagattgtgttttatccttatctccaaccaatgatcttatggtgatagctcgagagcaaaaagctgtatttctagtgcgtgagtatcctattattttcagcgacctttattttgatacattggatagaagagaaaatggattaggtgaaaagaatataatgctttttatttatttatttctctctctctccccccccccccaactcctcctccgccccctccctccctccctctccatttccctctttctcccccttccattctgtttgttttctcccttttttctttcttggctgtagctaccttagtgctctccatatggtacctcaggggcagtactgtgcattgctcaattcttgcaagggacagtcagagctaaaaaggtcattgaccttttcttagtaacaatgtgaatgaggtgattttcaactctaatttgaaaactcataatattatggatttctgtttggggcatagcattttaactcataattttttgttgaagattaaaattgaggtttttttcatatcttatagatctccaaaccttactgatcaaagtaagattgtgtgtaaaatgtgtctagaatggtcttacaaagcaaagttaccctcaagtagcaaagatctagtagaaaaattttctccgtcatctgatgataaaagtagtcttaaactaggcagggtgggcataggagttaataactttattctacaagaactatgacaacattatacaggttgaattgggggaaggagaggctgaaggccaggagactaggtgtattataagaatcttataaacatgtttatcttatatttacctataaaaaagacccaagtcagttaatacacaactgttaaattttgtaatcatattctaaggggaaagagcaaaatttataaattactcttttagtgtattatagctaaaattattttatatgatatcttaattcttacagcaaaatggaaatatagtgataaaggaaaggaagaaatgcaatttgctgttggctggagtggttccttaaatgtcgaagaagggtaggtgccagttaatttttgtttctctgtgtgttacatgtatgtatgaaattatttgacttgtaggtgaatctattaaaaagtttcattatttgattgggtgcagtggttcacatctgtaatcctagcactttgggaagccaaggcaggaagatcatttgagcccaggagttcgagaccaccctgggcaacatagtaagactctgtctttacaaaaaatttaaaaattagctggatgtgatgcgcacacctgtagtcccagctactcgggaggctgaggcaggaggattgcttgaacccaggagtttgaggctgcagtgagctatgatcatgccctgcattccagccagtgcaacagagtgacaccctgtctcttaaaaaaaaaaattttttagaataagaaagaaatttcattatttgaaatgtttagtaaatgtatatgtatcctaactttataggttgtagagaatgattcaatcagcaaattttatatatcgtgtaattatgtttttaaaaaattctgttggaagatttaaggaagaattcaaaaagaatctcgtaaaatcctttttacattttgtcttttccctctgttctccattactaattttattcattgaaaaagtcaagggcaatcattgtcttctctgctttgctgatattgggcttatacttgaagggtacagtactacattaattcttaaaactcataaacacttaagaaatgcaagttggtacattagtttcctgctgacccagtaaagcttttgtaaccatgatatccagtatggtgacatgatggagctgctagcttagaacttgagcccaaaactggttttcaattaaatctttatgactcaaaactgtctgatcagaatgagtaagaaaatccttcatactttgaattcagataaaagacaaccaagtggaagtgcctagaacatgcctggaacattgtagatatttgaaatattctctatcatcaaaataaatggtaatatttctccttacgccatttagtctaagtgttttaaagacatttgatctctgtcagaaatgcaaagcaaacataatactttaaaaacagtgaacaaacacgaagatgaattttgttcattgattacctagtatgatgtatggcatggaagtgtttatagttttttggataagctggtgatgatcctcaggtttgacagatttaacaaaagtcagtgggtaggagttgttttgattttgagacttagtttctgagctcctgacaaatatttcaagtctacatgtcagaaaaaaaatatatcttttttatataacatcacacctaacatgtgcttagaaatagatgatcagagcagtttctgcaaaatagaaaagaaaacccagcaagttgaaatacataagttcctaaaataatgtaccctgcagaaatacagtttgcatgtaacgtgactggcagttcctcaaccatttgcccagctcctgatctcaaacaagaggcaggctgaagttcttagctgaagcagaggagagagagagagatagtaggaaatggctgcgtggggatcatttgagctttgctcagttgtgtatacagtcagttgtgtaagtaaagttttgctttctgtactttcatgtttttcatgacaatacagagtgaaaaattctgttttttattaacctcaaatgcatgtggcattacattttgtgtgaatgaattttatggaccttaccagtggtggagttttactgtatttttacttatgcatcaaataaaactggttcacagaagtcatcttccagttattatcctttaacatccaattatagagaaataaaagtaattggtaagttcagtgggtaagcatatgattttgtttttgtttttagggaatgtgtaaccagtgctctatgtatcccactagcaagccaaaagaggtaaggataaataagagtcatctgttttctttgctttgatttatgagttgttaagataataaattttgtttgtaacaggagttccactgggcgtcctgactggacctgcattgtggtgggttttacttcaggttatgtacgcttctacactgaggtgagttgagttttcaacagctggaaaacactagttgactgcaatatctggttatgcatcacctttatactgtttgtgactttattacctgctgcctgaaaatgtgtagttgattctttatgggggtagaggccgggataggccgtggcaagttctggtagaagatacagagaagaggagctgtattctgaaaagagtgtacctggtatctctggaaaactgttggggaaatggtactctttgcctggccatacctgctaaggtatattggtaagaaaacaagcagggcccttctctgtgcttcctcctagaatggtgtgctcttgcttgcacagcttttgaatgaggacccagtacttcaacttaaatgcagaacctatgaaataccacgacatcccggcgtgactgagcaggtagtgtaaaaaattgtgttccaacagtaacagtggcattattttgaagcagtttctctcctcttttttaggtagaaacttaaaagagatctttgtcttgtggcacagttagttagctctgctatcatagtctagaaatataatctatttgtagctgagtaaagaataccagtcttgcttttacttatttaatgaaatattatatgtttcattctacaacaaagtaaaaccctttagttagaagccaagaaaatttcttatttttagaatttaataatgggaaggcaaaaatatgatattttataaccttatatcttgttttatttggatttaggtgccaaaattacccagagtaaaagaaaaaaaatttggccttgttactagtgatactaccttgtacttaactgtttctcagaaaaggggttactaagcttttgttcatagtggaaaatacatatattcattgaagatttcaactgagaaaataatgctgtttagtatccaaggctctaacttcttaggtgccttgtaacattttggttgtcttagtcaaaaaataattgtagggccatttaaaccaatatgcttttatttgttttgcggagtgcatagtcaaaactatgtaatatgccttccctttgttgtactacttggcctccaaaagatttcaagtgaacagatgtatatactgtatgcatttgttaatttaatttgcatgggagatggactggagctgtgaaagaatcttaactatctcgtaggagagactaggattaaaatctaataatatctatggatgaattaatcagtaatataaagcaatacctaatttattggtaatttatttggacagaatacagtctgtacaagcttagagaaagaggagttcaatttggaccaggaaaataagaaaatttcattgatgaggcgagatttgcattaaaccttgaataatgggtatagaatttaattaggtaatagaaaagaggggaaagtgtttcaggtaatcaggagaagatttgagagaagattcgaatgtagaactatatatgcaacaacaaagaaacttatgttataaagtaatgagaaactgtcaaataagcagagtggccaaattttgcataaattcaaaagccaagtgaaaaatgagagttgattcaggaaatgagagaaactcctaaagatttatgagaaggaagtgaaataatcaaaggaatattgaagatttctttcttcaggataaactggaattagggaggctagttatctggttttttaagtcatctgtaacagatgtggagtgctgggtgggagccaggactaatatggtgtatgggaagagagaaaggactagtacaaaaattgttttggggccgggcacggtggctgacacctgtaatcccagcactttgggagcccgaggtgggcggattgcctgagctcaggagtttgagaccagcctgggtaacacggtgaaaccctgtctctactaaaatacaaaaaattagccgggcatggcggcatgcgcctgtagtcccagcaacttggaaggctgaggcaggagaattgcttgaacccaggaggcggaggttgcagtgagctaagatcttgccactacactccagcctgggcgacagagcgagactccgtctcaaaaaaaaaaaaaattgttttgaagaagaaattaataggacctggttattgtgtagagatgtacaatttttttaaaatgagctaaagatgtctctaagatacttatcctgaggaatgccattgtcaaagttggaataggggactacattggcagtaaatgttattaaatgaggttttgcacatgttgagtttgaggcgatggtaggaaataaaatcaagttactgatatcatgtaatgatacaaaactgttgtataggcacagagactagattggacacgatggttgaagtcatagataatgaatgaattctttcaagtaaagagtgtaggaaaataaaactgcaggctgaagacttaagtcttagtaactaataatactcatcgtaaggagataggagaaattgaactattaaaggaaacaaggaacagctggaaatcaaagaagataatctgtgaactgaaaataactttccagagatgtttttcatttttctaaaaattgactggatgacgaagctttttaaaatacgttaaatttggtcatgtctgtaatactcttttttagaactggtggaaaaatataactaacatttaaatatttccttgctatttgctgtacaaagcaagaaaatcatctcaaaatttttatcaagaaggaagtctttgttgttactctgtatgctacgttaaacagctctggatctgacacgtcaatttatatatcaaaaatatcttctatttgcttctttttaatatactcccagatttgtcagagatcacagaagcacatttcctctaattcagctctaggagcaatgagtgtagtacgggtgacagcaggtcattcgtttcaggagaggattcgaaagagaggaaaaatctcctggaatttcaaagaaatttcttttgtataatagcttctgtaaaaagatcttctctgtcatctagcacagtgtctacagatttggggccaatggtgtttgtattagtgttttcttcaggaagactacctggttttggagaaactaacttgctagtgattaggtcttttctgttttctagctccccaaagtcagtgaggaggctctctccctgctgctgtgatcactgggccatgcatgcttagtcttgtgaacttgtcatgtgagaacacatgccatgtcccttccccactggtttatgcccctgtggccctgaagtcttctttaaaaagagaaacagcctgacagtccagtagaaaaaggagcaaagcagatttcaagagaagaaattggcccaaaagcatataagaaaattttgagccttaataacaatctaagaactataagaaaatataatgagataacttttcaccttttggattggcaaagataaagattaacaaacttttgatgacaatatagagaaacagtcactctcatgtattgttggtggaaatataagttgataggtactctttgaggcaacttaatatatatgagaatgaaaattgtgaatactgtatgacccaacagacccacttgaaggaatttacactaaagtaatatcttactaacatgaaaagatatagacagaagaatgtttattgcagtgatgtttataatgatgaaaatatgttaattcataaatattctttactgcctattatttgcccagttcatttctaatccctgaggattcattggtgtaacaggcatacaaggttcctgctttcatggggcttacagtttggggatggtagagggaaaccaacagtaagcagctagagatatcaaggtgattccaatctctgataggtgctgttaaggaagtcatgttgataagatagtaatgtgccaagagaatatgtatgttgtttgagatggaggttcaggagcagcctctctgggtaactaacatttgaactgaaacctgaatgacaggaacaattaggcaggtgaagatctgagaggagaagatccaagcacatgcaaaggtctgagggtaatgatgacctctcatatttgccagatgttgcagccatggttaatgagttcaggttttattctaaatgcagaagagagtcattgaagagttttaatcaggagattggtttgatctgctatgtctcaccaagagcacactggctgtgtggagcatggattgtagagagcaagagtggaagcaggaggccaaactgaatgtccgtcaatatgaactggttaagtaaaatcgggtacatataatgaaagactgtgcagccacaacaaaaaatgatttgttcacttattgaaatggaaaaatatcattgacatactattgagtagtaaaaaacatgttaggatactatatgtgctatagccttatgcaaatgtgtatgaatatatttggggatgtgtattgagacgtgtctgggatttcaggtgagttttcttctgtttttacatactgtttgtatctgtgcaatgagtatatttactttttatgaaattgtaattctttatttactctcagcatctttgagataattattcaccatacacaaaaggttatatttgaaaagaattttaggtctttggcaaaaaggcactctcaaattaattttttatctatttttactgttcttctgcctgatattgctttgggtgttgggtggttatgttacattattcgtgaaattcagtataataaaaagtagataagcttatttatctattcaagaactttttttttttatttcttaaatagaatgaagagttgagtatcttatatccagctgccattgtgactattgatggatttagcctttttcaatctcttcgtgcttgtcgaaatcaggtagcaaaaggtaatattttggcaagaaatatttaacctctgttaatgtttgttttatttaatttcacctgcttatggaattaagtatgtcttctaaataaaaaaggccttctgaactagatttatgggaaaaacctgccttctgtagagaaaggggagcatgttgagtagattgcttagtaaggtagagatgagctaaaacataaacactcttcacacgttgcctttggagagtgtggtcagcacaggaacaccgggctttcttcacgaattcagcagtatgtcttggctagctagatttgcaaccaacattgacaaccaaccctagtattgacaaccaacaatggggtaaagaatttagttgcatgtggctgaggtaccagattttcactagatcagcagctgatcaaggccagcatcctaaaatctgatgactctacattgcttccatcctccctgagaataaagctatgactgtgtgcaagggagatgcaagatcctacagatatcactgtaggcaggacccagcagggagtcaacatgagctgctttttgctaactcagaacactcagaatggagaaaaggtagaggcctaaacttaatatatatatgggcaatgacattttgtgacttagggatgaaaactgcccaaataatcaagaattcttacttttactacctatagtttacattctgatgttgttacatcttttggaagagatatttcatcaaattcaacatgccattgattgtaagatacactattgttttatgtaccactaagaagaaaaactgttgccagtgaaagacacaccatcaattttcagatctcaatttcagagttgtgaaaatatggaagagtcttaaaatcagtgaaaatacaatagcaaagacttggaaccaacccaaatgtccaacaacaatagacaacaatgatagactggattaagaaaatatggcacatatacaccatggaatactatgcagccataaaaaatgatgagttcatgtcctttgtagggacatgaatgaaactggaaaccattctcagcaaactatcgcaaggacaaaaaaccaaacactgcatgttctcactcataggtgggaattgaacaatgagaacacatggacacaggaaggggaacatcacactccggggactgttgtggggtggggggaggggggagggatagcattaggagatatacctaatgctaaatgattaggttaatgggtgcagcgcaccaatatggcacatgtatacatatgtaacaatcctgcacattgtgcacatgtaccctaaaacttaaaatataataaaaaaaaatcagtgaaaatattagtagcactaacttccccttttcttttgggattgagtagaggagccttaatggccccaaaacaaagtttaactttggtgaaaaattaaatggctgataataccgaatataaaataattgtctatttctagtttattaaattaatggacttcttacctacggaaaattgccttttgatatatagattaatgatgagtattttaaatgttctcaagataatgaagcttatggttggctaaatttaaataatttaaaagattctgaaaataggtataaaaatttaaacaaattctgacctagtaaaaaagcatttactagaaaagaaccacatagccaagacatcagaatttttgccaatcataccaacctgctaaaaaagacagagaaaaatttttgattgcaatatgagatgctggatttagactaggtttagaaacaattttatgaagcagtaaacatatcctaattagcctatgttttcaggaagccgtctcaaccatttaggagttaaactttgttttggggccactaagtctcctctactcaatcccagaagaaaaggggaagtcagcgccactactcatattttcactgattataagacttttcttttccatattttaacaactgtaaaattgggatctgaaattatttctaaatctagtctaaatgcagcatcttatattgcaataaaaatttttttctgtctttgttagcaggttgatatgattggtaaaataaggaagtcttggctatgtggttctttttttacaattagtttaaatttttatacctattttcataatcttttaaattatttaaatttaacccaccataagcttcactatcttgagaacatttaaaatactcaccattaatatatatgccaaaaggcaatttcctgtgggtaagaagtttattaataaactagaaatagacaataattttataattggtatcatcagcaatttaatttttcaccatttttgaatttctgtttgtttgttgtatataagaccataaagccatttgtctcctgggaagtaaggaattaagccacttagtgcccttgggttgtaagttgctataaaaagagttctggttacttagccataaattgtgatgtttatttcagcatataagaaaattatcttttcttggccgtactgtcaatctgcaatatttagaggttatattttttctttattattatttttcactttcctgaataaacagccagaactcagcaatattctaatatgtagcatgggagtttactgatttcatgggatgtacatgaatctatggcaagagatgtaactgttgcttttccttttcttactcactaggtgaagggactgaggttaaagattggcatttcattcatttttttgacagtgctgttgctttttacatatctttctatcaagtctggcctcagttacctaggttagagaccttgctgtgtgtgtgctctgccaagtatatcaggtttttagtttttctatcagtaaagcactgattcctatccctaggattttatctactttgtcaagagggagaaattgcttacttggcatcacatgcagtttgaattcactttgtttttgttttgttttcttttgttgttttcgagacggagtctccctctcttacccgggctggagtgcagtggcgtgatctcagcttactgcaacctccacctcccaggttcaagtgattttcctgcctcagcctcccgagtagctggtactgcaggcatgtaccaccacgcctggctcatttttgtatttttactagaaatggggtttcaccatgttggccaggctgatctcaaactcctgacctcaagcgacctgcctgcctcggcctcccaaagtgctgggattacaggcatgagccaccatgcccggcctgaattccctttgatttttagtagtagtctaggatttttaatagtcttctttaattactggagtgttccagaatcttttgtgacagccaacttagtcttttaaatgtttgcattttacgtgcattgtcttggtgtgaataaatctcaccttatgccttgttttcattactttgtgtcattattagctgaaattttagaataacaaattagtatggttttaatgtttttttgtaaaacttcattttatccataataagtttggattgtcttattttatctttggtagctgcagcatcaggcaatgagaacatacaaccaccaccattagcttataagaaatggggtctacaagatattgacactattattgatcatgctagtgttggtaagtattactaattcaaattctcttggaatttacttcttacactttttattgaagtatctcatttattagaaatgggcatttattctttatttattattattattttttaagatggagctttgctctgtcacccaggcaggagtgcagtggcatgatctcagctcactgcaacctccaccttccaggatcaagtgatcctcccacctcagcctcccaagtagctgagattacaagcatgcgccaccccgcctggctgatttttgtatttttaatagagacgggatttcatcatgttggctgggttggtcttgaactcctgacctcacccgcctcagcctcccaaagtgctgagattacaggcgtgagccactgcacccggccaaaatttattcttatgtgaaaaaatgcattgcctttagtgagacatctggaagttagttcagattcagatcatcataggcatatatctttaaaactgggcatgatggctaacacctgtaatcccagcactttgggaggccgaggtgggtggatcacatgaggccagaagttcaagattagcccgacccacatagtgaaaccccgtctctactaaaaatacaaaaattagccaggtgtggtggtgcacacctgtattcccagctacttaggaggctgaggcaggagaattgcctgaacccgggaggtggaggttgcagtgagccaagatcacgccactgcactccagcctgggtgacagagcgagactctgtctcaagaaagcaaaacaaaaacaaaaagaaatggtagcagttttaataaagatttaattatgccctcagccacagtattgtacagttttaagtcactcactgtttgactaatttttctacagacaaatttggtctatataatgaccatataaatcagtcttaaaaatgtaaccttggtcaagtgtggtggcttgcacctgtaatctcagctactcagaaggctgaggtaggaggatctcttgagcccaagagttcaagaccaacctgggcaatatagcgagaccccatcgcttaaaaaaaaaagtaacctttaaactagtaaaatatagataaaagcagatttcttcttgcagccactataagagagcttactgtgttaggtactgagggtatagagatgtaaagacatgcttctctgttgtctgaaagtgtgagtctaggagcctggttagaagaaacacatgagaatggctacaatactacaacatagtaattgtaacagacaaggggaccagctgtagtgggagcagaggaggacacacttattgtttctccagcacaccatacacttttatccctagatctatgtgcatgtgggctagaatgcctcctctgtgtttgttcacttggtcaagttctactcattctatgcaaactggacactgggagagaaagagcaaggagaagaggaaggagagtgactctaaagaggctaaggatatctgacacacaggccatctttctatttactgcatagctcttacatggaatactctgtaataaaaacctattggtaaacatttcagtgtgtctacttttttgctagcataaaaatgctgcaaaattccaaagtgttaagttcagttcagggtagcttccctgctctgttaattaaactttggaacattgaaactggctagggaaaatgattggatagaaactattattctattcatttatccccagcctacaaaatgaaaaaaggtacaataaacgttattgtatgtacatctttatgtagaggtctggttaatttattcaacaaataaatgagtacctattaatatttgtgctagaaatacaagataggaccccaccctgataaagcttacgttttggtgatggggagacaaacaataaactaaatgaatatcaaactcttagtgggcatcatgaagaaaataagtaggttatggtagagagtaaaggaagagggtgctttaggtagactagtgaggaaaggcctctccaaggacatgacattcagactgagacttgaaggatgagaaggagccagctatggaaagaggtgtaggaagagcattctaggtagaggagcatcagggatataggcctgggagccttgaagacctcagagtgttcaagaaacagaaagggggttggtgtgacttgactgtaaagagtgaggggaaaacaggacaaggttaggttggagatgcagactggggttagatcacgtagggataaggagatccgattttattctaaatgcagtggatgtcactgatggattctaagtaggggattacatttaaacatatctccctgtttgctgggtagagagatgcttgtagaagaaagcaaggagaccagttattgcaataattcacccaagagagaatgatggctttatggtggaggcagtggagttggaaggaagtagacagatttgagataccttttgtacttgctcagggatggttttgagaaacaagaggaaggaaagaattaagggtttcttaatttttaagtttgagcaacgggctggatgatgagactgtttactgaaatgagaataaggaggaggagaggaagagatttaaggtagtcaaataaagagttacgtttttacaggttaacttctgacacagttaaacattcaagtagaggtatcaagtatacgaattggacatgagagtcagaagttcagggaggaagctgggaatgtacatataaatttgagagggagtggtttactgtggaatgtttcgtagagttcaagaaaagaagaaggtccattggatttgacaacatggagttatttacttactgacttttgatatgaaagttacagtagaatggtgaggatgaaagccaaattaatatagtcttaagaataaatattttcaccccctgctgtctaaaatcacaaacaaggagcataagaaatagattcccagtatctccatttttatggagtcctgacctcttgctgaagcctcatactcatttctccagctccctactgaataatttctacctagatgtcaaacttaacatatccaaaatcgagtaatttcctcctgtcaaacttgctcctcctttttttttctacatcatctttcttcttctggttgctccttaccgtgacatacaaggcccaactttatctggcttatggtacctctgacactgtctcctgtagggttcccctccctgttcattgtgtttcatcatgtagatctcctttgtgttcctcagacacagcaagcatattcctactctagagcatttagaattactgctccctctgcctggaaaactttagctagtcacatggctttctccctctcttcactcaggtctccttatatatcacattgtcaaagaggccttcattagtcactctactaggcctagaaaattatccaatgagtttgactttatggaaacttatattgagagggactttgatgtctttcaaagtgtgggaaggcctcagacgctcagggaaaattctaaatgacaaggtaataataactccagaaaaaaaagaatgcacagccaaggaaatgtaattacagtaagtagcatgtctcagcagtgagtaatgcttatatcattcctaataataaaaacagtgaatttaataaaacgttgagatacaaatattttggaaggatatagggcgagaaagagagatgtaaataagccataccaccttaagttaatgaaaaatagtgctaaaatcagtgactcgaaagataaaagccccctaaattcagtaccaatgtgtagcaatataaagggcagaaaaacactttaaataatactataggaatgtggtcagctgtagactgtgggaaattagtctcaaacagccttgttgcttcaacaaatagatttcaaaggatcgaggatgggaaggaagggttgaggaggtcagaaggattttggaccaagctttatgtccatttgtttgtggttcttactttgaaacccagaggtattgtttttcttagcaatgatcagctattttgcttcaagagcagagaatgcagaaagtttaggtcaaccaagattaagatttagccagaggagtatgtgtgtagggggaaacgagtgtagggaggttgtggatatttgcaagaaagtgatgatgatggaacacaaagctaagctggatggaaagggaagtgatcccaagaggtacttgataaatagtggaaaaaatagtaggattaattagtttaaactcgaaattgtgaaattactgcagggagtttctggagtaattgagatggaaagctaggaggtggtggtctaagtgtggtaagcttgaaatcaaaaatacaaagaatctacagttgctgatgacaggatctaaagtgtgacattgaaaatagatgatttaagttataggaaggaaaacatcattggtagcaaggatggaaaggattgatcagccatttccttacaataaattagaatcctttaaaaaaattgcatatctattgcaaaattgtcctctggattactgtgtagtaatttatactcccatgtatattgcatgggagtttaaaaagaagctgttttaaaacttaaatttcaatttatgtgccatatagtttgccctttgatcgtgttttggtggagtcaggcaaaacttaagcaaattttgtaatgtagtgaaaacattttgtatactgaatcatggattcattcatgactatgagataggtgttctgatcttttataatggtctaggaggtgggaggggagtttaaaaaatagtccaaggatttgtttgatcactttaattcctataaagccagtgaatggcttgcgtatgaactcactcaaagaatttcctttcctaggacacgtcttaaggacgaatgcattttttgacagttttcaggcaaaggggaggcctgaaatatatgtatatgaaatttagtaaggtcaggcacagcagcacacgcctatattggctgggcacagtggctcacaccggtaatcccaacactttgggaggctgaggctggaggatcacctgaggtcaggagtttgagaccagcctggccaacatggcaaaacttcgtctctactaaaaatacaaaaattagctgggcatggtggtgcgcgtctgtaatcccagccattcggggaggctgaggcaagagaatcgcttgaacctgggaggcagaggttgcagtgagctgagattgcaccattgcactccagcctgggcgacagggtgagacgccatctcaaaaactaaaaaaaaaagaagtgaattggtatttggggatataagtggactgtatacttctggtacctctgagtttcatatctgttcaaaaaattaaattttgtttttatgatattctatagattatggaaattatagatggaaattttaatatttattattattatttttttgagatggggtctcgccctgttgcccaggctggagtgcagttggtgtgacctcagcttactgcaacctccacctcccaggttcaagcaattctcctgccccagcctcccaagtagctaagattacaggcacccaccaccatgcatggctaatttttgtatatttagtagaggcggggtttcaccatgttggccaggctgatttcaaactcttgacctcaagtgatccaactgccttggcctccggagtgctgggattataggagtgagccaccatgcctggcagaatattttctgatgttgactttgtagcttttaaaatgacttttggttattaaataaaactaaacatttagcatcttagaatggaactgaagtaaaaatgtaatgaccgcaataacattgtacattcaaatcacttttttttttttattaggtattatgactctgtccccctttgatcaaatgaagactgcctccaatataggtggatttaatgcagcaattaaaaatagtccacctgccatgtctcagtatatcactgtagggtccaatccatttactggcttcttctatgctttagaggtatgagttttatcaatgatcatgagtaaggctgctcttgattttacaatttgtctacaaattggatatggtaacttgcttagccttagaagattaagcagtttacatttctaaatttcaattgaaactaaaattaatctcaactagctttcttctaaattctttagattaactgaaaaggtactaccatcagtataaaaggaaattctttgtttctgaagccctgagttctttgatagctgagatgtctttaaatattggtgcaatagtcaggagctcaggcttgttaatgatgccagcccactagggatttgagtaaatgaggagttgtaaagacagaacaagctgccaactatacttgttataagtggtgaaaattgcttcctaaaatagtggaaagttgagtgttagatttggcagctcttgtttctcacttaaaaagcatgcttctcagaattgtccaaaatatctttttacttttataaaaatgtgtgtgtgtatatgtgtgtgcatatatatatatttaaagagagaaaggagccagttatgtgtaggtgtgaaatccatagtccagctagaataatgtaatcttaatgtcctagtttaaaatttatttgaatgaaattacaatttaaagagagaaattctaatggtaaaatagactaattgtgattttatttttaaactatagagttaaaactttttctcatattacgcctaaaataaactttttactgtactctgaaagaagctgagttgctagtccagcctttacaacttttcaaagcattttaaagtaagctttatttagaaagtatgtttgtttctttgtaagctactaagttttctctttcaaatgttctgtttttcagggaagcacacaaccattattatcccatgttgcactagcagttgcaagtaaactcacttctgctttatttaatgctgccaggtaattacttaacaattaaaataacaaatatctcatttgtatctagcttgcttttaacttatattttgatagtttgcactttaaaaccctggaagctcagttttatattctaagttttctttcttttcagtggttggcttggttggaaaagtaagcacgaagaagaagctgtccaaaagcaaaagccgaaggttgagccagctaccccattagctgtaaggcaagtctgtcatgcttcccaaattttagtccttttagaaaggtactgttaaatgtatggtctttccgtgtgcttggttgatttgctgatcttgtctttggaacttctgaaagccattacagtggaatttcttttcccactagaatgtaaaactccatgtgaagagtgattcttacctgttttgttcacagctttatccctgttatatactaggtattcaagatgtatttcttgagtgtgctttttaacaaataaacttagcttagttgtaggagaattaattcagtgatagctgttaaatttcttttaaaagtttagatagtttgttactaagttgtataaactttaaaagtacttagtgatttctttttaaaaaagtcatcctagtggattgcggtggctcacgcctgtaatcctagcactttgggaggcctaggtaggcggatcacttgaggtcaggagtttgacaccagcctgctcaacatggtgaaaccttgtctctactaaaaatacaaaaattagtcaggcatgatggcatgtgcctgtaatcccagctactccggtggctgaggcaggagaattgctcaaacccgggaggcagaggttgcagtgagccgatattgcactgttgcactccagagtgggggacaagagcgaaaaactccatctcaaaaaaaaaaagtaaaagcaggagtcctgtattcaggcactctttaaacagactcctgtcctgtgcttccttgtttacttcagtagtgctttagaatgtgttagtatattggtgagttttttttggtggagggagcatgatttttgttgcttttttttttcattattattttttagataggagcatgttttctaatgtttggttttgttttaaaatcattttttattacctaatataaagtaccaccatgaagggaaatagaacacctcctctttatggatgttcttcacctaagaagagccaactaattattaaaatttatcgaagtatagcttctaagttttttttcatctttttaaaaaatacattgtaacatatcacatttcctaatatcaagagtcaataaattagtcacatggccctgtgcgtctctaatagatgtaacaaaggttgggcacctttgtttcagggacttttctctaaatgagctttcctagttctcttttagtacttctttacttttattttactcacaattctaatgaggttgattatagaacaacagaagtttagagataactatttagaaaaaggaaggtttttgcttcaggcagattggtgtcagcaggatgtcatatcttgcaaaaaagagaaagattaagaagaagaatttaaaatagacaaaagatgcctgtgtgggagcatattctaaaatttagttgatggtgaggacattgttttctgtgacatgccttttaatcaaatatagttatactttatattctctaaaggtatagggttgtgggtatctattgaaaacctacataggactgtggttttatttcttttatgtattttatattacaaatgtcagttgtgattaataaattaactattaatccaggtaaaattcatatttctttatataaaaacagattcagcctatttcatttatgcatttcgttattctgttatatgtttctgaactggaatgtgatttgagcattttattttcttttaaatatcagatttggacttccagattctagacgccatggtgaaagcatatgtctgtctccatgtaacacactggcagcagtaacagatgatttcggcagagttattttattggatgtagctagaggaattgcaatacgcatgtggaaaggtacttcttacaaaaatccagaaaaacaattaattcactttttaccccaatagttgagcaatgttatcatccttcagcttctggatgataactctgtttaattcttcatgtttacattttctttttttgacatgaactcagatcagcaaccacttggtccagtagtcagttgatacatcttttaggtttgatcacctcatagccatgtttaacctttgccttttgcactttctttcaattctcactgttattgtcaatttctgagttcagtttcttgcccctgctacatttattccccttcacaaagccattcttgagccaaatgttctccccaaatctataatgccaagtctttcagatttaagatagcaaaacccatcttcactgacttgacttttatatccatatgcttgggtcaatccacctggtgtgtcaataagtatgtcacttaggagtttccttcagctattattaacagacctgagtaacagaccacagtatcttcaggaacccagtcttcttccttgtagcttccccactcaaggttctcatagacagccctcttatctgcattccgggaaggaagcagaaaggaagaaggcttctcctggcaactgagtcaatctactttgaagatattccccgaagtcccttcaaccattatctacattagccaggacttagtgacatggcctcatctaactataagggagacttgaaaatatcttttaactaggcacattgtgaataatatctccctgactaagaaagaagggatgattacattatttagaatcatctggaatagtaacatgtcagcatagaccacaatttatggtgcaatcttgtctatcctgtaaaatgtgaggaataatgaatggattgaggtcattcaattactctggaccagattgaagccactatcaccttcttgccaaagaactcctgcagtgatagacagaggcagtctttacctactacatgtctcagtatctgtagaaatagttttaatactgcagatacatcatttctccttggtgtttgtcttctgaaacaatatcaaaggtatgttctcagcaagacttttctaaaatacgaagacgaagctgtactgactgctccaaatccactatggcaatcttattccttgcatcattgcctgtctgcagctagtacagccagtttttctttccattgtgtccttggaaagaaggatcaattgcctatgtgagggaccaccctaaaatggaaaatagcatcagctacgtctcccatgcaagagcttcctcccatcgtcctgtaacccatattttctatctgcatgtcaccaaaaggcttgtgtgggaagggaagggaatgagagcaggaggggtaatcaggtggcttcaattatatctataatcttttctcttttttttttttttagagagtttcgctcttgttgcccaggctggagttcaatggtgcgatctgggctcactgcaacctccacctcctgggttcaactgattctcctgcctcagcctcccaagtagctgggattacaggcatgcgccgccatgcctagctaattttttgtatttagtagagacagggtcttaccacgttggtcaggctggtctcgaactcctgacctcaggtgatccacccgcctcagcttcccaaagtgctggaattacaggcatgacccactgtgcccagccaatattttctttttaaagagaaaaagtggtcagaagtaaatatagcaaaatagtaagatttgataaggctgggtgatagactggttattatttattatcattttttatttaagatattccataataaaaaatatacttttatagcttttcttaccccacccccacccccacccccactattccagagtacttcaggaggctactatggaacctagattaagtaattaacttccctttacctctgtctctaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggtaagctgcaaatgctggcattgtgctggttacaaaatgaaatataggaatgcttttattaaaataaagctttactaaagctgcttattagattacaagtttgagaattacaatattctttattgtggtttttcctgtgagtgcctggcatgtacttaagtatttaataacaaaaaaaaaaaattaaaaatgccatgatagactgctgaattaaagttagcttgttgctaatgtttgtcccttacttatgctgggaaggctcaaaaggaaaggttccttttgccctagtcataagtgaggtgaatgctttgtttgccattgaaacaggggcctgattgtgttcatttaattttttagaatctttcaacaaggcagaactctgctggttgagccctgctttacttatgtacttgctatcagtatttagttgccttattaatgctcctaaattgataataatgttgggtttcctagctataataaaagcaccttttggcatttctccttgttctaatatttttaccatattggtatgtgatttctttaggctgctgtatcctggctataaaataatgggtttaaataatgttaccagtcagagttggcagccacagacttatcagatctgtctggttgatccagtgtctggaagtgtgaaaacagtgaacgttcccttccatttagcactgaggtaaggtgtgtccagtgttgctgattgacgctcctctgctaacttttcctagttcctaggtttgttgtactctcttttgtagttgctattttgttgtttcctttgtctttagactgatatctttaaagttaaataggaaatatataaaggaaaaaaaagttggagtgtgtcagaattagaaagaaaataatttcacattctgtaataatttgttatatttattggtttagtgataagaagagtgaacgagccaaggatatgcacctagtgaagaaactagcagccttactgaaaacaaaatctcccaatcttggtaggtattctctcatacaaataataaagcatattgttctatcatcttttaaatcaataaaatattctgaatggagcaatcaaaataatgcatggatgagcttattggaattgctctgtaaggctgaagtgtgccatctagagggtgttataattcataacaagaaaacattaatgtgagagaacccaaaaatcctttagactcactgatagtacagatatgttcattttctttcagaataatgtttcactgttataaaaattaaaattttactttgattatttttttctttatagatttggttgaaacagaaataaaggaattaattcttgatattaaataccctgcaaccaaaaaacaagtaagtgtatataatacacgaactttcctgctagtagctataatacatccttcttaagaaaatctttattttcctatttcccccaaacatgagaggctgaagtcttcttttcacatttttattgtttatccctttctttattttcagatagaagttcctgttgtctctttaaaaaaaaaaaaaaaaattaatattcatgcctgtaactgtaatcctagcactttgggaggccgaggcagggggatcatgaggtcagtagttcgagaccagcctggccaacatggtgaaaccccgtctctactaaaaatacaaaaaaattagttgggtcagtattggcgggcgcctgtaatcccagctactcaggagctgaggcaggagaatcatttgaacctgggaggcggaggttgcagtgagctgagattgcaccattgtactccagcctgggttgccatacatctgagtgtgttttatatacacatacctacacatccctacattatatatattatatatataaaatagtaaatatgtgtgtatgaccacctaccttaggaaataaaatcttaccaggaactctaaagagccctgagtgtcccccctcagtcccattcccttctcccatccctaaggtaactgtaatttagaattttgtggttctttctttttctttactttatagttacgtcattcctgtgtggctcctttgaaacctgttgatgcatttcctgccttttcaaactttatataaatgcagtcatgccctatgtcttctgtgactttagtttttccttcaggattatgtttctgtgtcattcatattggtgtatgtagttatagttataattgattcatttactatgccatacaaattctgctcactgactagaatttatttacactcctgtcagtgaacggttaggttgtttccagatttttgacattacaaatgatgctatgcttatccatgtacatatttcctcattcacatatgcaagagtctctctggcgtttatacctaagagtggaattgctagggtgtgagcttcttcaactgtactagttgatggcaaattgtttcccaaaatagttgtactaatttatattcccacctgttctgtatgagtccctgttactccacagcctcaatattccatggtattgccagacctttactttttgccaggctcgtggttataatatggtcaccactggtgatttcttttactcccactcctcctatccaaacccctcataatgctattcaagtcctaactccacaaattcttacataatgcttcgatccccatggataactctgaactcctactctactttcaatcaaaactggatagttaatgactacttattttctaattatttcatgtatgttaatcatagcttccccgacttttttttctttaggtcttttaagctccttcaagtaggaaccttaccaaatacttgatttttataattcacagcatctaaaataatgctactgtgaaaatgtaagaaaaaactgtatcacaggttttttcttttctcttacacagtcactcgacacttctgccactagatgtagggttttttttttttttcccacacaccagtcaatttctttggcagattctccagctaacaccagctggttattctctaattcagttcgattctgacaccatctacctggagatagcatgagatcatcacgacaggttaagagctcagtcccacaagacttctacctacttcaggtaccagtcacaagtagttggttgtcagctatatttctgactgtctagctataaattagggttactatgaccccctctttgcggttgatgaatttgctagaccagctcacagaactcagggaaacgttttacttgaacgtttacccatttattataaaggatattacagagggtagagatcaacagccaagtggaagaggtgcatagagtaaatcatatgggaagggttgcagagcttccattccctctcctggcaagccactattcaggaacctctacacgttcagctatccagaagctcttccaacccttgtccttttgggtgttgatggaagcttcattatataagcatgattgattacatcattggccattggtgatcaactcagtcttccagctcctcttggctccccagaggtcaggggttgggctaaaagtttcaatcctcaaatacatggttggttccactggtaaccacccccttattctgaagctctccaggagcctgccatgagtggcctcattagaaaaaaagaagcttctatcacccaggaaattacagaggtcttagaagctccccatcagaaatggggggtcaaagaccaaatgttagaacaaaaggttctcctagcacctctgtctacaaagggattaagagctctgactgatgaactaggacagagaccaaacactagaacaaaagaaactcctagcacccccattgttcaagaaattataggaactctgtgtcaggtactggggccatagaccaatatgtatatttcttattattttatagctacatacatgggagaattcagtgaatagtgatacatgggagaatttagtgaatagtgatttctgttgcagtccgtttttaaaacactttattgagttattgtagaacagaaaagcctttgtgacttttaattgtgtcttccattctactgacaatgctaattggctctcattttgctcagggtaaagtctctgttattagagatgacatgatgatgacaaagtgggcatctagagaggcatattgagaaatctgtagtagaaagggtcataacccacacggttcttctcatttttatgccatctttcttcttatcctaaatcatagaacaacaaaattgggaaaccagcataatgcaaaatgtcttcttgattttcttttttttaatggtacttctgaatcatgtatgaagctgtgaattttataaagaatgctagaaaacccagtaacaaaagttataggtcttctaggactgactaaagggaaggaagaaaccagttcaggctttgggagactgttgaataatggggaagaaaacaagctagctgctagcctgggtaatcataggcagaactggagcaggttatgcttgtcctgggttctggcctcttacagtcactttctttattgtttcctggtagttacttcattataggcctgaccaacatcttgagccaccctctaagcccatttctcctccacaaacacgcagaggttattgtgttatgatcggatatttgtcttatcccacattctcagcctactttttgaactatttaatctcattaattaaaacccaacttaatgtgctaatatgaaaggataaatatgacctttaacttctgatagttgctactttaggcatgaagagatattttgggactggttatgaagaatcttaaatatctatgggggtggggagagggaggtagggaagggtgggtactgtattcatctagcagggcctatagattctgcctgccatgcacaaatgcaataattaaggtataactaagtttttggcagcttttgttattgacatgacaataacctctgcttttcgtttatgcctatatagtataggcatattcaaactcttcttattggtaaatagctttatctttgtttctgttttgatttggctattctgttaagtagcagttgccttctagttgttttattctcagcctggatttttgtcatttatgtcatatttggcatgacatgaagttgattgtatattacttaacaacgcaacttgagatttaatatatgtacactaaaacatcttaaatatagagcttccctttgaaatttggggtagtgaaagtttgggcataaatataagatttaaaaaacaaaatcactgccttataattactagaactgttcaatatctttctcctaggctttggaaagcattttggcaagtgaacgtttaccattttcttgccttagaaacatcactcagactttaatggacactttaaaaagtcaaggtaatagggtttgtactgattggaggttatgttcttaactcaaattttgtaactctgattatagaaagctattgactttgtgataccatcatgttactttaatgtggaagtaatatagatataagaaattaagaatcttatttattccctatttaatatatgtagttgatcttcatctaagctgtctttgaatgtattgactgttattgggaagttgtttttaattgtgaggaaagatgtcaggatagaatgataagtggttattctgatatagctttgtattaatgttctatcagtgtatcagtttccctcgtgaacagagttaaggacttccagaatcacaatcaacaatcagattattatttctgaattttctggtcattttttgatattcaaaatttgtctgtactatcacattgttctttaaaatccatcagtccgtcaaaatgtatttgtctgaaaaaggattacacttgaaacttgaaactgtggggttgtaacaccatattccatccaactgaactagtaaaaattcactttattctgaattcctaacatcagttaaattgtgtgcagtggactgatgtcatctagttgtgacttttgtttgtcatattaattatgtaaaaccagctttgtgttttagttgtgtgtaagacagcttaaagtggcttaatacacaaattataatttgttctttcaggacttcaaacatgctaattttgagactctttttcaaccttttttttttaacagatacataaaactgacattggcaaatagtgaactcctttagcatacaccacttgtcagaaataaatccctcttttaaaaagcgtggtatacttacaaagccctcccacccctcaaggcattcacaacatcccaaaatttattaaatgaaaagttatcttccactggcctggtagtaaaccaaacaccattgttggaattccataaaatcatcagtttcaagttctacataaacataagattcctaaaaactttaatcattttgtgtggtcagttttattatggctataagaacttgaacaatattccatgatactgtatttcaaataagattttgaggggattatcagtgtctccctttttaaagaataaatatttcttttatattagatataaatattcatacagtatatgaattatgtagtcagggaaaatattttcaaaggtatttccagataatttctttaaattttaagtattagatgaagatatttccgcttccttttttatctccctacttttagagcatcttattttatttaaaaagttagacattttgtcatgacagaaaaattatttttgctttcaaaacctggtatagcttaagcatctcagtatttaatacatcagagcatcagggaattacataatattgagagatttaatgaaagcaaagcctgtttatgagtctgttaaatatatctcttatatatacttttccttctgccttttagaacttgagtctgttgatgaaggattgctacagttttgtgccaataaactaaaactgctgcaactctatgagtctgtcagtcaattaaattcccttgattttcatttagacacaccattctctgataatgtgagtaatcccacattttatattatataaaataatctctttgattagttttactttttaaaattagtagtaaagaagtagaaaattaagaattttttttaaagctttaaaggtatattttccttaccaagccccctgctagctctctgtgctttgctgctatatttatattatttatacaagtgctgagattataggcataagccactatgcccagccatgatatgtttttgtacatatagtatataaaaatagtttgaaagcctagcaggttgtatccctgagagccacatacaggacttatatgtagatacaatgagaatatttttctatgtttttattttatagtgtttacgctgctttataattaagcatttaagttcaatatttagtttcctcagaatagtaagagttgcgtttgacacccttttaaatttttttctgattatacagtaatacatgtttattaaaattctagcatttgccaaggcatagtggcttgcacctgtaaccttaacactttgggaagctgaggtgcgaggatcacttgagcccaggagttcgagagcagcctgggcaacatagtgggaccctgcctctacaaaaaaaaaaatttttaattagctggatgtggtggtgcacacttgtggtcccggctactcaggtggctgaggcaggaggattgcttgagcccaagaagtcaaggctgcagtgaaccatgattgtgccaaggcactctagcctgggtaacaaagtgagaccctgtctcaaaaaaaaaaaaaaaatgctaacattctagaagataataaagtaccctcaagaaatatcctaaaatggtacttttaataccatttcttttagtacctacctctagtaccatgtttggtttggtaccaaacatgcagtgtttcaaaattatagtttactttatttaaataacttcctactcatgaaacgtgatttgtaagtaaagttttaagcagaatacatgataggtattatattaattaaaaagtcgacttttgcttacagccttgaatttcagttcagataatgtgggtgatagatgtggaatgttgttttgttttgttttctgttttaaaggacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtaggtaaaataatacactggtctttgtatgcctcttcttttagaagaaaacatggtaggaacatatagcatctcagagattccatttgttttgaaatttaaataatgaaaggatttaatgtactgtattttttggccaacaaaagatactctggtcaacaggttgtattaatgagtatactaaagagacaatattggatcatgatttgctttctgctttaataaatcaagcaaattgaacaattaatttctcttccttcataatgttttgtttctctggaattccagattgtgattcaataagattgttagtccaaatggtaagtagtcattgattaatgtgctttgtttttcttctaccaggtagtttctttttttggaagtgtttgcatggagaaagctccactgaggatatgtgtcacactttggagtcggctggtcttagccctcagctgttgttggtaaggtttttttggttgctggatgctgttcttccttgtgaatgtcacccagaagtgtcagtcttctttttttttttaactattgtcttttaggatatcacagaatgtccatgaaaactttctaaaaatgatcaaagaaaattttaatcaccatatttaatagaagtaatattatttatttttcttataccctgtaattttttttttcttttactttgagagagagagagagtcttgctctgtcacccaggctggagtatagtggtgtgatcatcgctcactgtggccccaacctcctgggctcaagccatcctcccatctcagcctcctgagtagctgagactactgggcaatttttttttttacttttgtggagatgggggtctcgctatgttgcccagcttgtctcaaactcctggcctgaagcaatcctccccgcatgaccgctcaaagcttttggattacagacaagaaccaccatgcctggccaattttctgtaaatgttaacaagcatatcgtatagttggcctaaaataagtttagaatctgtgtgcacccatctatatgcgtgcatttacagtggaattggatcatcagtaaaaaactgtcatgttacaatgaaaaatatcttaaaaacaaaataagcttcccataaagcaatgtggaattgttaccaaacattttcagactttgaatatatattataatgtaatctctaatataacaaatataaaacaaaagaatcatccaaggaggaaatacaacactaaatttttaccctttctgaaaaaaacaaggaaagttaccccatcttccttgttcttctttgttattacctatcccctacacatgcatgcatacacagttgtccctcagcacccatggaagattggttccaggaacctccccctccattaccaaaaccatggatacagaaggtcctgataaaaaatggtgtaataaaaaattagccaggcatggtggcatgtccctgtattcccagctactcaagaggctgaggcatgaggatcccttgaatcagggagatcaaggatgtgctgattgcacctctgcactccagcctaggtgatagagtgagaccctgtctctaaaaagcaaaaaagttaaaatggtgtggtatttgcatgtaacctatgcacatctcctgtataccttaaatcatatctaggttacttataatactttctgcaatgtaaatgtgtaaattgttaaaactgtaccgttgagggaataatgacaagaaaaaagcctgtacatgttcagtatagatggaaccgtccatctttttttttctgaatatttttgactcacagttgattaaatccacagatgtggaatgcatggatacagagggccaactgcatactctttcacacacccccatttacatgttatattttggccaggatttgggcatcctacctctgtgagcttgttgatggtttaatgtgttgtttttattatgtatgtgtctggttttggtatctgggtaatgttggcctcatagaatgagtttggaagtattccctcctctccaatgttgtgaaatagtttgagtataattgatattagttcttctttgaatgtttgaaagaattcagcaggaaattcatcagatctgggcttttctgtgatgggagactttttatgactgcttccatctcgttacccattactggtttgttgaggttttctgtttctctactgctgttggcataaagctgttcataatagtctctaatgatcctttgtatttctatggtatcaattgtaatgttttcttttttgtctctgattttatttatttgagtcttttctctttgcttcttagtctaactaaaggtttgttgattttgtttatcttttttaataaaaacaactttttttgttgatcttgtgtaatttttttattctcaatttcatttatttctgcttgatctttattacttcttttactaatttttaggttggttcttgcttttctagtttcttgaggtgcattgttagattgtttatttggagtctttttattgaggtgtttattactatagacttccctcttttctttttttttgagacgtagtctcactctgtcaccaggctggagtgcagtggtgcgatctcggctcactgcaacttccgcctcctgggttcaagcgattctcctgcctcagcctcctgagtagctgggactacaggcatgcgccaccacacccagctaatttttgtatttttagtagagacggggtttcacaatgttggccaggatggtctcgatctcttgacctcgtgatctgcctgtctcggcctcccaaagtgctgggattacaggcgtgagccaccgcacccggccgacttccctcttagcactccttttgctgcatcccattgttctagtatgttgtatttccatttttattttttcaagaaatttttaaattttatttttagttgcttccttgcctcattggttgttcagtagcatgtcgtttaatatctgtatttgtgcagtttccaaagttcctcttgttactgatctctacttttattctgttgtcagataaatacttcacatgattttgactttttaaaatttgttgagaattgttttgtggctaacatatggtctgtcctggagaatgttttatgtgctgatgaaaagaatgtgtattctgcagcagcaagtgaaatgttctataaatgtctattaggtccatatggtctagtatgtagtttaactctgatctttctttattgatgttctacctggaagatctgtccattcctgaaagtgaggttgaagacctctgttattactgtattgaagtctgtctctccctttagatctattaatatttgctttatatatttgagtgctccattgttgggtgcatatatacttactattgttagatcctcttgctgaattgactcttttttcattgtataattaccatctttgtcttctttttttttttttttttttttttgagacagtctcactgtcgcccaggcgggagtgcagtgtcatgatctcggctcactgcaacctctacctcccaggttcaagttattctcctgcctcagcctcccctttgtctctttttataattttcaacttaaagtctattctgtctgatataggtacagcttctcctgctcttttttggttttcatttttatggaatatctttttccattccctcactttcagtctatgttagcctttataggtgaagtgagtttcttgtatgcagtatacacttttatgttgttgagtcactctatgtcttttttttattattattattcctgggcctaagctattatctcctctcagccttccagtcagccaggactataggtgcatatcactgtgcccagctcactctgtgtcttttaattggagaatttagcccacttacattcagtgttattattgattggtaaggtcctactactgccattttgttacttgtttattagttgctgtgtaactcctctcttttttctgtctttttttttatagttaagtgattttctcttgtagtatgtttcaattcgctacttttgatttttgtgtatctattgtaggctttgcactgtgattaccatgaggcttacaaaaaaaatctagttacaacaagtatttaaaactgataccagcttaactttgatcacaaaacagcaaaaccaacaaaccataaaaagaaaacctatacgcattaactctcttctccccccattttagcatttttgatgtcatcattttatgttattgtctcttaacaaattgtcagttttttgatagttttttcttttagtcttcttactaaagatatatgtggtttaagcaccgtgattagaatattagtatgacaatcacattagcatcattttctttcagtttggagaactccctttagtgtctaagaaatcacacatttcttataggataggtctgatagcagtaaattccctcagctttcgtttgtctcgggaaatcttttatttccctttttcatttctaaggaataactttgccacgtacagtatttttaggtggcagtttttttcctttaacactctgaacatactgccccactccctcttggcctgtaaggtttctgctgagaaatctgctaccaagcatattggatctatcttatatgttatttgcttctattctcctgctgttttctaaattctctctttgtctttgacccttatgagtttgtaaattggagtattcttgtctgagttaactcggattggtgacccttgaccttcctgtacctgtatattctggtttggaaagttttctgttattacttatttgagtaaacgttctactcctttgtctttctcagttctctctttaactccagtaaccccaatatttgctcttttgatgttgttttatagatcctatagaccttgttcattccttttcattcatttcatttctttcttctcctctgactatgtatttttaaatagtctatcaacgaattcactgattctttcttctgtttgatcaattctgctattgatgctctatattgcatttttaattttatttatttttcagctccgaggtttctatttgatttttttcattagtatttcaaccttttaaaaatttctctgataaatttttgaatagattgtgtgggttttcttaaagtttgttgagcttccattttgaattctttgtctgagagatcacacatctccctcactttagattctgtctctggtgcctttctttgtccatttggtgaggtcgtgtttccctgaatgttctcgatgcttgtggtagtacgatggtattgtgcattgatatattaggtatgtactttagtcttcacagtctggctttgtttgtacttgaccttcctcagagggccttccagggattctaagctgactgactttcatgttccctgagcttgtgaccactgcaacacttgacatcactctaagcccaggcttgctgcaggtctctcaagagctctgaagtttatgtggctttctatccttcatggactgggggaagacccaaggagggtactgaggctatttgggaatactggccagggacctgggtccagaagtctgtcctggtggccccgacaggtatgcatcccagcaggtgtctgcacaggtggatgggtccccagctgcagttagagggggtagaagtgagactggacctctttaggatctgtgtgaaaaggaggctggggggcctgttttgttggctcagatggttatgtgtcgcccagcaggttcctgcacaagtgaggtaattcctcaactgcaacaggaggggcttgagctgagactgggccctcttgggatcagctgtgggaatggaggctggtgtgtctcatgttggctcagagaggcatgtgtcttcagcaagttcctgcacagataggatagttctccagctgcagtgagggggccctgagggggatctgctgtgagatagaggttggtgagcctgtcagggaggctctgagtcctgggctgagagatatgggtgagtctgcctctgggtccttatgcaagcaactctgagctgggacctcagctaaggaaggtgagagcagcaccacaaggctactttccagcccactgctgagaccagtgctagcgggcagactagcctttctgccaaaacactagtgtgtacagttctttctggaccccatggcaaatggttttggtggcaggatcatgggcaaacagggaagtagccaagccccttgtggggactgggctgtttctgggcttcaatctggaagtcagttcagggggacagatcaaccaccttattgtgagagaatataagtaggttgccttctattccgccatcttggtgacctcaaggtttctgttactcaaaatctattatttagacatcatctggttatatgtcaatatataacatatttatatgtgagataacagttaatattttaatatgtgaattcataatataaatatattatgaataatgtaatgtggcattctttgttgtgactgttagaatatcttattttgtatttactagttatggaggtagttacctttatacactagactcttctcctgttatatgtgtccatatatgtgtttctatgtggtaacttaatttatctctgtattcacttctttatttttcttctttcatcttaatgtttcctgcaatttaaaatatctatattgcttataagtgattctacaattatatgattatgttctgatagtttctttggcatcctctattttatactgatctcctatatacaaacaaaagcttgactgtttggaagttttaatgtttatagaaaacaggaaaaacacactctaggttataaacagagactacctgtagggtgggaaatagaaggaggtaacctagggagaaataagaagcaaagttaagcagagcaggttttttgtttgtttcagaattttattacaagtgatggtgggtagaggagaggttggttggagagaaaagtggaattcatagtgtgaagagaggtccaaggcatggcatttaatttttttggctgccttaatataaaataaacttctggctgccaattttgatgagcattttgaaactttgttgttgatggggaaatgaaccaagctttaagagacattaaatctataggtatgtttagaaatctggtattccggccgggcgcagtggctcacgcctgtaatcccagcactttgggaggccaaggcgggcgaatcacgaggtcaggagttcgagaccagcctggccaacatagtgaaacccgtctctacctaaaaatacaaaaattagccgggcatggtggctcgcgcctgtagtccaagctacttgagaggctgaggcactttgaacctgggaggcggaggctgtcgtgagccaagatcgcgccactgcactccaacctaaataacagagtgagactctgtctcaaaaaaaaaagaaaagaaaagaaaagaaatctgatgcactttaataacaggcccaggtcagacattttgtatgtaaaatttatcaaagtgaatctagtggcaatttaacagtgagcctaaaatataagataaattctgctctcccccaacatttctttttgatttgcttcccagtatacatgcacataaaacagcgagacagagttatttttgattgagtatagaatgtctttgttaactgtataggcaaccaattttttcagcctacctagtggtgaaaagcatcaggttatggaggttaaggggaagtctagaagagaggaaattcccctgataaataaactaaggtcattctgaattttgttggttaaacaggatattgggttgcaagtggaaggaacatggtgtaattatgatcccattgttgtgacagtgactcccccttatcctccctcaaaagtacgatatatgtatctatacatataaagctgttaatggcttggagcatagtaacctttatgtagccattagcatttattgttgttaacattgtcattatttatgagcatggaagatatatttgttttttaaaaaaggtttctaatgggtacaaaaaatagaataagaccttctatttgatagcacaacagggtgactatagtcaataataactgtgcatcttaaaatagcttaaagaatgtaattggattgtttgcaactcaatgggtaaatgcttgatgggatggacactccattcttcatgatgtgcttatttcatgttgcatgcctgtatcaaaacatatcaagtaccacatacaaatatacacctacctactatgtacccacaaaaagttttttaaagggtgtctatatgggatgaggtaaaaagggagctggtatgaggaggcccttggaagggaaattagaccaaaaaaggaaaaaaaatagaaggcattaaagagtgtgcgtgtatgtgtgtgtgtgtatatatgtgtggtttcgtaagtgtaaaaattaagtgcatatataaatttatatgtacatgtatatatcctcatacacatgtgaacatttttaaagggggagaagagaaaatacgcatgttattaatagaatcaggcaggtttattttcaaattttagttcttttttttaaatttatttgagatctgataaacatggatccaattttagttcttttcttttctttttttttttttttttttgagacagagtctcgctctgtagcccaggccagagttcagtggcatgatctcagctcactgcaacctccgcctcctgggttcaagtgattctcctgcctcagcctcccaagtagctgggactataggcacctgccaccccgcccagctaattttttgtatttttagtagagatggggtttcaccacgttagccaggatggtctcaatctcctgacctcgtgatccgcccgcctcggcctcccaaagtgctgggattacaggtgtgtcaattttagttctaactcattaactgtagtgctggacatgttagctttcccgtatgagcttatttcatcatttctgaaatctggatcatcatccctgccacagaagttattaggataaaaggaggtgatgtgcatgtcacgtacttatcacagctcctggccctaagtcgtcctcataaattcacttctttcatgtgcttcttctccttcaactctttaccctccttaatttttgaaaactatttgaaataattcatttaaactaacagtcagtcttttaacttagagctatttttcacataaaagtattgcagtattataattaatcaaggcctttcagagataccagtacttacagatgtaacaccatttcattaaacttcattatcccagaattatctgtgaaccaattttataaatcttaaaaaaatttcagcttcaagtaggtatgctggtttacagccattttaaaagtcacttatgttgacttaagttttttggtttaaagtctgttttttcataacttattagtgatttaaaaattggagtttgatacttttatgtacttgctcctcactgccacgtctgcaatacctttgtacagccaaggcaaggctaagatccacagctacagatcctacctctctctccagtcaaaacctacagccaagtggcacctcgttcatcaacagcagatctatgctcacgtagtagtaactcctgtctggtaatatgctccttaatagagatttggattggaaggcaatgcttaacccaaagaaggtttggaaacagtgaagtttaaatatacaacaggttatagagaatctcctaggtagacaaggtacctcatattccctctcagattacatgatacagcaagcaaccactaattttttcacctcaagaagctgcatcatccatatgcatgcatctgctgtctaggaaagtgtaagattttgtctatgctaaatttttttttagactgaaaaagatttaaatttgatttcagtctctgctcctgagtgtttggctttcaaaggaaaaggatattttggataaaccacagtcaatctgctgtcttcataccatgctgtccctcctgagcaagatgaaaggtaaacaaagtttgttgctctcgtcaacaaagtttcgtgtttgaaatgtcacaaaaagatgggagagtggataggatcccttaacaaaaggagtctgtagtgtacaaaacatttcaccgtagagattcttttatgtattaatagaatactcttaatgcatttgacttatgctttaatttatgaaattttatattttgtatcatcataaaaaaataacatgatttgaacaatacatcttaactcagtaaggcaaatggaatggtcttcggggaaggcaatgtttttcttgttattttttgtatgattatcagaatattaatctgttaaaatattcaacagttttcagtaatgatgaaatattccaaataaggatttatattgattcagaacaaagatgactaaaagatcataaataaatggaatataaatgttctgaataaaatagattgttagacttccacttcattgagaaatacaaaaacacatcagtaggtaacttagttttaacattatgtttaacataaatggttagtccaaaaaattgacagggtaagagtttatttttctgttttctcctatccctatagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaagtaagtgggtaaaggtatggctttgatctgtacacatccagtaggctaaggggatgctttccttttctggggtttttcggggggttttttggagcggggagagggatgagaggtgctccccttaatttctttattgagaatgatgccgtggatacttgaatttagcagttgtcacatggcagtgtcctactgtgtttttttctcatctcttgaggactcacatttcctttacagctcatggtggatcaaataattttttccagggggtgttaacgttaatttggatgagacacctaaataggtctgtggagattcacttaacattgtcagccactgttgtttataggctaaatttaatattgcctgcttgaaatgttcattatgatggagagagatgaaatttcagattgttttttaggttgaagagtgcattctgaagaaatataagtattttgatggtactgatagacaaaacttggcccttgccaaagatggcccagaaaactctgaaatgtatactggttgagtcagggccattagtgcaggactccttataaatatctgaactcaccatccttgcccatgagtctccaatctactcctgaccctcatgtttcatccagccaagtagtaatatttgtgaaatagcatgtatgtgttgctttgtgatgtatcctcagtatccatcagctttcaagttaaaagctcattcaagttaatattgattcagaatctttggcaaagaatcaccagtgcattttttattagttttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtaagctgaagtttatttgagcatttgcatccatttttttatgttacgagggtttcttttaatagaaatgacggaaagaatagagaaagaaaaatacactcagatttaaaaataacaataaccttctatatactacctttaaattaattttctctaaagtctcatttggtcagttccacgctcaggaactgctaggtgcttccctctgcctaagaaaattggcagtgattctcaaagagtggtcagaggacctcaggagtcctccttttttcacctacatgtctatatgagaccagattttcctcttatacttcaaccaaaacacagagcacaatagattgaatggcaaaactgattggagaatccagatataaaccaggcattacagagatttgcaaatatgtaaagtagtgccatatttctcaccaaatatcctttttttttttgcattgggaaatataactacttttttattattatactttaagttatgggatacatatgcagaacgtgcaggtttgttacataggtatacacgtgccatggtggtttgctgcacccatcaacccatcatcgacattaggtatttctcctaatgctatcccttccctagccccgcaatcccccacaggccctggtatgtgatgttcccctccctgtgtccatgtgttctcattttcaactcccacttatgagtgagaacatgcggtgtttggttttctgttcctgtgttagtttgctgagaatgacggtttccagcttcatctatgtctctgcaaaggacatgaactcatcttttttatggctgcatagtattcctttgtgtatctgtgccacattttctttatccagtctatcattgatgggcatttgggttggttccaagtctttgctattatgaatagtgctgcagtaaacatatgtgtgcatgtgtctttatagaagaatgatttataatccttcgggtatatacccagtaatgggattgctgggtcaaatgtaattattttcataaaatattagcatgtaatcagtttattttcatttcaaaatggactaataaaatattttttaatttatcagttttaatttttagtaccataaagattgacagccataactcataaaccaaagttctgtggggttgccagtaattttaaggggatcatgagactagtaagttcaagaattgcctgaacaaagcataaactcttaagcttgctctccaataacttttgactttgaatccaactgatttttctatttctttctcatttgcttcctagattttagttaaaatgaagcatccgtgtgcttcccgtcttagatctggacctatcctcttccctttccctgcctctctcactcatggatatcgaaatcttacttatctttcaaggtccagctcaaatgcttctcctccaggaaacctttcatgattcactaactgcaaattttctcttcttcctcctaatatccacagaacgttattcctctgttgtgaagcatcactttctactgtcctggaatcatttgggttcctgtgcttatatcttgcaggaacataaacatcttacatttttagttgtctttgggggctcacactttttatcagcagctcttttaggcatttgatactggaaggactgtatatgaggtttataaatacccacatgtttatagatttttagtttacttcttttctcattctttataaaacttgtgaactttttcttattgtaaactcaccacacttcatgttgccacctagtgaaagggtaaggatgccatttgaatattaacctaagcaatggaatcaggggcttaattctggaatgagaattttccaatgatttagaagccaaacataagaaattagatcacccagcacactgctcacatttattttcactgataattgtgaatttactgtgaagcattctttttgtggaaaggtttttatttgaatcaaaagatgaggaaagactgagaaagttttggtaaacaatagagtataatttgttttcgataataaacaggactcgttaaatatctggaacgtttttcagcgtgtttacaattttttgtactatattgatgactgagacatgatataatgctgttgattagctatagctaaattaggcccataaatatttcatataggcaaatttgttgattattaaaagtaatagggctgggcatggtggcacatgcctgtaatcccagcattttgggacgctgaggcaggtggatcacctgatgtcaagagtttgcgaccagcctgactaacatggtgaaaccctgtctctactaaatacaaaaatttagccgggcatggtggcacatgcatgtaatccaagctacttgggagcctgagacaggataatcccttgtacctgggaggcagagggtgcagtgagccaagattgcaccattgcaccccagcctggacaacaagagcgaaactctgtctcaaaaaaaaaaaaaaaggaatatttactgggcacagtggctcacacctgtaatcctagcactttggggggctgaggcaggcagatcacctgaggtcaggagttcgagaccagcctcgccaacatggcgaaaccccatctctactaaaaatataaaaaaattacctgggtgtggtgggcgcctgtaatctcagttgctcgggaggctgaggcaggaaaatcacttgaacctgggaggcggaggttgcagtgagctgagatcgcaccactacactccagcctaagcaacaaagcatgactctgtctcaaaaacaaacaaacaaaaaagtaatattatattggccttaggagcctagacaaatgtcatactaaccaatctattttcatttataatttaagtaaaagtgttttaagtatatattaattttttttgtctctggtaaagtgtattttgaacttagaaagcatatggtttatagacatatgcatgtgcatttatatttatctaatattttctgagagtataaggatgccctgacatcgtaaatatcccacttgttgccctcacaagttgcgtggtaggtaggaacactgctgtaaatctcatggctttttcgggtcagcttcaggctgagaaatgaatgtggcacttagatctcttcgtaaggaaattggctcccattggcaaacactgccctgtgtgttgtaaatttttattttctttcttgtctccaaactataggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccaggtgatacacaaataatgagaaatatgaaatccaaattggaaagatgtggccaagtgttcattaaggaaaaaaataacatcactgctttcttctgactttcagacttactgcatttagcctatgagcagtttccttgtagccttgagctcgatgtcttgcatgcacattgctgctgggagtacgttgttcagtggaataaagatccagaggtaagattctcgttacctctttcatgttatttctgcttctgtgttcatgctattcatatatggggaccgtctaattaaatagcttattataaacactggctttttccccgttgtaatgcctctgtactaactagggtagacctttttcacatatttcctcttacaatcctcccagtaaacctgtgaagtatagatactgtcagtatccccactctaaagaaaatactagggctcagagaagttaagtttcttccctgcagacacacagctaagtaagtgtcaggatttaagcatatggttctctttatctaaaaccagtgtgctttgctctactccctagttaggttgtgacaagtatattgtttatttccttctgaattcctgcatgaaatggccccaaccgaacacaatattcttaatattatagtcatcgtgataaaagtcaagagtgaaggtcctgagatcaacctagtgtctgattgttcaaatatgtatttgtctgttacttctgtatgcctcagaagaacaaagaggcagatcgtgaccagggttgactgtagtccaaggttagccttgctgccctctcagctctctgctcaggcttcattttctattgctttcggtagccactgtttctaccaggacattcacagtctggaagcagcatatggggaagaccccaagcctggaggcagaaggcagtgatttggatcccagctgaattgctgacaagcttctggctcaagagggccactgaatctctggcctgttattttctacctccttccacctcctttttaaaatgaaggtgccatgatcaaataagatataaaaacatattgtaaatattcccctttgccaatcagtccttcacttagacctccttagtcagttccctggtaaattattcctctcaaatcaaaattcttaactttatcttccttatatgaggttgcactattgtagagaactctcacagatgaactaattcatgctaatatattaatggaaacgatactcttccttcctccaaaaaactgtgtaatcacttatatattaaaggaagacattatgaaagtaagtgatttaaataaaggaatagtctttgatcaattaaaccttgaccaaaaaatgattttaggacagaggaatcctcttaatgcccttcaaatcaccctcttcagttgactacagcctgaatggcgatcatatttaggctctctacttaaatgtgttacttttccattttattaaaaaggaatgttatgtctagaatgagaaaataataatttctaaaatctgaattaatttcaaattcaagtctaaaaaagtggcatttaagaagaaaattctgctttgtagtatttgtttataaaccaaaggcagcttgcagaggggacatagacaaagctgacgtcaagccccatggttgctgcatagagcttgtaatcctcatagcacacggtttctgaactcttcgtttcaatgttctcctaaaatgagggctgtaatagtagttatctcaaaaggttattgcatattttgagaaaatgaatgcatagtgcctaacattttgactagtgttatcagtatcattaatgttgcttacatttaaaagaagttgttgttttacttgtttgtttttcccattaaatattcatcttgccccatccaaccagtctcagctccaccatttgacacacacaattttataaggctcaaaacaataaaattaccttcagagaaatttcaacacagtgtgtattggcaatgatgatatgtttgatgatgatgtacaagctacaaaattatttagcagatatctaaattatttaatcagtgttgtatactgtatttgagttttaatatgtaaacttctttgattagaaagagttgaatttcaaacatcccatctaatatttcatatttccttcctgctttaatgtttttctctttggcacttaccattaacatactaaatataatatattaacttatcatgtttattatataggtccctcactagaatttaaactcagtgaaggcaagacttggggtctgttttgttcattatggaatccatcgtgcttcaaatagggcttggtgcatactagatactcaataaatatttgttgaatgatgaatgaatgaatagtatctacaaaagtaagcttattgtttttaaatctgtatgaaattcaagtatttattggagagaatattgctatgatgttcaaaccacagcaaatttgaatccagatgttagcccatatgaccgaggagcttctgggaattaattattgtataggtaatgtgagttgaagagggacagtttatcaaaagttatttcttatccaataatttcatgttattattgcaacattcttaggtggttttatgcagaaatttatgtaagaagtctccattgataatggtaaaacctattaaatgatacctctttttctttctcgtttttttctccctgtatgtaaggaagcacgtttttttgttaggtcaatagaacacttgaagcaaatatttaatgcacatgttcaaaatggtaagtaaacagatgttagaaacatcactgtttgatctaaaagaggcttcctgatttaacaggatgtgaatttaaagatttacaacctattaaatttttatttgattatcctgcagcctaacatattactgtgtattggctgaggtgcaagggtctcttgagcccagtagttcaaggctgcagtgagctatgatcacaccactgcatccagcctgggtgacagagtgagaccctgtctctaaaaaaaaaaaaaaaaaaacaaaacaaaaaacaaaacaaaaaaaaaacagtactggccattttaactacttggaaaagtgctatttataaaggggcaaaacaactgatagtaatcaccacttctgttccccaagcagctgactactatccctgagtgtaatgaaggcagctgttctgtatctagctttccaaggaaagagggaatcaatgatagatgcagaacagctgccttcattacacccttcacagatagtgaaggaaagagggatggatttctcaggactgcaattcttaataaaaaatcttggtagccaaaagcctaataagattagactgtagcaactatcttgtgcgtcttataatggatgtgaatattctccattagctgccttggcaactactgatgcctccttgaaaaaatattgaacttgtaaacagattccatttaatagatagatgggtttcattataggaattgaggatatcagcactaagctagttagtaaccttagtaaatgatgagacttggtgttaggctgggtaagaggagatatcaccttatgtctctgtaataaattctagagaagctatgtatttttcacctctatcacatgcttgcaggtgacatgaaatccagttgcagaaattgtaaaatatcccattttacttgaagagaacttgaaaattacttattcatctcttagatcttaccttcatcctatatatatatatatatatatatatatatgtatgtatttatatatttaccttgactgatttagaaaatatcatgtttagattattctatctttattgataaaattaagttactgccggacgcagtggctcacacctgtaatcccaacactttgggaggccgaggcgggcggatcacgaggtcaggagatcgagaccatcctggctaacatggtgaaaccctgtctctactaaaaatataaaaaattagccgggcatggtggcaggtgcctgtagtcccagctactcgggaggctgaggcaggagaatggcctgaacccaggaggcggagcttgcagtgagcagagatcactccactgcactccagcctgggagagagagactccgtctcaaaaaaaaaaaaaaaaaattaagttactaactgacttcagactagtatttcttcaagtcaggcctttacatatttgtacctttacccatcgagtagggttcctggcttctcatagcctgtgatgggccttactcatagacagactcagctacaagggtagtaataatagcatgtgaaatgccatgtttacattgcctaattgacaactgtttcagaaatttaatgttaatgccacagctcaatgagtagtgacagggtcttgctttgttaccccagttggagtatagtggcacacatagctcacaataatcttgaactcctgagctcaagctatgctatcacctcagcctccgagtgcgactatagccatgtgccaccatgcctaattttttaaacattttttcatagggatgggttctggccatgttgcccagcctggtttgtttgtttgtttgttttttatatattttgtttttaatacttttttatataactacatactttagtttgcagttatatgtgaaaaaaatcaattggcagacattgggattgtttctagtgtttggctgttgggaataaaactgttcccaacaatctcatacatatgttctgtattcatttctctagtgtatatacccagcagaattgtcgggtgatagagcagacacatgtttagcttcagtagctaccacccagcagttttccctgtggttttaccaaattattataccaccagtaatgcatgagtgttccatttgttccatatcctcactaatacttggtattataatttaaaaattgttcttagcctttttggtggttatgtaatgctgtctcactgtgacattgtatttctctcataactaatgatgtgactcttttcttcatgcttagtggcaatttagacatactcttatacagcctagttctgatttttattaaatcagattttaaatgaaattaaagatttcatgaactttataaatattacatgagatataaaaaatgaaatcaaaatagtctatatagtttaataagcttaagaaagagtaatttatgtgtaataaaagtgagactatataagcattctatttactacttttacttgctatctaggcattgcactgatgatgtggaatacgttcttagttaaaagattttctgctgctacatacttaatggataaggtaaggtagtttcatgtattgacttcttatttatttgattctcttatttgactaatattagaaagattgttcacattaggctttgttagactattttttaatttgataattagattttactcatactcagttaaatgtaatgcccagtactggcattttaatgacataaagaaggactctaaatcctcataaagagactaatatattataaaagcctcttaactaaagagattaggactggtagttgattcaagcaaggatttgcattttattttaaattaaagtgtacaaatttacacttaccaatctttgatgtaaggccaagatattttctttgaatggagttgattgcattctcctttggttttcttgtgtaaacctcacccataatgtattgcctatcatggctagatcttatttttttaaagttgttgtgtaatctgagtccaaaacctttagatttctataatttttatagttgttccctctgtatctaatccaaaagacctaggagttattctcctctataaatctttgcaaagcattcaacatagcattcatggaaataactcccccttttttctcattcatatttcatcagttatggaattaaattacataattacagtgacatctacaaccagcatgagtagctttgggaacaagcataacatataagcatagaactcaactggtgggagcagaagctgctagcatgccgacagtaccagcctagcctccagctgagtggccagggacactagttagtgtgttttacaggccactcaacaatgtagattagtgtagcatcagatgagtggatgctaagagaattaccactgtaaagataacatattcttttaaatgtatagtcacagtcattcctgcatcatgaatagcaccacagccaagacccaactttaggccactgctccccttgaaattactctctttgatgttattgataacatttttctggttaaatctaaccattctttcctctgtgctcatcttccttgactgaatagcttctttcttggaacttgcatcttttggcctttatgatgttgttctcctattcaacttcacctcttaccccctcgtctttcgagagaataacagtaaaatgtaatttatgtgtgttacaatttgtagtttcacagcattctcacatccacaatcacttttgatcttcactactttggggcaaaaacagtcctaaaccaggaagtaggaaatttgtgattggataagtctttattataatgtgttatctctcatgtgccaagactatgctaggttctgtggttgaaccaatggaagttatggtcctggccctcaaagagctcacagtttgaacaccaggtaaacagacaatagggagtgtttggagctcagaagaggaggaaataaataacaaaacaaggggaaggcttctgacttaaattttggtggatgcctatatatataccagtaaaaagtaggtgagaggaaagtatatcccagcagtcctggagatatgaggcaacttgttggattcagagaactagaagtagcttaggatggctggaacataggctatattagaagaaaagaaaagctaagatgaagacattcctgtgcaggctgtgaatttggattttctagtagtatgtgtaagcttagcacagggtctggcacatgtggtaagggctcagtaaatggtagctattattttatattgaagacactggggcagttttaagcagaggaattatatattcaaatttgtgtttaaaaagatgattctggcaacagacaaaatatcttgggactggggtcagctgatcttggttgttccaaggctgttgcagtaatcccagcaagtggtagtgaggtgacatttttctccaatgtctcctgtgagtttcctctcttatcaagtagtatttctgagggcagaacttttgcctcccacttattacactgtagacatatacagtaaaatcttaataagtacttattgcgtaaggaaatttttctgggctaggaatataactcccatgtgctttagagtggttttcctttctttctatttcaaacaattgtgcctttatcaacaagctgaattcttaggtgttcttgattagtagccctgaattaggctctgggttttttttttagtttttctttggtaggagtgggatggagtctcactctgttgcccgggctggagtgcagtggcacaatcttggctcaccgcaacctctacctcctgagttcaagtgattcccctgcctcagcctcccgagtagctaggactacaggtgcatgccaccacgcccagctaatttttgtatttttagtagagatggggtttcaccatgttggcgaggctggtctcaaactcctgacctcaagtggtcggcccaccttggcctcccgagtgctaggattacaggcatgaactaccacacccggcccaggctctgggtttttaggcaacacagttatttgactgtacagatttttagagtttttacttatttaatagttcagaaatatgtaatttatatttgaaaaggattattcttgagcccagtgtgagattaagtttcaccaccaatttaattgcatctactgttggtagagccaacagctaattaatgaggctgtcacatttacttatagcgccatttacggtttttaaattcggttactttttattatttgtgccatagtaatgtctttttatttaaattattaaatgttacaacattttatctttttattttaggttggaaaatcaccaaaagataggttatgccgaagggtaagtgaatctcccatagctagaattatggttgttaattccacacttttatgtagtactttattaactgtataggtgaactttgccttttatcattgtgatgacgtatcagaaggagataagaaaaatgaaaagagaatactgcattaaggaaactggtcatgaactatggccagttttaatttacttttccagattgttagatagcatattaaactaggtttttataagatgttgttcagctttgaactgtgaacaggttaacatgctaccattgctgcatattccgattagacatttataatggaagcatccaacatcaaattgaagcaggttcaaatgaagtagttaatttgatctacctatatatatgatatatataataacataagtatacaaatacaacattagtcttaactaatattctaatccatggatatgggacttgtatttgacccaagaaattaatagtactagcttccattgttgaagactttttctgatgtgttcttgagaatggttgtatgactagagtgtgtacgtgtgtgtgcatgcatgtgtgtgtgcatgtacccacaaacactgaattatttgctttggggatgtgaggaaattataagattgttggttttaaaaagattatatggcagggcgcggtggctcacgcctgtaatcctagcactttggaaaggcgaggctggtggatcacctgaggtcaggagtttgagaccagcctgaccaacaaggtgaaaccccatctctactaaaaatagaaaaactagccaggcatggtggtgggcgcctgtaatcccagctactcaggaggctgaggcaggataatcgcttgaacctgggaggtggaggttgcagtgagccgagatcgtgccactgtactccagcctgggcaacaagaatgaaactctgtctcaaaaaaaaaaaaagattatacacaaatgcagtggtcccttggacaagccctttaaaggagtcattgagaatcgtctgttgctcacagcatcaatctggtatttagttctcaagcttgaggattctagttttgctcagagggtcgggttcagtctctaaaagacgctctgaaagcagaccaggctgttttcttggagcttttcaggttagattctcatgtgtgtatcttccatctaccacgattatttggctaccagatgccttagcaagctgaacagtgagctcagaagtgccaccatctatagtaactaatgaggctgtttctttacaatacacaaagaacactactttttaaaagtcaatatttataccactttgtaaagcttgactttaaaattggttgacagtaaatctaaaagaaggaacttaaatatgctaatgccttgactttcaaattcttgcctgtctattcagtgtggaaagtcagctgaaccagtgtattgtatcctggttcttgtttggctgacagtaactatagcagttttcctgcagggcctaattacgttcctttttaaaaaacaggatgtgggaatgagtgacacagcaatgacatctttcctcggctcctgtttggatcttcttcagatcttaatggaggtaaaagaggtgtatttttcattctgaactgctcctaagatattacatattctgcaaaccattgcatttaataaatgactattttaatgaggttgtttttcattcattcatttctaaattttgacttgagcccagaaggtagtgatgttttcttattaaattcttattgaaattagactttgtgtttttttattacaatttgggacagtgtgcaatatgaatttgcactttgctgctaataaactcattgggatatttgtaagctattatttttccattactgaacacagtcctccattctcaaaacccttaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaaggtaagtacctcacaggatttcagagctattttggagttgcaggcttagcagacacatggattttcatatttaatagaagctgtccagtacttttgtgactggtataatttggtgtgaggttccaactccctcattccctgcttgattccgttctttttatttaccttctgtactgctccccttggagttttgccctctcagctgtctgctcttctcattctccatattattcctggacagactcattttctccctcttatatatctctaggcctgaccaatccctagagtttgaggcattcatttcttttgaacttctctctttgagtgtcttataggacttcagacacctcatatctaaaatatatctgcaaaccaatacccacatcctgcccctaacctaaatttgctgttccttctgaattccctgacttggttattttattaacgatgtcatcatttttgccctggcaaaaactagaaactttgaagttatctcaccaattccttacttcaagccaattttcttcattgtaaattcattcttgtaaattctgccatagatcatgcctgtccgtttctctccatgactataaccctagttcaggcataatcatctttccctcggctattacaacagccctttcttaatcacgctgcctccagtttctctctctccagtcccatgctgcaagagctgtcttcctaagagacaggtttaattgtattagttctatacctaagattttttttggctcctctgcaggatcaagtccaaatttgtgagtagaatatgtttttacatattctattgtaaccttcacagtttagctgcagtggatagtaaaatcctttccttccccacgcaggtgtcaaattttgagagacaggacaaactgttggagacaaaaacgtcaacattattacttagctttttactgatagaagctgggttagagaacacagcttaggcttgtgggaaagtgggtttattatttcacccttaaatgagagactcccggacagtcatggtggctcacacctgtaatcccagcactttgggaagacaaggtgggcagatcacttgaggtcaggagtttgagaccagcctggccaacatggtgaaaccctgtcactagtaaaaacacaaaaactagccaggcatggtggtgtgtgcctgtactcccagctacttgggaggctgaggcaggataatcgcttgaacctgggaggcagaggttgcagtgagccaagatcacaccactgcacttcagcctgggccacagagtgagactctgtctcaaaaaaaaaaaaaagtatagattttgaatgagttagtatatctttgagaatataagcgataagagtacttaaaagttaaaaaagagaaagaaataccaaaataaagtgcctagctcagtattcccatcagaaaaggcctttgtgaaaccagaacacatccagaattggattagcacaataatgtttagtttcaacccatgtcatgccaagactacctgagacagctgggtgacactcatctgcagagagctagtatggttgagtggctagtgaaaacaatcccggtgctaccatttgctaactagaattatttagattttcttactctcagttttctcattcagaaagtagcagtgccagcctcatggttgttgtaagggttccttgtattcaacatgaagtacttagcagcatctggaatgtagtaaataataagtggtgctattatagatgctatagctaggaccaccaggtgggaactatcgagtaacagattgtgagtgtatgctaaatctttaaatacttctctcagtgatgtccaaaatgtcatgggttgccctgtaagtccggtttttcttatcactaaaggatgagtagctttaatctacttggcagtcacaacagatgacctagaatcacagatgattaggtatggaaggcacattggaagatacctaggatgacctgcttgcagaagaagaaacggtaacccaagattgtgggtcatttacccaaggcaacctggatggaagtggtgagccttggactagacccaggtctttcaacttaaaggccaatgttctttgctctgtattacatttccttccaaggaacttctaaaatcctgtttcctgatattctgtttttactctttagacacacatctgttcttttaaataaggtgtttttaaacaattcaacaagtgtttttaaaaggattcagaggctgggcgcggtggctcatgcctgtaatcccagcactttgggaggctgaggcgggcagatcacctgaggtcaggagtttgagacctgcctggccaatatggtgaaaaccccgtctctactaaaaatacaaaaaaattagccttggcgtggtagtacacgcctgtagtcccagctacttgggaggctgaggtgggagaatcgcttgaaccaggaaggtggaggctgcagtgagctgagatcacaccactgtactccagcctaggcaacagagtgagactctgtctcaaaaaaaaaaaaaaaaaggattcagggtacatatatgtattacttagctattactgcggagtaaatcatcccaaaacttggctgaaaataacaaatatttattatctcacagttgttgtgggtcagtaatctgtgttctccttatctaggtgcctctggcttagtctctcatgaggctgtagttaaggtgctgcatctgaaagctcaactgggatggggacagggtgattcacttctaagcacaattgttggcaagattcagttatgccacatgtgcctctccatacagcagctcacaacacggaacctggcttcctgcagaacaagtgagagtgaatatgagtgcctcaaggcagaagaagcagtcttttggaacgtggtcttggaagtaacatgtatcacctctacctgcttctgttgctagaagcaagtcatcagcctccatgcaaggagaggagactataggaaacacgaataccaggaggaggggatcactgggtttcatcttaaaggctgtctactatatactagataattgttataaaaattattctaaaatcttactgttcaaggagaaataaaaatcaaccataagttattattaagttttaaacaaatctttctccctctccccccttaataatccacactcatcagttttcttgctctctttctttttagggaaaaaatgcatttttcaaagacctaacttcaattcagttattacctagtggggaaatggatccaaattttatttctgtacgacaacaggtaaattatagctattggattttgtttttgtttcttggaaaaaaaaacataagggaaaaatctagctggcttttgaaaagaatgactactttctatcgcaaggacagaaaaccaaacagcacatgttctcactcataggtgggagttgaacaatgagaacacttggacacagggtggggaacatcacacaccagggcctgtcgtggggtggggggaagggggagggatagcattaggagatatacctaatgtaaatgatgacttaaggggtgcagcacaccaacatggcacatgtatacatatgtaacaaacctacacgttgtgcacatgtaccctagaacttaaagtataataataaaaaataataataatatttaaaaaagaccaatttcaaagtattcttgagagctagttgtttaaatgatgtgttccttttttgataactaaacaatttaatggaaaagccactataagtgacagaaaagctaacaatacttggtttaggtattttaaaatgaaacagtaacaatgcattgctctatctctttctccattttcaagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggtaatcatgaccctttgaatgttaattgggctcaagttataaaattgatagttggaataaagaatcagttaagtttccaatgaagccttttgctcttccttttattagaacatctaggtataaaaatagaacaatagaatattttttaaaacataaaattataatcaaataattcctacagtgtgccaggcctgccctacgcacagggatatagcagtaaacaaaacagacaaggttccttcatcatggacttgatagtctgctggtaggagcagaaaagcatgctaaattttgcattgaatgataggtgctatgaagaaaataaagagggccgggtgtcgtggctcacacgtgtaatcccagcactttggaaggctcaggtggcagatcacttgagcccagaagctcgagaccaatctgggcaatatagcgagaccccgtctctaaaaaggaaaaaaatatttatttttaaattgaaaaagaaagaaacaggatcatatgaataaacaggagccactacagtagagtggtcagagaaggtgacatttgaaccgagcccccaaggagaagcagcagccagctactcagaaactgggggaacagtgcttgagacaagaattacaaaggccctgaggtggggactagaatgactaggtccaggactagaaaggccagtatggctgaccaaacatagtaagcaaggaataaagaagtatggcatgaggcagggaggctggcccgggccatggccctatcctaggtctcggagcccatggttattctaagtgtattcagaagccattagaggggctgggcgtggtggctcacgcctgtaatcctagcactttgggaggccaaggtgggtggatcacttgaggtcaggagttcaagaccagcctgggcaacatggtgaaaccctgtctctactgaaaatacaaaaaattagctgggcgtggtggcatgtgcctgtaatcccagctacttgggaggctgaagcaggagaatcgcttgaacccaggaggtggaggctgcagtaagctgagattgcaccactgcactccagcttgggtggcagagtgagactccatctcaaaaaacaacaaaaaaaagccattagagggtttcaaatagacatgacatgaaactccttttatttgccaaaagtttgaaaacagcacactgagtagccacattgaattgaaagattaggtgatgagagaaaaaaaaattaaccaaggaacagaaatttgggtttaaatgctaagtttgatttggatttatctttggttgtatacaatcaaaagataaatggccacagttcaaaaatcaactagaatctcttcactggcaacccctttcctatagaataaacaaatctgctcactctgactgtattatttctccatgttcctatcttcaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggtcagtacaatagaacgagatcaggcaaaaggtcattggatgttttcttgagtgcctggttaataacagttatgaagaaaatttgacaagtttaattcacctagttacaaagaaaagcatttttatgtaataactcttaagtcaataacaattattgtttagttgtctataataggttatttttgtgtcccatttgcaggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttc

SEQ ID NO: 36147 - DNA, 3236 bp, Homo sapiens
aaacagccggggctccagcgggagaacgataatgcaaagtgctatgttcttggctgttcaacacgactgcagacccatggacaagagcgcaggcagtggccacaagagcgaggagaagcgagaaaagatgaaacggaccctgtgagtatggctttcttccctctcccgccaccccctgccccacactgcaagctgcaaacgcggtactttcgggctcgcctttgacgttaggaaactagcctgagcctatgcagggaaaaaaaatcgaaaaggtcaatttgttaagtaaggttaaatctgggtgatgctcgggtacagtttaagaaccgagggagacagttgatatgagggcggtggttgatgcgctaagaaattgcgggttggctttttgtcctcctgcattcaaaatgacatcagaatcctgcggctgaagcgcgtccccagcattcatacgttgcatgatgagttctcatcagcttacacagctactggaaggtgatgctcttgctggttctgaatatactcgtttaaaatccatttttgttttttaattatagagcagatctcacccagtccgaatgtggaacaaataattgttatgcagcgtctgcttaaaagaagtgtcgtaggtggggaaggaagagcgcaggggaatcagtcacccacctctttgtacagtctctggcgtggtccagaacctcctgctctaaagagagaagcgtgggccggctccagacagttccatgtctgtccttttcattaaagtgcaaaacgtctcggaattgtaattaaccttgcaaacaaactgatgccctttgtgagccagaaatagtgtctgccttttgaactaaattcattaacaattctttaaaataccctagtgattataggtagccctgcccttagttgtaaaactagtagatacggtcagattaatggacgaaactgctcagtacatgaggtttaaatgttaggtggataagacttatttgaagagttcttgctttgccttatgcggtttgtctctagttactgggtgactttatttggtaaaaatgcgttcagctgcagtagcatattcaagtgttgctagttagtaattatctttttaattttttgttttagtttaaaagattggaagacccgtttgagctacttcttacaaaattcctctactcctgggaagcccaaaaccggcaaaaaaagcaaacagcaagctttcatcaagtaagttgagaatcctgtgcttgcaaatatcaatagttagctgctgaactgaaaaggggaactctgatgtgcgtaagctaacatacagaacctctcttgcaggccttctcctgaggaagcacagctgtggtcagaagcatttgacgagctgctagccagcaaatgtaagttaactcttgagcttgagccattgctaacatcgcaaaagcctggaaaggctgcgtccacctaacaaaagagcagcttgcctgagggggattagactgcagtcactataggataaagcctgtttttctttcctttatttcccagggtttaacaaataaatgcatatattctctccaggtggggaagaaaatcagcctaaacaaattaaagtggcagttgcttatagttaaggttgagtcagtttttccattgcatacaatgttttcaagaggcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatgtgagggataggagaaacataaggaatcatttggtctctcagttcttcacattctgcatgctctcttttctccccccttcagatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagaggtaaggaaacaagttcctaatttcagcacaatctggacatctttagcacaaaagtgaaacaaagtaatcaaggacaaagcgggctaggaggggtaaaaagtccctccacgttgtagctttcagttatgttaaagttctcctgtgacttagctagtaaagctaatcacacataatttttattttttgttttcaaatactaaattttaatctttaactctgaataccaaataaacaacttttttgttttatttcagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaac
